(12) United States Patent
Cargill et al.

(10) Patent No.: US 7,811,794 B2
(45) Date of Patent: Oct. 12, 2010

(54) GENETIC POLYMORPHISMS ASSOCIATED WITH RHEUMATOID ARTHRITIS, METHODS OF DETECTION AND USES THEREOF

(75) Inventors: Michele Cargill, San Francisco, CA (US); Ann Bethea Begovich, El Cerrito, CA (US); Heather Camille Alexander, Alameda, CA (US)

(73) Assignee: Celera Corporation, Alameda, CA (US)

( * ) Notice: Subject to any disclaimer, the term of this patent is extended or adjusted under 35 U.S.C. 154(b) by 529 days.

(21) Appl. No.: 10/803,180

(22) Filed: Mar. 18, 2004

(65) Prior Publication Data

US 2007/0031848 A1 Feb. 8, 2007

Related U.S. Application Data

(60) Provisional application No. 60/455,444, filed on Mar. 18, 2003, provisional application No. 60/465,241, filed on Apr. 25, 2003.

(51) Int. Cl.
C12P 19/34 (2006.01)
C12Q 1/68 (2006.01)
C07H 21/02 (2006.01)
C07H 21/04 (2006.01)

(52) U.S. Cl. ............ 435/91.2; 435/6; 536/23.1; 536/24.33

(58) Field of Classification Search ............ None
See application file for complete search history.

(56) References Cited

OTHER PUBLICATIONS

Hacker UT et al 'Lack of association between an interleukin-1 receptor antagonist gene polymorphism and ulcerative colitis.' Gut. May 1997;40(5):623-7.*
GenBank GI:16874864 'Homo sapiens chromosome 3 clone RP11-78O10, Working Draft Sequence, 8 unordered pieces' 2001, pp. 1-48.*
Criswell LA et al 'Analysis of families in the multiple autoimmune disease genetics consortium (MADGC) collection: the PTPN22 620W allele associates with multiple autoimmune phenotypes.' Am J Hum Genet. Apr. 2005;76(4):561-71.*
Begovich AB et al 'A missense single-nucleotide polymorphism in a gene encoding a protein tyrosine phosphatase (PTPN22) is associated with rheumatoid arthritis.' Am J Hum Genet. Aug. 2004;75(2):330-7.*
Lee AT et al 'The PTPN22 R620W polymorphism associates with RF positive rheumatoid arthritis in a dose-dependent manner but not with HLA-SE status.' Genes Immun. Mar. 2005;6(2):129-33.*
Harrison P et al 'Effects of PTPN22 C1858T polymorphism on susceptibility and clinical characteristics of British Caucasian rheumatoid arthritis patients.' Rheumatology (Oxford). Aug. 2006;45(8):1009-11.*
Chen JY et al 'Association of rheumatoid factor production with FcgammaRIIIa polymorphism in Taiwanese rheumatoid arthritis.' Clin Exp Immunol. Apr. 2006;144(1):10-16.*
'Date Changes that Occur Between Builds' from the SNP FAQ Archive, acessed online on Oct. 28, 2008 at: http://www.ncbi.nlm.nih.gov/books/bv.fcgi?rid=helpsnpfaq.section.Build.Data_Changes_that_Oc printed pp. 1-3 provided.*
DataBase EMBL Online ! Jun. 9, 1995, "Homo sapiens (clones HGPCD2 and HGPCD15) pterin-4a-carbinolamine dehydrates (PCBD) gene, complete cds." XP002310444 retrieved from EBI accession No. EM_HUM: L41560; Database accession No. L41560.
Thony Beat et al.; "Characterization of the Human PCBD Gene Encoding the Bifunctional Protein Pterin-4-Alpha-Carbinolamine Dehydratase/Dimerization of cofactor for the Transcription Factor HNF-1-Alphe" Biochemical and Biophysical Research Communications, vol. 210, No. 3, 1995, pp. 966-973, ISSN: 0006-291X.
DataBase EMBL 'Online!; Apr. 9, 2000, "Homo sapiens chromosome 10 clone RP11-29P24 map 10, Working Draft Sequence, 17 unordered pieces." XP002310248 retrieved from EBI accession No. EM_HTG: AC023639.
DataBase EMBL 'Online!; Jun. 8, 2000, "Homo sapiens chromosome 10 clone RP11-205C5, complete sequence." XP002310249 retrieved from EBI accession No. EM_HUM: AC069538.
DataBase EMBL 'Online!; Sep. 6, 2001, "603189135F1 NIH_MGC_95 Homo sapiens cDNA clone iMAGE: 5260425 5', mRNA sequence." XP002310466 retrieved from EBI accession No. EM_EST: BI548743; Database accession No. BI548743.
WO 01/11084 A (Kimberly Robert P; UAB Research Foundation (US); Gibson Andrew (US) Feb. 15, 2001 p. 8, line 5—p. 14, line 17 claims 7,8.
WO 02/074989 A (Gough Stephen; Todd John (GB); Ueda Hironori (GB); Catalyst Biomedica Sep. 26, 2002 p. 42, line 22—p. 45, line 5; claims 1-4.
Morgan Ann W et al.; "Fogamma Receptor Type IIIA is Associated with Rheumatoid Arthritis in Two Distinct Ethnic Groups" Arthritis and Rheumatism, vol. 43, No. 10, Oct. 2000, pp. 2328-2334, XP002288078; ISSN: 0004-3591.
Waldron-Lynch F et al.; Tumor Necrosis Factor 5' Promoter Single Nucleotide Polymorphisms influence Susceptibility to Rheumatoid Arthritis (RA) in Immunogenetically defined multiplex RA Families; Genes and Immunity; Apr. 2001, vol. 2, No. 2, Apr. 2001, pp. 82-87, XP009082935; ISSN: 14664879.
Yamada R et al.; "Association between a single-nucleotide polymorphisms in the promoter of the human interleukin-3 gene and rheumatoid arthritis in Japanese patients and maximum-likelihood estimation of . . . Effect that two genetic loci have susceptibility to the disease"; American Journal of Human Genetics, American Society of Human Genetics, Chicago, IL, US, vol. 68, No. 3, 2001, pp. 674-685, XP002972306; ISSN: 0002-9297.
Thony B, et al.; "Hyperphenylalaninemia with High Levels of 7-Bioptern is associated with Mutations in the PCBD Gene Encoding the Bifunctional Protein Pterin-4A-Carbinolamine Dehydratase and Transcriptional Coactivator (DC0H)."; American Journal of Human Genetics; Jun. 1998, vol. 62, No. 6, Jun. 1998, pp. 1302-1311, XP002310443; ISSN: 0002-9297.
International Search Report and Written Opinion dated Mar. 2, 2005.
Van Oene, Mark, et al., "Association of the Lymphoid Tyrosine Phosphatase R620W Variant with Rheumatoid Arthritis, but not Crohn's Disease, in Canadian Populations," Arthritis and Rheumatism, vol. 52, No. 7, Jul. 2005, pp. 1993-1998.

* cited by examiner

Primary Examiner—Stephen Kapushoc

(57) ABSTRACT

The present invention is based on the discovery of genetic polymorphisms that are associated with rheumatoid arthritis. In particular, the present invention relates to nucleic acid molecules containing the polymorphisms, variant proteins encoded by such nucleic acid molecules, reagents for detecting the polymorphic nucleic acid molecules and proteins, and methods of using the nucleic acid and proteins as well as methods of using reagents for their detection.

10 Claims, 1 Drawing Sheet

GENETIC POLYMORPHISMS ASSOCIATED WITH RHEUMATOID ARTHRITIS, METHODS OF DETECTION AND USES THEREOF

FIELD OF THE INVENTION

The present invention is in the field of diagnosis and therapy of autoimmune diseases such as rheumatoid arthritis. In particular, the present invention relates to specific single nucleotide polymorphisms (SNPs) in the human genome, and their association with rheumatoid arthritis and related pathologies such as other autoimmune diseases. Based on differences in allele frequencies in the rheumatoid arthritis patient population relative to normal individuals, the naturally-occurring SNPs disclosed herein can be used as targets for the design of diagnostic reagents and the development of therapeutic agents, as well as for disease association and linkage analysis. In particular, the SNPs of the present invention are useful for identifying an individual who is at an increased or decreased risk of developing rheumatoid arthritis and for early detection of the disease, for providing clinically important information for the prevention and/or treatment of rheumatoid arthritis, and for screening and selecting therapeutic agents. The SNPs disclosed herein are also useful for human identification applications. Methods, assays, kits, and reagents for detecting the presence of these polymorphisms and their encoded products are provided.

BACKGROUND OF THE INVENTION

Autoimmune Diseases & Rheumatoid Arthritis

Autoimmune diseases are a major health issue, occurring in up to 3% of the general population (Cooper & Stroehla, 2003, *Autoimmunity Rev.* 2:119-125). Although the clinical phenotypes of these diseases are distinct, they share certain common elements, including geographical distributions, population frequencies, therapeutic strategies, and some clinical features which suggest potential similarities in the underlying mechanisms of these diseases. Furthermore, the co-association of multiple autoimmune diseases in the same individual or family supports the presence of common environmental and genetic factors that predispose an individual to autoimmunity (Vyse & Todd, 1996, *Cell* 85:311-318; Cooper & Stroehla, 2003, *Autoimmunity Rev.* 2:119-125; Ueda et al., 2003, *Nature* 423:506-511).

While the major histocompatability complex (MHC) is a known susceptibility locus for many autoimmune diseases, a recent comparison of 23 autoimmune or inflammatory genome-wide scans or linkage studies have uncovered a clustering of non-MHC susceptibility candidate loci (Becker et al., 1998, *Proc. Natl. Acad. Sci. USA* 95:9979-9984; Jawaheer et al., 2001, *Am. J. Human Genet.* 68:927-936). Examples of autoimmune diseases are rheumatoid arthritis, type 1 diabetes, multiple sclerosis, systemic lupus erythematosus, inflammatory bowel diseases, psoriasis, thyroiditis, celiac disease, pernicious anemia, asthma, vitiligo, glomerulonephritis, Graves' disease, myocarditis, Sjogren disease, and primary systemic vasculitis.

Rheumatoid arthritis (RA) is one of the most common autoimmune inflammatory disorders, with a prevalence of between 0.5-1% in most adult populations. It is found worldwide and affects all ethnic groups, although it is more common in Europe and the United States than in Asia (Abdel-Nasser et al., 1997, *Semin. Arthritis Rheum.* 27:123-140; Silman & Hochberg, 1993, Rheumatoid Arthritis, *Epidemiology of the Rheumatic Diseases*, Oxford University Press, pp. 7-68) and there is a gradient in Europe with a higher prevalence in the north (Cimmino et al., 1998, *Ann. Rheum. Diseases* 57:315-318). RA can also occur in any age group. Onset is typically between the ages of 40 and 60 years, and the incidence increases with age until approximately 70-80 years, at which point it declines (Abdel-Nasser et al., 1997, *Semin. Arthritis Rheum.* 27: 123-140; Silman & Hochberg, 1993, *Epidemiology of the Rheumatic Diseases*. Oxford University Press. pp. 7-68). RA is two to three times more common in women than men, depending on age (Linos et al., 1980, *J. Chronic Diseases* 33:73-77). The observations that (i) women in the postpartum period are at increased risk for RA onset and (ii) women with RA commonly experience remission during pregnancy followed by postpartum relapse (Barrett et al., 1999, *Arhritis Rheum.* 42:1219-1227) suggest that hormones play a role in disease onset.

RA is a chronic, progressive disease of unknown etiology characterized by the infiltration of activated lymphocytes and macrophages into the synovial lining of the affected joint. These cells produce cytokines and degradative enzymes, which mediate inflammation and destruction of the joint architecture, often leading to permanent disability. RA is a systemic disease; extra-articular manifestations are often present and can range from relatively minor problems, such as rheumatoid nodules, to life-threatening organ disease.

Clinically, RA is a highly heterogeneous disease varying from very mild to severely disabling disease with upwards of one in 20 patients progressing to severe, erosive disease. Joint damage occurs early in disease with the greatest progression to joint abnormalities taking place during the first six years. Within three years of disease onset, as many as 70% of patients show some radiographic evidence of joint damage (Lipsky et al., 1994, Rheumatoid Arthritis, *Harrison's Principles of Internal Medicine*, 13th ed. New York, McGraw-Hill, Inc., pp. 1648-1655). At present, there is no cure for RA, and the joint damage is irreversible.

Although the course of RA is highly variable, most patients with clinical, persistent RA eventually develop debilitating joint damage and deformation, resulting in progressive functional limitation. Consequently, RA is considered a highly disabling disease with a considerable economic impact that some liken to that of coronary artery disease (Allaire et al., 1994, *Pharmacoeconomics* 6:513-522). A 1993 study in the U.S. estimated total annual direct costs of $5275 per patient with indirect costs as high as $21,000 per year (Merkesdal et al., 2001, *Arthritis Rheum.* 44:528-534).

RA is thought to be a complex disease precipitated by the interplay of environmental and genetic factors. Although several environmental triggers have been suggested, such as infection (Harris, 1990, *N. Engl. J. Med.* 322:1277-1289), immunization (Symmons and Chakravarty, 1993, *Ann. Rheum. Dis.* 52:843-844), diet (Shapiro et al., 1996, *Epidemiology* 7:256-263), and smoking (Symmons et al., 1997, *Arthritis Rheum.* 40:1955-1961), none have been established. A genetic component to RA susceptibility has long been indicated by data from twin and family studies. It is estimated that the concordance between monozygotic twins is in the range of 12-15% while the prevalence in siblings of RA probands is approximately 2-4%, both well above the estimated background population prevalence of 0.5-1% (Seldin et al., 1999, *Arthritis Rheum.* 42:1071-1079). From these data, the disease heritability has been estimated at approximately 60% (MacGregor et al., 2000, *Arthritis Rheum.* 43:30-37) while the relative recurrence risk for siblings ($\lambda$s) of probands with RA is estimated at between 5 and 10 (Seldin et al. 1999; Jawaheer et al., 2001, *Am. J. Hum. Genet.* 68:927-936).

Among the many genetic studies of small cohorts, the only genes consistently associated with RA to-date are the MHC, i.e. human leukocyte antigen (HLA)-linked genes, on the short arm of human chromosome 6. It has been estimated that approximately one-third to one-half of the total genetic contribution to RA can be attributed to genes within the HLA complex (Deighton et al., 1989, *Clin. Genet.* 36:178-182). This observation has been supported by three recent genome-wide scans using RA-affected sibling pairs (Cornelis et al., 1998, *Proc. Natl. Acad. Sci. USA* 95:10746-10750; Jawaheer et al., 2001, *Am. J. Hum. Genet.* 68: 927-936; MacKay et al., 2002, *Arthritis Rheum.* 46:632-639). The vast majority of HLA studies of RA have focused on a direct role of HLA-DRB1 alleles that encode a common structural element, but recent evidence suggests that the HLA association is more complex and probably involves other loci within this gene complex. Despite over 20 years of research, it is still unclear whether the implicated HLA-DRB1 alleles are involved in RA susceptibility or severity of disease (Weyand et al., 1998, *Springer Semin. Immunopathol.* 20:5-22; Fries et al., 2002, *Arthritis Rheum.* 46:2320-2329).

The increasing availability of specific therapies that can halt disease progression has magnified the need for accurate early diagnosis of RA (Maini et al., 1999, *Lancet* 354:1932-1939; Lipsky et al., 2000, *N. Engl. J. Med.* 343: 1594-1602; Weinblatt et al., 1999, *N. Engl. J. Med.* 340: 253-259). Unfortunately, classifying an arthritic disorder such as RA is challenging because no etiological agent has been identified and no clinical or laboratory features uniquely define the disease (Sangha, 2000, *Rheumatology* 39 (suppl. 2): 3-12). The most commonly used diagnostic criteria are those adopted by the American College of Rheumatology in 1987 (Arnett et al., 1988, *Arthritis Rheum.* 31: 315-324), which are based on a combination of clinical, laboratory and radiological assessments. A patient is classified as having RA if he or she satisfies at least four of the following seven criteria: (i) morning stiffness lasting at least one hour; (ii) arthritis of three or more joint areas; (iii) arthritis of hand joints; (iv) symmetric arthritis; (v) rheumatoid nodules; (vi) presence of serum rheumatoid factor (RF); and (vii) radiographic changes in hand or wrist joints. Using these criteria, a trained rheumatologist can usually diagnose RA in individuals who have had disease for more than 12 weeks (Harrison et al., 1998, *J. Rheumatol.* 25: 2324-2330). However, these criteria are largely ineffective for patients during early stages of the disease, such as during the first 12 weeks of disease (Green et al., 1999, *Arthritis Rheum.* 42: 2184-2188), during which time irreversible joint damage has already begun, and cannot predict which patients will develop severe erosive disease and therefore benefit from aggressive early disease modifying therapy.

Early initiation of therapy can provide considerable benefit, not only by reducing pain and inflammation but also by reducing or eliminating the loss of function that accompanies persistent RA, especially when therapy is administered prior to the occurrence of irreversible joint damage. Consequently, there is a need for novel diagnostic markers that enable the detection of RA at an early stage, or that enable the identification of individuals who are predisposed to developing RA. While genome-wide linkage scans of affected sibling pairs have revealed multiple linkage peaks (Cornelis et al., 1998, *Proc. Natl. Acad. Sci. USA* 95: 10746-10750; Jawaheer et al., 2001, *Am. J. Hum. Genet.* 68: 927-936; MacKay et al., 2002, *Arthritis Rheum.* 46: 632-639), specific disease-associated genetic markers have not previously been identified.

SNPs

The genomes of all organisms undergo spontaneous mutation in the course of their continuing evolution, generating variant forms of progenitor genetic sequences (Gusella, *Ann. Rev. Biochem.* 55, 831-854 (1986)). A variant form may confer an evolutionary advantage or disadvantage relative to a progenitor form or may be neutral. In some instances, a variant form confers an evolutionary advantage to the species and is eventually incorporated into the DNA of many or most members of the species and effectively becomes the progenitor form. Additionally, the effects of a variant form may be both beneficial and detrimental, depending on the circumstances. For example, a heterozygous sickle cell mutation confers resistance to malaria, but a homozygous sickle cell mutation is usually lethal. In many cases, both progenitor and variant forms survive and co-exist in a species population. The coexistence of multiple forms of a genetic sequence gives rise to genetic polymorphisms, including SNPs.

Approximately 90% of all polymorphisms in the human genome are SNPs. SNPs are single base positions in DNA at which different alleles, or alternative nucleotides, exist in a population. The SNP position (interchangeably referred to herein as SNP, SNP site, SNP locus, SNP marker, or marker) is usually preceded by and followed by highly conserved sequences of the allele (e.g., sequences that vary in less than $1/100$ or $1/1000$ members of the populations). An individual may be homozygous or heterozygous for an allele at each SNP position. A SNP can, in some instances, be referred to as a "cSNP" to denote that the nucleotide sequence containing the SNP is an amino acid coding sequence.

A SNP may arise from a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion or deletion variant referred to as an "indel" (Weber et al., "Human diallelic insertion/deletion polymorphisms", *Am J Hum Genet* 2002 October; 71(4):854-62).

A synonymous codon change, or silent mutation/SNP (terms such as "SNP", "polymorphism", "mutation", "mutant", "variation", and "variant" are used herein interchangeably), is one that does not result in a change of amino acid due to the degeneracy of the genetic code. A substitution that changes a codon coding for one amino acid to a codon coding for a different amino acid (i.e., a non-synonymous codon change) is referred to as a missense mutation. A nonsense mutation results in a type of non-synonymous codon change in which a stop codon is formed, thereby leading to premature termination of a polypeptide chain and a truncated protein. A read-through mutation is another type of non-synonymous codon change that causes the destruction of a stop codon, thereby resulting in an extended polypeptide product. While SNPs can be bi-, tri-, or tetra-allelic, the vast majority of the SNPs are bi-allelic, and are thus often referred to as "bi-allelic markers", or "di-allelic markers".

As used herein, references to SNPs and SNP genotypes include individual SNPs and/or haplotypes, which are groups of SNPs that are generally inherited together. Haplotypes can have stronger correlations with diseases or other phenotypic effects compared with individual SNPs, and therefore may provide increased diagnostic accuracy in some cases (Stephens et al. *Science* 293, 489-493, 20 Jul. 2001).

Causative SNPs are those SNPs that produce alterations in gene expression or in the expression, structure, and/or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a SNP within a coding sequence causes a genetic disease include sickle cell anemia and cystic fibrosis.

Causative SNPs do not necessarily have to occur in coding regions; causative SNPs can occur in, for example, any genetic region that can ultimately affect the expression, structure, and/or activity of the protein encoded by a nucleic acid. Such genetic regions include, for example, those involved in transcription, such as SNPs in transcription factor binding domains, SNPs in promoter regions, in areas involved in transcript processing, such as SNPs at intron-exon boundaries that may cause defective splicing, or SNPs in mRNA processing signal sequences such as polyadenylation signal regions. Some SNPs that are not causative SNPs nevertheless are in close association with, and therefore segregate with, a disease-causing sequence. In this situation, the presence of a SNP correlates with the presence of, or predisposition to, or an increased risk in developing the disease. These SNPs, although not causative, are nonetheless also useful for diagnostics, disease predisposition screening, and other uses.

An association study of a SNP and a specific disorder involves determining the presence or frequency of the SNP allele in biological samples from individuals with the disorder of interest, such as rheumatoid arthritis, and comparing the information to that of controls (i.e., individuals who do not have the disorder; controls may be also referred to as "healthy" or "normal" individuals) who are preferably of similar age and race. The appropriate selection of patients and controls is important to the success of SNP association studies. Therefore, a pool of individuals with well-characterized phenotypes is extremely desirable.

A SNP may be screened in diseased tissue samples or any biological sample obtained from a diseased individual, and compared to control samples, and selected for its increased (or decreased) occurrence in a specific pathological condition, such as pathologies related to rheumatoid arthritis. Once a statistically significant association is established between one or more SNP(s) and a pathological condition (or other phenotype) of interest, then the region around the SNP can optionally be thoroughly screened to identify the causative genetic locus/sequence(s) (e.g., causative SNP/mutation, gene, regulatory region, etc.) that influences the pathological condition or phenotype. Association studies may be conducted within the general population and are not limited to studies performed on related individuals in affected families (linkage studies).

Clinical trials have shown that patient response to treatment with pharmaceuticals is often heterogeneous. There is a continuing need to improve pharmaceutical agent design and therapy. In that regard, SNPs can be used to identify patients most suited to therapy with particular pharmaceutical agents (this is often termed "pharmacogenomics"). Similarly, SNPs can be used to exclude patients from certain treatment due to the patient's increased likelihood of developing toxic side effects or their likelihood of not responding to the treatment. Pharmacogenomics can also be used in pharmaceutical research to assist the drug development and selection process.

(Linder et al. (1997), *Clinical Chemistry*, 43, 254; Marshall (1997), *Nature Biotechnology*, 15, 1249; International Patent Application WO 97/40462, Spectra Biomedical; and Schafer et al. (1998), *Nature Biotechnology*, 16, 3).

SUMMARY OF THE INVENTION

The present invention relates to the identification of novel SNPs, unique combinations of such SNPs, and haplotypes of SNPs that are associated with rheumatoid arthritis and related pathologies. The polymorphisms disclosed herein are directly useful as targets for the design of diagnostic reagents and the development of therapeutic agents for use in the diagnosis and treatment of rheumatoid arthritis and related pathologies.

Since autoimmune diseases share certain similar features that may be due to common genetic factors that are involved in their underlying mechanisms, the SNPs identified herein as being associated with rheumatoid arthritis may also be used as markers for other autoimmune diseases. Such autoimmune diseases include, but are not limited to, type 1 diabetes, multiple sclerosis, systemic lupus erythematosus, inflammatory bowel diseases, psoriasis, thyroiditis, celiac disease, pernicious anemia, asthma, vitiligo, glomerulonephritis, Graves' disease, myocarditis, Sjogren disease, and primary systemic vasculitis. Moreover, the genes containing the SNPs identified herein, and the transcripts and proteins encoded by these genes, can be used in the treatment of other autoimmune diseases, in addition to rheumatoid arthritis. For example, the genes and encoded gene products can serve as targets for the development of therapeutic agents (e.g., small molecule compounds, antibodies, antisense/RNAi agents, etc.) or used directly as therapeutic agents (e.g., therapeutic proteins, etc.) for the treatment of not only rheumatoid arthritis, but various other autoimmune diseases as well.

Based on the identification of SNPs associated with rheumatoid arthritis, the present invention also provides methods of detecting these variants as well as the design and preparation of detection reagents needed to accomplish this task. The invention specifically provides novel SNPs in genetic sequences involved in rheumatoid arthritis, variant proteins encoded by nucleic acid molecules containing such SNPs, antibodies to the encoded variant proteins, computer-based and data storage systems containing the novel SNP information, methods of detecting these SNPs in a test sample, methods of identifying individuals who have an altered (i.e., increased or decreased) risk of developing rheumatoid arthritis based on the presence of a SNP disclosed herein or its encoded product, methods of identifying individuals who are more or less likely to respond to a treatment, methods of screening for compounds useful in the treatment of a disorder associated with a variant gene/protein, compounds identified by these methods, methods of treating disorders mediated by a variant gene/protein, and methods of using the novel SNPs of the present invention for human identification.

In Tables 1-2, the present invention provides gene information, transcript sequences (SEQ ID NOS:1-83), encoded amino acid sequences (SEQ ID NOS:84-166), genomic sequences (SEQ ID NOS:1662-1717), transcript-based context sequences (SEQ ID NOS:167-1661) and genomic-based context sequences (SEQ ID NOS:1718-6607) that contain the SNPs of the present invention, and extensive SNP information that includes observed alleles, allele frequencies, populations/ethnic groups in which alleles have been observed, information about the type of SNP and corresponding functional effect, and, for cSNPs, information about the encoded polypeptide product. The transcript sequences (SEQ ID NOS:1-83), amino acid sequences (SEQ ID NOS: 84-166), genomic sequences (SEQ ID NOS:1662-1717), transcript-based SNP context sequences (SEQ ID NOS: 167-1661), and genomic-based SNP context sequences (SEQ ID NOS:1718-6607) are also provided in the Sequence Listing.

In a specific embodiment of the present invention, SNPs which occur naturally in the human genome are provided as isolated nucleic acid molecules. These SNPs are associated with rheumatoid arthritis such that they can have a variety of uses in the diagnosis and/or treatment of rheumatoid arthritis. One aspect of the present invention relates to an isolated nucleic acid molecule comprising a nucleotide sequence in which at least one nucleotide is a SNP disclosed in Tables 3 and/or 4. In an alternative embodiment, a nucleic acid of the invention is an amplified polynucleotide, which is produced by amplification of a SNP-containing nucleic acid template. In another embodiment, the invention provides for a variant protein which is encoded by a nucleic acid molecule containing a SNP disclosed herein.

In yet another embodiment of the invention, a reagent for detecting a SNP in the context of its naturally-occurring flanking nucleotide sequences (which can be, e.g., either DNA or mRNA) is provided. In particular, such a reagent may be in the form of, for example, a hybridization probe or an amplification primer that is useful in the specific detection of a SNP of interest. In an alternative embodiment, a protein detection reagent is used to detect a variant protein which is encoded by a nucleic acid molecule containing a SNP disclosed herein. A preferred embodiment of a protein detection reagent is an antibody or an antigen-reactive antibody fragment.

Also provided in the invention are kits comprising SNP detection reagents, and methods for detecting the SNPs disclosed herein by employing detection reagents. In a specific embodiment, the present invention provides for a method of identifying an individual having an increased or decreased risk of developing rheumatoid arthritis by detecting the presence or absence of a SNP allele disclosed herein. In another embodiment, a method for diagnosis of rheumatoid arthritis by detecting the presence or absence of a SNP allele disclosed herein is provided.

The nucleic acid molecules of the invention can be inserted in an expression vector, such as to produce a variant protein in a host cell. Thus, the present invention also provides for a vector comprising a SNP-containing nucleic acid molecule, genetically-engineered host cells containing the vector, and methods for expressing a recombinant variant protein using such host cells. In another specific embodiment, the host cells, SNP-containing nucleic acid molecules, and/or variant proteins can be used as targets in a method for screening and identifying therapeutic agents or pharmaceutical compounds useful in the treatment of rheumatoid arthritis.

An aspect of this invention is a method for treating rheumatoid arthritis in a human subject wherein said human subject harbors a gene, transcript, and/or encoded protein identified in Tables 1-2, which method comprises administering to said human subject a therapeutically or prophylactically effective amount of one or more agents counteracting the effects of the disease, such as by inhibiting (or stimulating) the activity of the gene, transcript, and/or encoded protein identified in Tables 1-2.

Another aspect of this invention is a method for identifying an agent useful in therapeutically or prophylactically treating rheumatoid arthritis in a human subject wherein said human subject harbors a gene, transcript, and/or encoded protein identified in Tables 1-2, which method comprises contacting the gene, transcript, or encoded protein with a candidate agent under conditions suitable to allow formation of a binding complex between the gene, transcript, or encoded protein and the candidate agent and detecting the formation of the binding complex, wherein the presence of the complex identifies said agent.

Another aspect of this invention is a method for treating rheumatoid arthritis in a human subject, which method comprises:

(i) determining that said human subject harbors a gene, transcript, and/or encoded protein identified in Tables 1-2, and (ii) administering to said subject a therapeutically or prophylactically effective amount of one or more agents counteracting the effects of the disease.

Many other uses and advantages of the present invention will be apparent to those skilled in the art upon review of the detailed description of the preferred embodiments herein. Solely for clarity of discussion, the invention is described in the sections below by way of non-limiting examples.

Description of the Files Contained on the CD-R Named CL001511CDR

The CD-R named CL001511CDR contains the following five text (ASCII) files:

1) File SEQLIST_1511.txt provides the Sequence Listing. The Sequence Listing provides the transcript sequences (SEQ ID NOS:1-83) and protein sequences (SEQ ID NOS:84-166) as shown in Table 1, and genomic sequences (SEQ ID NOS: 1662-1717) as shown in Table 2, for each rheumatoid arthritis-associated gene that contains one or more SNPs of the present invention. Also provided in the Sequence Listing are context sequences flanking each SNP, including both transcript-based context sequences as shown in Table 1 (SEQ ID NOS:167-1661) and genomic-based context sequences as shown in Table 2 (SEQ ID NOS:1718-6607). The context sequences generally provide 100 bp upstream (5') and 100 bp downstream (3') of each SNP, with the SNP in the middle of the context sequence, for a total of 200 bp of context sequence surrounding each SNP. File SEQLIST_1511.txt is 5,586 KB in size, and was created on Mar. 17, 2004.

2) File TABLE1_1511.txt provides Table 1. File TABLE1_1511.txt is 1,203 KB in size, and was created on Mar. 17, 2004.

3) File TABLE2_1511.txt provides Table 2. File TABLE2_1511.txt is 4,641 KB in size, and was created on Mar. 17, 2004.

4) File TABLE3_1511.txt provides Table 3. File TABLE3_1511.txt is 11 KB in size, and was created on Mar. 17, 2004.

5) File TABLE4_1511.txt provides Table 4. File TABLE4_1511.txt is 16 KB in size, and was created on Mar. 17, 2004.

The material contained on the CD-R labeled CL001511CDR is hereby incorporated by reference pursuant to 37 CFR 1.77(b)(4).

LENGTHY TABLES

The patent contains a lengthy table section. A copy of the table is available in electronic form from the USPTO web site (http://seqdata.uspto.gov/?pageRequest=docDetail&DocID=US07811794B2). An electronic copy of the table will also be available from the USPTO upon request and payment of the fee set forth in 37 CFR 1.19(b)(3).

Description of Table 1 and Table 2

Table 1 and Table 2 (both provided on the CD-R) disclose the SNP and associated gene/transcript/protein information of the present invention. For each gene, Table 1 and Table 2 each provide a header containing gene/transcript/protein information, followed by a transcript and protein sequence (in Table 1) or genomic sequence (in Table 2), and then SNP information regarding each SNP found in that gene/transcript.

NOTE: SNPs may be included in both Table 1 and Table 2; Table 1 presents the SNPs relative to their transcript sequences and encoded protein sequences, whereas Table 2 presents the SNPs relative to their genomic sequences (in some instances Table 2 may also include, after the last gene sequence, genomic sequences of one or more intergenic regions, as well as SNP context sequences and other SNP information for any SNPs that lie within these intergenic regions). SNPs can readily be cross-referenced between Tables based on their hCV (or, in some instances, hDV) identification numbers.

The gene/transcript/protein information includes:
a gene number (1 through n, where n=the total number of genes in the Table)
a Celera hCG and UID internal identification numbers for the gene
a Celera hCT and UID internal identification numbers for the transcript (Table 1 only)
a public Genbank accession number (e.g., RefSeq NM number) for the transcript (Table 1 only)
a Celera hCP and UID internal identification numbers for the protein encoded by the hCT transcript (Table 1 only)
a public Genbank accession number (e.g., RefSeq NP number) for the protein (Table 1 only)
an art-known gene symbol
an art-known gene/protein name
Celera genomic axis position (indicating start nucleotide position-stop nucleotide position)
the chromosome number of the chromosome on which the gene is located
an OMIM (Online Mendelian Inheritance in Man; Johns Hopkins University/NCBI) public reference number for obtaining further information regarding the medical significance of each gene
alternative gene/protein name(s) and/or symbol(s) in the OMIM entry NOTE: Due to the presence of alternative splice forms, multiple transcript/protein entries can be provided for a single gene entry in Table 1; i.e., for a single Gene Number, multiple entries may be provided in series that differ in their transcript/protein information and sequences.

Following the gene/transcript/protein information is a transcript sequence and protein sequence (in Table 1), or a genomic sequence (in Table 2), for each gene, as follows:
transcript sequence (Table 1 only) (corresponding to SEQ ID NOS:1-83 of the Sequence Listing), with SNPs identified by their IUB codes (transcript sequences can include 5' UTR, protein coding, and 3' UTR regions). (NOTE: If there are differences between the nucleotide sequence of the hCT transcript and the corresponding public transcript sequence identified by the Genbank accession number, the hCT transcript sequence (and encoded protein) is provided, unless the public sequence is a RefSeq transcript sequence identified by an NM number, in which case the RefSeq NM transcript sequence (and encoded protein) is provided. However, whether the hCT transcript or RefSeq NM transcript is used as the transcript sequence, the disclosed SNPs are represented by their IUB codes within the transcript.)
the encoded protein sequence (Table 1 only) (corresponding to SEQ ID NOS:84-166 of the Sequence Listing)
the genomic sequence of the gene (Table 2 only), including 6 kb on each side of the gene boundaries (i.e., 6 kb on the 5' side of the gene plus 6 kb on the 3' side of the gene) (corresponding to SEQ ID NOS:1662-1717 of the Sequence Listing).

After the last gene sequence, Table 2 may include additional genomic sequences of intergenic regions (in such instances, these sequences are identified as "Intergenic region:" followed by a numerical identification number), as well as SNP context sequences and other SNP information for any SNPs that lie within each intergenic region (and such SNPs are identified as "INTERGENIC" for SNP type).

NOTE: The transcript, protein, and transcript-based SNP context sequences are provided in both Table 1 and in the Sequence Listing. The genomic and genomic-based SNP context sequences are provided in both Table 2 and in the Sequence Listing. SEQ ID NOS are indicated in Table 1 for each transcript sequence (SEQ ID NOS:1-83), protein sequence (SEQ ID NOS:84-166), and transcript-based SNP context sequence (SEQ ID NOS:167-1661), and SEQ ID NOS are indicated in Table 2 for each genomic sequence (SEQ ID NOS:1662-1717), and genomic-based SNP context sequence (SEQ ID NOS:1718-6607).

The SNP information includes:
context sequence (taken from the transcript sequence in Table 1, and taken from the genomic sequence in Table 2) with the SNP represented by its IUB code, including 100 by upstream (5') of the SNP position plus 100 by downstream (3') of the SNP position (the transcript-based SNP context sequences in Table 1 are provided in the Sequence Listing as SEQ ID NOS:167-1661; the genomic-based SNP context sequences in Table 2 are provided in the Sequence Listing as SEQ ID NOS:1718-6607).
Celera hCV internal identification number for the SNP (in some instances, an "hDV" number is given instead of an "hCV" number)
SNP position [position of the SNP within the given transcript sequence (Table 1) or within the given genomic sequence (Table 2)]
SNP source (may include any combination of one or more of the following five codes, depending on which internal sequencing projects and/or public databases the SNP has been observed in: "Applera"=SNP observed during the re-sequencing of genes and regulatory regions of 39 individuals, "Celera"=SNP observed during shotgun sequencing and assembly of the Celera human genome sequence, "Celera Diagnostics"=SNP observed during re-sequencing of nucleic acid samples from individuals who have rheumatoid arthritis or a related pathology, "dbSNP"=SNP observed in the dbSNP public database, "HGBASE"=SNP observed in the HGBASE public database, "HGMD"=SNP observed in the Human Gene Mutation Database (HGMD) public database) (NOTE: multiple "Applera" source entries for a single SNP indicate that the same SNP was covered by multiple overlapping amplification products and the re-sequencing results (e.g., observed allele counts) from each of these amplification products is being provided)

Population/allele/allele count information in the format of [population1(first_allele,count|second_allele,count) population2(first_allele,count|second_allele,count) total (first_allele,total count|second_allele,total count)]. The information in this field includes populations/ethnic groups in which particular SNP alleles have been observed ("cau"=Caucasian, "his"=Hispanic, "chn"=Chinese, and "afr"=African-American, "jpn"=Japanese, "ind"=Indian, "mex"=Mexican, "ain"="American Indian, "cra"=Celera donor, "no_pop"=no population information available), identified SNP alleles, and observed allele counts (within each population group and total allele counts), where available ["-" in the allele field represents a deletion allele of an insertion/deletion ("indel") polymorphism (in which case the corresponding insertion allele, which may be comprised of one or more nucleotides, is indicated in the allele field on the opposite side of the "|"); "-" in the count field indicates that allele count information is not available].

NOTE: For SNPs of "Applera" SNP source, genes/regulatory regions of 39 individuals (20 Caucasians and 19 African Americans) were re-sequenced and, since each SNP position is represented by two chromosomes in each individual (with the exception of SNPs on X and Y chromosomes in males, for which each SNP position is represented by a single chromosome), up to 78 chromosomes were genotyped for each SNP position. Thus, the sum of the African-American ("afr") allele counts is up to 38, the sum of the Caucasian allele counts ("cau") is up to 40, and the total sum of all allele counts is up to 78.

(NOTE: semicolons separate population/allele/count information corresponding to each indicated SNP source; i.e., if four SNP sources are indicated, such as "Celera", "dbSNP", "HGBASE", and "HGMD", then population/allele/count information is provided in four groups which are separated by semicolons and listed in the same order as the listing of SNP sources, with each population/allele/count information group corresponding to the respective SNP source based on order; thus, in this example, the first population/allele/count information group would correspond to the first listed SNP source (Celera) and the third population/allele/count information group separated by semicolons would correspond to the third listed SNP source (HGBASE); if population/allele/count information is not available for any particular SNP source, then a pair of semicolons is still inserted as a place-holder in order to maintain correspondence between the list of SNP sources and the corresponding listing of population/allele/count information)

SNP type (e.g., location within gene/transcript and/or predicted functional effect) ["MIS-SENSE MUTATION"=SNP causes a change in the encoded amino acid (i.e., a non-synonymous coding SNP); "SILENT MUTATION"=SNP does not cause a change in the encoded amino acid (i.e., a synonymous coding SNP); "STOP CODON MUTATION"=SNP is located in a stop codon; "NONSENSE MUTATION"=SNP creates or destroys a stop codon; "UTR 5"=SNP is located in a 5' UTR of a transcript; "UTR 3"=SNP is located in a 3' UTR of a transcript; "PUTATIVE UTR 5"=SNP is located in a putative 5' UTR; "PUTATIVE UTR 3"=SNP is located in a putative 3' UTR; "DONOR SPLICE SITE"=SNP is located in a donor splice site (5' intron boundary); "ACCEPTOR SPLICE SITE"=SNP is located in an acceptor splice site (3' intron boundary); "CODING REGION"=SNP is located in a protein-coding region of the transcript; "EXON"=SNP is located in an exon; "INTRON"=SNP is located in an intron; "hmCS"=SNP is located in a human-mouse conserved segment; "TFBS"=SNP is located in a transcription factor binding site; "UNKNOWN"=SNP type is not defined; "INTERGENIC"=SNP is intergenic, i.e., outside of any gene boundary]

Protein coding information (Table 1 only), where relevant, in the format of [protein SEQ ID NO:#, amino acid position, (amino acid-1, codon1) (amino acid-2, codon2)]. The information in this field includes SEQ ID NO of the encoded protein sequence, position of the amino acid residue within the protein identified by the SEQ ID NO that is encoded by the codon containing the SNP, amino acids (represented by one-letter amino acid codes) that are encoded by the alternative SNP alleles (in the case of stop codons, "X" is used for the one-letter amino acid code), and alternative codons containing the alternative SNP nucleotides which encode the amino acid residues (thus, for example, for missense mutation-type SNPs, at least two different amino acids and at least two different codons are generally indicated; for silent mutation-type SNPs, one amino acid and at least two different codons are generally indicated, etc.). In instances where the SNP is located outside of a protein-coding region (e.g., in a UTR region), "None" is indicated following the protein SEQ ID NO.

Description of Table 3 and Table 4

Tables 3 and 4 (both provided on the CD-R) provide a list of a subset of SNPs from Table 1 (in the case of Table 3) or Table 2 (in the case of Table 4) for which the SNP source falls into one of the following three categories: 1) SNPs for which the SNP source is only "Applera" and none other, 2) SNPs for which the SNP source is only "Celera Diagnostics" and none other, and 3) SNPs for which the SNP source is both "Applera" and "Celera Diagnostics" but none other.

These SNPs have not been observed in any of the public databases (dbSNP, HGBASE, and HGMD), and were also not observed during shotgun sequencing and assembly of the Celera human genome sequence (i.e., "Celera" SNP source). Tables 3 and 4 provide the hCV identification number (or hDV identification number for SNPs having "Celera Diagnostics" SNP source) and the SEQ ID NO of the context sequence for each of these SNPs.

Description of Table 5

Table 5 provides sequences (SEQ ID NOS:6608-6676) of primers that have been synthesized and used in the laboratory to carry out allele-specific PCR reactions in order to assay the SNPs disclosed in Table 6 during the course of rheumatoid arthritis association studies.

Table 5 provides the following:
the column labeled "hCV" provides an hCV identification number for each SNP site
the column labeled "Alleles" designates the two alternative alleles at the SNP site identified by the hCV identification number that are targeted by the allele-specific primers (the allele-specific primers are shown as "Sequence A" and "Sequence B") [NOTE: Alleles may be presented in Table 5 based on a different orientation (i.e., the reverse complement) relative to how the same alleles are presented in Tables 1-2]
the column labeled "Sequence A (allele-specific primer)" provides an allele-specific primer that is specific for the first allele designated in the "Alleles" column
the column labeled "Sequence B (allele-specific primer)" provides an allele-specific primer that is specific for the second allele designated in the "Alleles" column
the column labeled "Sequence C (common primer)" provides a common primer that is used in conjunction with each of the allele-specific primers (the "Sequence A" primer and the "Sequence B" primer) and which hybridizes at a site away from the SNP position.

All primer sequences are given in the 5' to 3' direction.

Each of the nucleotides designated in the "Alleles" column matches (or is the reverse complement of, depending on the orientation of the primer relative to the designated allele) the 3' nucleotide of the allele-specific primer that is specific for that allele. Thus, the first nucleotide designated in the "Alleles" column matches (or is the reverse complement of) the 3' nucleotide of the "Sequence A" primer, and the second nucleotide designated in the "Alleles" column matches (or is the reverse complement of) the 3' nucleotide of the "Sequence B" primer.

Description of Table 6

Table 6 provides results of statistical analyses for SNPs disclosed in Tables 1-5 (SNPs can be cross-referenced between Tables 1-6 based on their hCV identification numbers). The statistical results shown in Table 6 provide support for the association of these SNP alleles with rheumatoid arthritis.

Description of Column Headings for Table 6:

TABLE 6

| Column Heading | Definition |
| --- | --- |
| Marker | Internal hCV identification number of the tested SNP |
| Gene | Internal hCG identification number for the gene which contains the tested SNP |
| Typed in Discovery and Replication? | "Replicated" = marker has been genotyped in two independently derived DNA sample sets (a Discovery Set and a Replication Set); "no" = marker has been genotyped in a single DNA sample set (a Discovery Set only) |
| Study | Sample set used in analysis ("Discovery"; "Replication, All Cases"; or "Replication, Probands") |
| Genotyping | Method of SNP genotyping ("Individual" or "Pool" genotyping) |
| Stratum | The stratum used for the analysis ("All" = All cases and matched controls, "RF+" = rheumatoid factor positive cases and matched controls) |
| Allele1 | Nucleotide (allele) of the tested SNP for which allele frequencies are being reported (NOTE: Allele1 may be presented in Table 6 based on a different orientation, i.e., the reverse complement, relative to how the same allele is presented in Tables 1-2) |
| Case Freq | Frequency of Allele1 in cases |
| Control Freq | Frequency of Allele1 in controls |
| Allelic p-value | Fisher exact test results for allelic association |
| Odds Ratio | Allelic odds ratio for Allele1 |

DETAILED DESCRIPTION OF THE INVENTION

Figure 1:
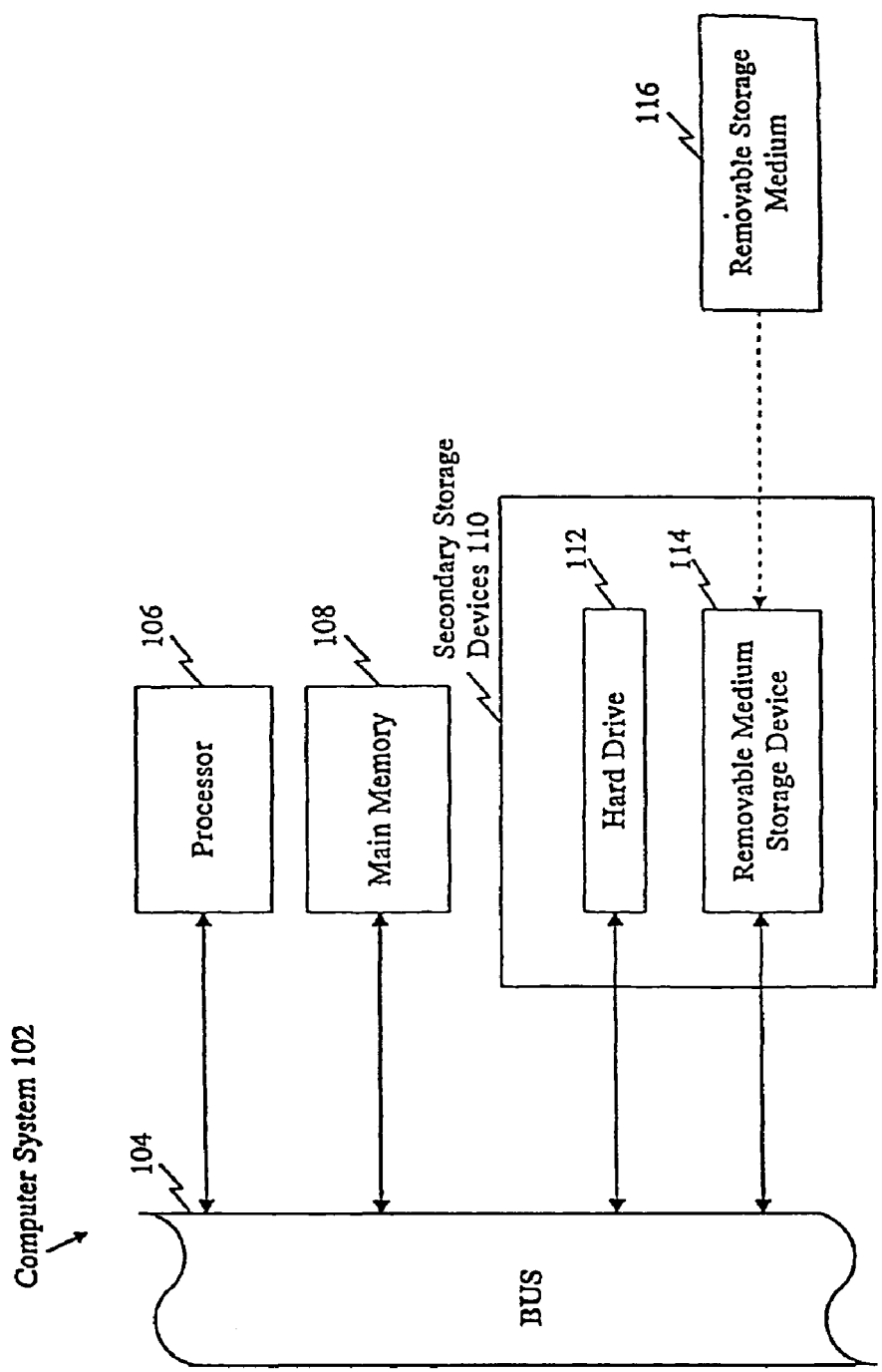
FIG. 1 provides a diagrammatic representation of a computer-based discovery system containing the SNP information of the present invention in computer readable form.

The present invention provides SNPs associated with rheumatoid arthritis, nucleic acid molecules containing SNPs, methods and reagents for the detection of the SNPs disclosed herein, uses of these SNPs for the development of detection reagents, and assays or kits that utilize such reagents. The rheumatoid arthritis-associated SNPs disclosed herein are useful for diagnosing, screening for, and evaluating predisposition to rheumatoid arthritis and related pathologies in humans. Furthermore, such SNPs and their encoded products are useful targets for the development of therapeutic agents.

Since autoimmune diseases share certain similar features that may be due to common genetic factors that are involved in their underlying mechanisms, the SNPs identified herein as being associated with rheumatoid arthritis may also be used as markers for other autoimmune diseases. Such autoimmune diseases include, but are not limited to, type 1 diabetes, multiple sclerosis, systemic lupus erythematosus, inflammatory bowel diseases, psoriasis, thyroiditis, celiac disease, pernicious anemia, asthma, vitiligo, glomerulonephritis, Graves' disease, myocarditis, Sjogren disease, and primary systemic vasculitis. Moreover, the genes containing the SNPs identified herein, and the transcripts and proteins encoded by these genes, can be used in the treatment of other autoimmune diseases, in addition to rheumatoid arthritis. For example, the genes and encoded gene products can serve as targets for the development of therapeutic agents (e.g., small molecule compounds, antibodies, antisense/RNAi agents, etc.) or used directly as therapeutic agents (e.g., therapeutic proteins, etc.) for the treatment of not only rheumatoid arthritis, but various other autoimmune diseases as well.

A large number of SNPs have been identified from re-sequencing DNA from 39 individuals, and they are indicated as "Applera" SNP source in Tables 1-2. Their allele frequencies observed in each of the Caucasian and African-American ethnic groups are provided. Additional SNPs included herein were previously identified during shotgun sequencing and assembly of the human genome, and they are indicated as "Celera" SNP source in Tables 1-2. Furthermore, the information provided in Table 1-2, particularly the allele frequency information obtained from 39 individuals and the identification of the precise position of each SNP within each gene/transcript, allows haplotypes (i.e., groups of SNPs that are co-inherited) to be readily inferred. The present invention encompasses SNP haplotypes, as well as individual SNPs.

Thus, the present invention provides individual SNPs associated with rheumatoid arthritis, as well as combinations of SNPs and haplotypes in genetic regions associated with rheumatoid arthritis, polymorphic/variant transcript sequences (SEQ ID NOS:1-83) and genomic sequences (SEQ ID NOS: 1662-1717) containing SNPs, encoded amino acid sequences (SEQ ID NOS: 84-166), and both transcript-based SNP context sequences (SEQ ID NOS: 167-1661) and genomic-based SNP context sequences (SEQ ID NOS:1718-6607) (transcript sequences, protein sequences, and transcript-based SNP context sequences are provided in Table 1 and the Sequence Listing; genomic sequences and genomic-based SNP context sequences are provided in Table 2 and the Sequence Listing), methods of detecting these polymorphisms in a test sample, methods of determining the risk of an individual of having or developing rheumatoid arthritis, methods of screening for compounds useful for treating disorders associated with a variant gene/protein such as rheumatoid arthritis, compounds identified by these screening methods, methods of using the disclosed SNPs to select a treatment strategy, methods of treating a disorder associated with a variant gene/protein (i.e., therapeutic methods), and methods of using the SNPs of the present invention for human identification.

The present invention provides novel SNPs associated with rheumatoid arthritis, as well as SNPs that were previously known in the art, but were not previously known to be associated with rheumatoid arthritis. Accordingly, the present invention provides novel compositions and methods based on the novel SNPs disclosed herein, and also provides novel methods of using the known, but previously unassociated, SNPs in methods relating to rheumatoid arthritis (e.g., for diagnosing rheumatoid arthritis, etc.). In Tables 1-2, known SNPs are identified based on the public database in which they have been observed, which is indicated as one or more of the following SNP types: "dbSNP"=SNP observed in dbSNP, "HGBASE"=SNP observed in HGBASE, and "HGMD"=SNP observed in the Human Gene Mutation Database (HGMD). Novel SNPs for which the SNP source is only "Applera" and none other, i.e., those that have not been observed in any public databases and which were also not observed during shotgun sequencing and assembly of the Celera human genome sequence (i.e., "Celera" SNP source), are indicated in Tables 3-4.

Particular SNP alleles of the present invention can be associated with either an increased risk of having or developing rheumatoid arthritis, or a decreased risk of having or developing rheumatoid arthritis. SNP alleles that are associated with a decreased risk of having or developing rheumatoid arthritis may be referred to as "protective" alleles, and SNP alleles that are associated with an increased risk of having or developing rheumatoid arthritis may be referred to as "susceptibility" alleles or "risk factors". Thus, whereas certain SNPs (or their encoded products) can be assayed to determine whether an individual possesses a SNP allele that is indicative of an increased risk of having or developing rheumatoid arthritis (i.e., a susceptibility allele), other SNPs (or their encoded products) can be assayed to determine whether an individual possesses a SNP allele that is indicative of a decreased risk of having or developing rheumatoid arthritis (i.e., a protective allele). Similarly, particular SNP alleles of the present invention can be associated with either an increased or decreased likelihood of responding to a particular treatment or therapeutic compound, or an increased or decreased likelihood of experiencing toxic effects from a particular treatment or therapeutic compound. The term "altered" may be used herein to encompass either of these two possibilities (e.g., an increased or a decreased risk/likelihood).

Those skilled in the art will readily recognize that nucleic acid molecules may be double-stranded molecules and that reference to a particular site on one strand refers, as well, to the corresponding site on a complementary strand. In defining a SNP position, SNP allele, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference may be made to either strand in order to refer to a particular SNP position, SNP allele, or nucleotide sequence. Probes and primers, may be designed to hybridize to either strand and SNP genotyping methods disclosed herein may generally target either strand. Throughout the specification, in identifying a SNP position, reference is generally made to the protein-encoding strand, only for the purpose of convenience.

References to variant peptides, polypeptides, or proteins of the present invention include peptides, polypeptides, proteins, or fragments thereof, that contain at least one amino acid residue that differs from the corresponding amino acid sequence of the art-known peptide/polypeptide/protein (the art-known protein may be interchangeably referred to as the "wild-type", "reference", or "normal" protein). Such variant peptides/polypeptides/proteins can result from a codon change caused by a nonsynonymous nucleotide substitution at a protein-coding SNP position (i.e., a missense mutation) disclosed by the present invention. Variant peptides/polypeptides/proteins of the present invention can also result from a nonsense mutation, i.e. a SNP that creates a premature stop codon, a SNP that generates a read-through mutation by abolishing a stop codon, or due to any SNP disclosed by the present invention that otherwise alters the structure, function/activity, or expression of a protein, such as a SNP in a regulatory region (e.g. a promoter or enhancer) or a SNP that leads to alternative or defective splicing, such as a SNP in an intron or a SNP at an exon/intron boundary. As used herein, the terms "polypeptide", "peptide", and "protein" are used interchangeably.

Isolated Nucleic Acid Molecules and SNP Detection Reagents & Kits

Tables 1 and 2 provide a variety of information about each SNP of the present invention that is associated with rheumatoid arthritis, including the transcript sequences (SEQ ID NOS:1-83), genomic sequences (SEQ ID NOS:1662-1717), and protein sequences (SEQ ID NOS:84-166) of the encoded gene products (with the SNPs indicated by IUB codes in the nucleic acid sequences). In addition, Tables 1 and 2 include SNP context sequences, which generally include 100 nucleotide upstream (5') plus 100 nucleotides downstream (3') of each SNP position (SEQ ID NOS:167-1661 correspond to transcript-based SNP context sequences disclosed in Table 1, and SEQ ID NOS:1718-6607 correspond to genomic-based context sequences disclosed in Table 2), the alternative nucleotides (alleles) at each SNP position, and additional information about the variant where relevant, such as SNP type (coding, missense, splice site, UTR, etc.), human populations in which the SNP was observed, observed allele frequencies, information about the encoded protein, etc.

Isolated Nucleic Acid Molecules

The present invention provides isolated nucleic acid molecules that contain one or more SNPs disclosed Table 1 and/or Table 2. Preferred isolated nucleic acid molecules contain one or more SNPs identified in Table 3 and/or Table 4. Isolated nucleic acid molecules containing one or more SNPs disclosed in at least one of Tables 1-4 may be interchangeably referred to throughout the present text as "SNP-containing nucleic acid molecules". Isolated nucleic acid molecules may optionally encode a full-length variant protein or fragment thereof. The isolated nucleic acid molecules of the present invention also include probes and primers (which are described in greater detail below in the section entitled "SNP Detection Reagents"), which may be used for assaying the disclosed SNPs, and isolated full-length genes, transcripts, cDNA molecules, and fragments thereof, which may be used for such purposes as expressing an encoded protein.

As used herein, an "isolated nucleic acid molecule" generally is one that contains a SNP of the present invention or one that hybridizes to such molecule such as a nucleic acid with a complementary sequence, and is separated from most other nucleic acids present in the natural source of the nucleic acid molecule. Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. A nucleic acid molecule can be fused to other coding or regulatory sequences and still be considered "isolated". Nucleic acid molecules present in non-human transgenic animals, which do not naturally occur in the animal, are also considered "isolated". For example, recombinant DNA molecules contained in a vector are considered "isolated". Further examples of "isolated" DNA molecules include recombinant DNA molecules maintained in heterologous host cells, and purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Generally, an isolated SNP-containing nucleic acid molecule comprises one or more SNP positions disclosed by the present invention with flanking nucleotide sequences on either side of the SNP positions. A flanking sequence can include nucleotide residues that are naturally associated with the SNP site and/or heterologous nucleotide sequences. Preferably the flanking sequence is up to about 500, 300, 100, 60, 50, 30, 25, 20, 15, 10, 8, or 4 nucleotides (or any other length in-between) on either side of a SNP position, or as long as the full-length gene or entire protein-coding sequence (or any portion thereof such as an exon), especially if the SNP-containing nucleic acid molecule is to be used to produce a protein or protein fragment.

For full-length genes and entire protein-coding sequences, a SNP flanking sequence can be, for example, up to about 5 KB, 4 KB, 3 KB, 2 KB, 1 KB on either side of the SNP. Furthermore, in such instances, the isolated nucleic acid molecule comprises exonic sequences (including protein-coding and/or non-coding exonic sequences), but may also include intronic sequences. Thus, any protein coding sequence may be either contiguous or separated by introns. The important point is that the nucleic acid is isolated from remote and unimportant flanking sequences and is of appropriate length such that it can be subjected to the specific manipulations or uses described herein such as recombinant protein expression, preparation of probes and primers for assaying the SNP position, and other uses specific to the SNP-containing nucleic acid sequences.

An isolated SNP-containing nucleic acid molecule can comprise, for example, a full-length gene or transcript, such as a gene isolated from genomic DNA (e.g., by cloning or PCR amplification), a cDNA molecule, or an mRNA transcript molecule. Polymorphic transcript sequences are provided in Table 1 and in the Sequence Listing (SEQ ID NOS: 1-83), and polymorphic genomic sequences are provided in Table 2 and in the Sequence Listing (SEQ ID NOS:1662-1717). Furthermore, fragments of such full-length genes and transcripts that contain one or more SNPs disclosed herein are also encompassed by the present invention, and such fragments may be used, for example, to express any part of a protein, such as a particular functional domain or an antigenic epitope. Thus, the present invention also encompasses fragments of the nucleic acid sequences provided in Tables 1-2 (transcript sequences are provided in Table 1 as SEQ ID NOS:1-83, genomic sequences are provided in Table 2 as SEQ ID NOS:1662-1717, transcript-based SNP context sequences are provided in Table 1 as SEQ ID NO:167-1661, and genomic-based SNP context sequences are provided in Table 2 as SEQ ID NO:1718-6607) and their complements. A fragment typically comprises a contiguous nucleotide sequence at least about 8 or more nucleotides, more preferably at least about 12 or more nucleotides, and even more preferably at least about 16 or more nucleotides. Further, a fragment could comprise at least about 18, 20, 22, 25, 30, 40, 50, 60, 80, 100, 150, 200, 250 or 500 (or any other number in-between) nucleotides in length. The length of the fragment will be based on its intended use. For example, the fragment can encode epitope-bearing regions of a variant peptide or regions of a variant peptide that differ from the normal/wild-type protein, or can be useful as a polynucleotide probe or primer. Such fragments can be isolated using the nucleotide sequences provided in Table 1 and/or Table 2 for the synthesis of a polynucleotide probe. A labeled probe can then be used, for example, to screen a cDNA library, genomic DNA library, or mRNA to isolate nucleic acid corresponding to the coding region. Further, primers can be used in amplification reactions, such as for purposes of assaying one or more SNPs sites or for cloning specific regions of a gene.

An isolated nucleic acid molecule of the present invention further encompasses a SNP-containing polynucleotide that is the product of any one of a variety of nucleic acid amplification methods, which are used to increase the copy numbers of a polynucleotide of interest in a nucleic acid sample. Such amplification methods are well known in the art, and they include but are not limited to, polymerase chain reaction (PCR) (U.S. Pat. Nos. 4,683,195; and 4,683,202; *PCR Technology: Principles and Applications for DNA Amplification*, ed. H. A. Erlich, Freeman Press, NY, N.Y., 1992), ligase chain reaction (LCR) (Wu and Wallace, *Genomics* 4:560, 1989; Landegren et al., *Science* 241:1077, 1988), strand displacement amplification (SDA) (U.S. Pat. Nos. 5,270,184; and 5,422,252), transcription-mediated amplification (TMA) (U.S. Pat. No. 5,399,491), linked linear amplification (LLA) (U.S. Pat. No. 6,027,923), and the like, and isothermal amplification methods such as nucleic acid sequence based amplification (NASBA), and self-sustained sequence replication (Guatelli et al., *Proc. Natl. Acad. Sci. USA* 87: 1874, 1990). Based on such methodologies, a person skilled in the art can readily design primers in any suitable regions 5' and 3' to a SNP disclosed herein. Such primers may be used to amplify DNA of any length so long that it contains the SNP of interest in its sequence.

As used herein, an "amplified polynucleotide" of the invention is a SNP-containing nucleic acid molecule whose amount has been increased at least two fold by any nucleic acid amplification method performed in vitro as compared to its starting amount in a test sample. In other preferred embodiments, an amplified polynucleotide is the result of at least ten fold, fifty fold, one hundred fold, one thousand fold, or even ten thousand fold increase as compared to its starting amount in a test sample. In a typical PCR amplification, a polynucleotide of interest is often amplified at least fifty thousand fold in amount over the unamplified genomic DNA, but the precise amount of amplification needed for an assay depends on the sensitivity of the subsequent detection method used.

Generally, an amplified polynucleotide is at least about 16 nucleotides in length. More typically, an amplified polynucleotide is at least about 20 nucleotides in length. In a preferred embodiment of the invention, an amplified polynucleotide is at least about 30 nucleotides in length. In a more preferred embodiment of the invention, an amplified polynucleotide is at least about 32, 40, 45, 50, or 60 nucleotides in length. In yet another preferred embodiment of the invention, an amplified polynucleotide is at least about 100, 200, 300, 400, or 500 nucleotides in length. While the total length of an amplified polynucleotide of the invention can be as long as an exon, an intron or the entire gene where the SNP of interest resides, an amplified product is typically up to about 1,000 nucleotides in length (although certain amplification methods may generate amplified products greater than 1000 nucleotides in length). More preferably, an amplified polynucleotide is not greater than about 600-700 nucleotides in length. It is understood that irrespective of the length of an amplified polynucleotide, a SNP of interest may be located anywhere along its sequence.

In a specific embodiment of the invention, the amplified product is at least about 201 nucleotides in length, comprises one of the transcript-based context sequences or the genomic-based context sequences shown in Tables 1-2. Such a product may have additional sequences on its 5' end or 3' end or both. In another embodiment, the amplified product is about 101 nucleotides in length, and it contains a SNP disclosed herein. Preferably, the SNP is located at the middle of the amplified product (e.g., at position 101 in an amplified product that is 201 nucleotides in length, or at position 51 in an amplified product that is 101 nucleotides in length), or within 1, 2, 3, 4, 5, 6, 7, 8, 9, 10, 12, 15, or 20 nucleotides from the middle of the amplified product (however, as indicated above, the SNP of interest may be located anywhere along the length of the amplified product).

The present invention provides isolated nucleic acid molecules that comprise, consist of, or consist essentially of one or more polynucleotide sequences that contain one or more SNPs disclosed herein, complements thereof, and SNP-containing fragments thereof.

Accordingly, the present invention provides nucleic acid molecules that consist of any of the nucleotide sequences shown in Table 1 and/or Table 2 (transcript sequences are provided in Table 1 as SEQ ID NOS:1-83, genomic sequences are provided in Table 2 as SEQ ID NOS:1662-1717, transcript-based SNP context sequences are provided in Table 1 as SEQ ID NO:167-1661, and genomic-based SNP context sequences are provided in Table 2 as SEQ ID NO:1718-6607), or any nucleic acid molecule that encodes any of the variant proteins provided in Table 1 (SEQ ID NOS:84-166). A nucleic acid molecule consists of a nucleotide sequence when the nucleotide sequence is the complete nucleotide sequence of the nucleic acid molecule.

The present invention further provides nucleic acid molecules that consist essentially of any of the nucleotide sequences shown in Table 1 and/or Table 2 (transcript sequences are provided in Table 1 as SEQ ID NOS:1-83, genomic sequences are provided in Table 2 as SEQ ID NOS: 1662-1717, transcript-based SNP context sequences are provided in Table 1 as SEQ ID NO:167-1661, and genomic-based SNP context sequences are provided in Table 2 as SEQ ID NO:1718-6607), or any nucleic acid molecule that encodes any of the variant proteins provided in Table 1 (SEQ ID NOS:84-166). A nucleic acid molecule consists essentially of a nucleotide sequence when such a nucleotide sequence is present with only a few additional nucleotide residues in the final nucleic acid molecule.

The present invention further provides nucleic acid molecules that comprise any of the nucleotide sequences shown in Table 1 and/or Table 2 or a SNP-containing fragment thereof (transcript sequences are provided in Table 1 as SEQ ID NOS:1-83, genomic sequences are provided in Table 2 as SEQ ID NOS:1662-1717, transcript-based SNP context sequences are provided in Table 1 as SEQ ID NO:167-1661, and genomic-based SNP context sequences are provided in Table 2 as SEQ ID NO:1718-6607), or any nucleic acid molecule that encodes any of the variant proteins provided in Table 1 (SEQ ID NOS:84-166). A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleotide residues, such as residues that are naturally associated with it or heterologous nucleotide sequences. Such a nucleic acid molecule can have one to a few additional nucleotides or can comprise many more additional nucleotides. A brief description of how various types of these nucleic acid molecules can be readily made and isolated is provided below, and such techniques are well known to those of ordinary skill in the art (Sambrook and Russell, 2000, Molecular Cloning: A Laboratory Manual, Cold Spring Harbor Press, NY).

The isolated nucleic acid molecules can encode mature proteins plus additional amino or carboxyl-terminal amino acids or both, or amino acids interior to the mature peptide (when the mature form has more than one peptide chain, for instance). Such sequences may play a role in processing of a protein from precursor to a mature form, facilitate protein trafficking, prolong or shorten protein half-life, or facilitate manipulation of a protein for assay or production. As generally is the case in situ, the additional amino acids may be processed away from the mature protein by cellular enzymes.

Thus, the isolated nucleic acid molecules include, but are not limited to, nucleic acid molecules having a sequence encoding a peptide alone, a sequence encoding a mature peptide and additional coding sequences such as a leader or secretory sequence (e.g., a pre-pro or pro-protein sequence), a sequence encoding a mature peptide with or without additional coding sequences, plus additional non-coding sequences, for example introns and non-coding 5' and 3' sequences such as transcribed but untranslated sequences that play a role in, for example, transcription, mRNA processing (including splicing and polyadenylation signals), ribosome binding, and/or stability of mRNA. In addition, the nucleic acid molecules may be fused to heterologous marker sequences encoding, for example, a peptide that facilitates purification.

Isolated nucleic acid molecules can be in the form of RNA, such as mRNA, or in the form DNA, including cDNA and genomic DNA, which may be obtained, for example, by molecular cloning or produced by chemical synthetic techniques or by a combination thereof (Sambrook and Russell, 2000, Molecular Cloning: A Laboratory Manual, Cold Spring Harbor Press, NY). Furthermore, isolated nucleic acid molecules, particularly SNP detection reagents such as probes and primers, can also be partially or completely in the form of one or more types of nucleic acid analogs, such as peptide nucleic acid (PNA) (U.S. Pat. Nos. 5,539,082; 5,527,675; 5,623,049; 5,714,331). The nucleic acid, especially DNA, can be double-stranded or single-stranded. Single-stranded nucleic acid can be the coding strand (sense strand) or the complementary non-coding strand (anti-sense strand). DNA, RNA, or PNA segments can be assembled, for example, from fragments of the human genome (in the case of DNA or RNA) or single nucleotides, short oligonucleotide linkers, or from a series of oligonucleotides, to provide a synthetic nucleic acid molecule. Nucleic acid molecules can be readily synthesized using the sequences provided herein as a reference; oligonucleotide and PNA oligomer synthesis techniques are well known in the art (see, e.g., Corey, "Peptide nucleic acids: expanding the scope of nucleic acid recognition", *Trends Biotechnol.* 1997 June; 15(6):224-9, and Hyrup et al., "Peptide nucleic acids (PNA): synthesis, properties and potential applications", *Bioorg Med Chem.* 1996 January; 4(1):5-23). Furthermore, large-scale automated oligonucleotide/PNA synthesis (including synthesis on an array or bead surface or other solid support) can readily be accomplished using commercially available nucleic acid synthesizers, such as the Applied Biosystems (Foster City, Calif.) 3900 High-Throughput DNA Synthesizer or Expedite 8909 Nucleic Acid Synthesis System, and the sequence information provided herein.

The present invention encompasses nucleic acid analogs that contain modified, synthetic, or non-naturally occurring nucleotides or structural elements or other alternative/modified nucleic acid chemistries known in the art. Such nucleic acid analogs are useful, for example, as detection reagents (e.g., primers/probes) for detecting one or more SNPs identified in Table 1 and/or Table 2. Furthermore, kits/systems (such as beads, arrays, etc.) that include these analogs are also encompassed by the present invention. For example, PNA oligomers that are based on the polymorphic sequences of the present invention are specifically contemplated. PNA oligomers are analogs of DNA in which the phosphate backbone is replaced with a peptide-like backbone (Lagriffoul et al., Bioorganic & Medicinal Chemistry Letters, 4: 1081-1082 (1994), Petersen et al., Bioorganic & Medicinal Chemistry Letters, 6: 793-796 (1996), Kumar et al., Organic Letters 3(9): 1269-1272 (2001), WO96/04000). PNA hybridizes to complementary RNA or DNA with higher affinity and specificity than conventional oligonucleotides and oligonucleotide analogs. The properties of PNA enable novel molecular biology and biochemistry applications unachievable with traditional oligonucleotides and peptides.

Additional examples of nucleic acid modifications that improve the binding properties and/or stability of a nucleic acid include the use of base analogs such as inosine, intercalators (U.S. Pat. No. 4,835,263) and the minor groove binders (U.S. Pat. No. 5,801,115). Thus, references herein to nucleic acid molecules, SNP-containing nucleic acid molecules, SNP detection reagents (e.g., probes and primers), oligonucleotides/polynucleotides include PNA oligomers and other nucleic acid analogs. Other examples of nucleic acid analogs and alternative/modified nucleic acid chemistries known in the art are described in *Current Protocols in Nucleic Acid Chemistry*, John Wiley & Sons, N.Y. (2002).

The present invention further provides nucleic acid molecules that encode fragments of the variant polypeptides disclosed herein as well as nucleic acid molecules that encode obvious variants of such variant polypeptides. Such nucleic acid molecules may be naturally occurring, such as paralogs (different locus) and orthologs (different organism), or may be constructed by recombinant DNA methods or by chemical synthesis. Non-naturally occurring variants may be made by mutagenesis techniques, including those applied to nucleic acid molecules, cells, or organisms. Accordingly, the variants can contain nucleotide substitutions, deletions, inversions and insertions (in addition to the SNPs disclosed in Tables 1-2). Variation can occur in either or both the coding and non-coding regions. The variations can produce conservative and/or non-conservative amino acid substitutions.

Further variants of the nucleic acid molecules disclosed in Tables 1-2, such as naturally occurring allelic variants (as well as orthologs and paralogs) and synthetic variants produced by mutagenesis techniques, can be identified and/or produced using methods well known in the art. Such further variants can comprise a nucleotide sequence that shares at least 70-80%, 80-85%, 85-90%, 91%, 92%, 93%, 94%, 95%, 96%, 97%, 98%, or 99% sequence identity with a nucleic acid sequence disclosed in Table 1 and/or Table 2 (or a fragment thereof) and that includes a novel SNP allele disclosed in Table 1 and/or Table 2. Further, variants can comprise a nucleotide sequence that encodes a polypeptide that shares at least 70-80%, 80-85%, 85-90%, 91%, 92%, 93%, 94%, 95%, 96%, 97%, 98%, or 99% sequence identity with a polypeptide sequence disclosed in Table 1 (or a fragment thereof) and that includes a novel SNP allele disclosed in Table 1 and/or Table 2. Thus, an aspect of the present invention that is specifically contemplated are isolated nucleic acid molecules that have a certain degree of sequence variation compared with the sequences shown in Tables 1-2, but that contain a novel SNP allele disclosed herein. In other words, as long as an isolated nucleic acid molecule contains a novel SNP allele disclosed herein, other portions of the nucleic acid molecule that flank the novel SNP allele can vary to some degree from the specific transcript, genomic, and context sequences shown in Tables 1-2, and can encode a polypeptide that varies to some degree from the specific polypeptide sequences shown in Table 1.

To determine the percent identity of two amino acid sequences or two nucleotide sequences of two molecules that share sequence homology, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. (*Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part* 1, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991). In a preferred embodiment, the percent identity between two amino acid sequences is determined using the Needleman and Wunsch algorithm (*J. Mol. Biol.* (48):444-453 (1970)) which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6.

In yet another preferred embodiment, the percent identity between two nucleotide sequences is determined using the GAP program in the GCG software package (Devereux, J., et al., *Nucleic Acids Res.* 12(1):387 (1984)), using a NWSgap-dna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4:11-17 (1989)) which has been incorporated into the ALIGN program (version 2.0), using a PAM120 weight residue table, a gap length penalty of 12, and a gap penalty of 4.

The nucleotide and amino acid sequences of the present invention can further be used as a "query sequence" to perform a search against sequence databases to, for example, identify other family members or related sequences. Such searches can be performed using the NBLAST and)(BLAST programs (version 2.0) of Altschul, et al. (*J. Mol. Biol.* 215: 403-10 (1990)). BLAST nucleotide searches can be performed with the NBLAST program, score=100, wordlength=12 to obtain nucleotide sequences homologous to the nucleic acid molecules of the invention. BLAST protein searches can be performed with the)(BLAST program, score=50, wordlength=3 to obtain amino acid sequences homologous to the proteins of the invention. To obtain gapped alignments for comparison purposes, Gapped BLAST can be utilized as described in Altschul et al. (*Nucleic Acids Res.* 25(17):3389-3402 (1997)). When utilizing BLAST and gapped BLAST programs, the default parameters of the respective programs (e.g., XBLAST and NBLAST) can be used. In addition to BLAST, examples of other search and sequence comparison programs used in the art include, but are not limited to, FASTA (Pearson, *Methods Mol. Biol.* 25, 365-389 (1994)) and KERR (Dufresne et al., *Nat Biotechnol* 2002 December; 20(12):1269-71). For further information regarding bioinformatics techniques, see *Current Protocols in Bioinformatics*, John Wiley & Sons, Inc., N.Y.

The present invention further provides non-coding fragments of the nucleic acid molecules disclosed in Table 1 and/or Table 2. Preferred non-coding fragments include, but are not limited to, promoter sequences, enhancer sequences, intronic sequences, 5' untranslated regions (UTRs), 3' untranslated regions, gene modulating sequences and gene termination sequences. Such fragments are useful, for example, in controlling heterologous gene expression and in developing screens to identify gene-modulating agents.

SNP Detection Reagents

In a specific aspect of the present invention, the SNPs disclosed in Table 1 and/or Table 2, and their associated transcript sequences (provided in Table 1 as SEQ ID NOS:1-83), genomic sequences (provided in Table 2 as SEQ ID NOS:1662-1717), and context sequences (transcript-based context sequences are provided in Table 1 as SEQ ID NOS: 167-1661; genomic-based context sequences are provided in Table 2 as SEQ ID NOS:1718-6607), can be used for the design of SNP detection reagents. As used herein, a "SNP detection reagent" is a reagent that specifically detects a specific target SNP position disclosed herein, and that is preferably specific for a particular nucleotide (allele) of the target SNP position (i.e., the detection reagent preferably can differentiate between different alternative nucleotides at a target SNP position, thereby allowing the identity of the nucleotide present at the target SNP position to be determined). Typically, such detection reagent hybridizes to a target SNP-containing nucleic acid molecule by complementary base-pairing in a sequence specific manner, and discriminates the target variant sequence from other nucleic acid sequences such as an art-known form in a test sample. An example of a detection reagent is a probe that hybridizes to a target nucleic acid containing one or more of the SNPs provided in Table 1 and/or Table 2. In a preferred embodiment, such a probe can differentiate between nucleic acids having a particular nucleotide (allele) at a target SNP position from other nucleic acids that have a different nucleotide at the same target SNP position. In addition, a detection reagent may hybridize to a specific region 5' and/or 3' to a SNP position, particularly a region corresponding to the context sequences provided in Table 1 and/or Table 2 (transcript-based context sequences are provided in Table 1 as SEQ ID NOS:167-1661; genomic-based context sequences are provided in Table 2 as SEQ ID NOS: 1718-6607). Another example of a detection reagent is a primer which acts as an initiation point of nucleotide extension along a complementary strand of a target polynucleotide. The SNP sequence information provided herein is also useful for designing primers, e.g. allele-specific primers, to amplify (e.g., using PCR) any SNP of the present invention.

In one preferred embodiment of the invention, a SNP detection reagent is an isolated or synthetic DNA or RNA polynucleotide probe or primer or PNA oligomer, or a combination of DNA, RNA and/or PNA, that hybridizes to a segment of a target nucleic acid molecule containing a SNP identified in Table 1 and/or Table 2. A detection reagent in the form of a polynucleotide may optionally contain modified base analogs, intercalators or minor groove binders. Multiple detection reagents such as probes may be, for example, affixed to a solid support (e.g., arrays or beads) or supplied in solution (e.g., probe/primer sets for enzymatic reactions such as PCR, RT-PCR, TaqMan assays, or primer-extension reactions) to form a SNP detection kit.

A probe or primer typically is a substantially purified oligonucleotide or PNA oligomer. Such oligonucleotide typically comprises a region of complementary nucleotide sequence that hybridizes under stringent conditions to at least about 8, 10, 12, 16, 18, 20, 22, 25, 30, 40, 50, 55, 60, 65, 70, 80, 90, 100, 120 (or any other number in-between) or more consecutive nucleotides in a target nucleic acid molecule. Depending on the particular assay, the consecutive nucleotides can either include the target SNP position, or be a specific region in close enough proximity 5' and/or 3' to the SNP position to carry out the desired assay.

Other preferred primer and probe sequences can readily be determined using the transcript sequences (SEQ ID NOS:1-83), genomic sequences (SEQ ID NOS:1662-1717), and SNP context sequences (transcript-based context sequences are provided in Table 1 as SEQ ID NOS:167-1661; genomic-based context sequences are provided in Table 2 as SEQ ID NOS:1718-6607) disclosed in the Sequence Listing and in Tables 1-2. It will be apparent to one of skill in the art that such primers and probes are directly useful as reagents for genotyping the SNPs of the present invention, and can be incorporated into any kit/system format.

In order to produce a probe or primer specific for a target SNP-containing sequence, the gene/transcript and/or context sequence surrounding the SNP of interest is typically examined using a computer algorithm which starts at the 5' or at the 3' end of the nucleotide sequence. Typical algorithms will then identify oligomers of defined length that are unique to the gene/SNP context sequence, have a GC content within a range suitable for hybridization, lack predicted secondary structure that may interfere with hybridization, and/or possess other desired characteristics or that lack other undesired characteristics.

A primer or probe of the present invention is typically at least about 8 nucleotides in length. In one embodiment of the invention, a primer or a probe is at least about 10 nucleotides in length. In a preferred embodiment, a primer or a probe is at least about 12 nucleotides in length. In a more preferred embodiment, a primer or probe is at least about 16, 17, 18, 19, 20, 21, 22, 23, 24 or 25 nucleotides in length. While the maximal length of a probe can be as long as the target sequence to be detected, depending on the type of assay in which it is employed, it is typically less than about 50, 60, 65, or 70 nucleotides in length. In the case of a primer, it is typically less than about 30 nucleotides in length. In a specific preferred embodiment of the invention, a primer or a probe is within the length of about 18 and about 28 nucleotides. However, in other embodiments, such as nucleic acid arrays and other embodiments in which probes are affixed to a substrate, the probes can be longer, such as on the order of 30-70, 75, 80, 90, 100, or more nucleotides in length (see the section below entitled "SNP Detection Kits and Systems").

For analyzing SNPs, it may be appropriate to use oligonucleotides specific for alternative SNP alleles. Such oligonucleotides which detect single nucleotide variations in target sequences may be referred to by such terms as "allele-specific oligonucleotides", "allele-specific probes", or "allele-specific primers". The design and use of allele-specific probes for analyzing polymorphisms is described in, e.g., *Mutation Detection A Practical Approach*, ed. Cotton et al. Oxford University Press, 1998; Saiki et al., Nature 324, 163-166 (1986); Dattagupta, EP235,726; and Saiki, WO 89/11548.

While the design of each allele-specific primer or probe depends on variables such as the precise composition of the nucleotide sequences flanking a SNP position in a target nucleic acid molecule, and the length of the primer or probe, another factor in the use of primers and probes is the stringency of the condition under which the hybridization between the probe or primer and the target sequence is performed. Higher stringency conditions utilize buffers with lower ionic strength and/or a higher reaction temperature, and tend to require a more perfect match between probe/primer and a target sequence in order to form a stable duplex. If the stringency is too high, however, hybridization may not occur at all. In contrast, lower stringency conditions utilize buffers with higher ionic strength and/or a lower reaction temperature, and permit the formation of stable duplexes with more mismatched bases between a probe/primer and a target sequence. By way of example and not limitation, exemplary conditions for high stringency hybridization conditions using an allele-specific probe are as follows: Prehybridization with a solution containing 5× standard saline phosphate EDTA (SSPE), 0.5% NaDodSO$_4$ (SDS) at 55° C., and incubating probe with target nucleic acid molecules in the same solution at the same temperature, followed by washing with a solution containing 2×SSPE, and 0.1% SDS at 55° C. or room temperature.

Moderate stringency hybridization conditions may be used for allele-specific primer extension reactions with a solution containing, e.g., about 50 mM KCl at about 46° C. Alternatively, the reaction may be carried out at an elevated temperature such as 60° C. In another embodiment, a moderately stringent hybridization condition suitable for oligonucleotide ligation assay (OLA) reactions wherein two probes are ligated if they are completely complementary to the target sequence may utilize a solution of about 100 mM KCl at a temperature of 46° C.

In a hybridization-based assay, allele-specific probes can be designed that hybridize to a segment of target DNA from one individual but do not hybridize to the corresponding segment from another individual due to the presence of different polymorphic forms (e.g., alternative SNP alleles/nucleotides) in the respective DNA segments from the two individuals. Hybridization conditions should be sufficiently stringent that there is a significant detectable difference in hybridization intensity between alleles, and preferably an essentially binary response, whereby a probe hybridizes to only one of the alleles or significantly more strongly to one allele. While a probe may be designed to hybridize to a target sequence that contains a SNP site such that the SNP site aligns anywhere along the sequence of the probe, the probe is preferably designed to hybridize to a segment of the target sequence such that the SNP site aligns with a central position of the probe (e.g., a position within the probe that is at least three nucleotides from either end of the probe). This design of probe generally achieves good discrimination in hybridization between different allelic forms.

In another embodiment, a probe or primer may be designed to hybridize to a segment of target DNA such that the SNP aligns with either the 5' most end or the 3' most end of the probe or primer. In a specific preferred embodiment which is particularly suitable for use in a oligonucleotide ligation assay (U.S. Pat. No. 4,988,617), the 3' most nucleotide of the probe aligns with the SNP position in the target sequence.

Oligonucleotide probes and primers may be prepared by methods well known in the art. Chemical synthetic methods include, but are limited to, the phosphotriester method described by Narang et al., 1979, Methods in Enzymology 68:90; the phosphodiester method described by Brown et al., 1979, Methods in Enzymology 68:109, the diethylphosphoamidate method described by Beaucage et al., 1981, *Tetrahedron Letters* 22:1859; and the solid support method described in U.S. Pat. No. 4,458,066.

Allele-specific probes are often used in pairs (or, less commonly, in sets of 3 or 4, such as if a SNP position is known to have 3 or 4 alleles, respectively, or to assay both strands of a nucleic acid molecule for a target SNP allele), and such pairs may be identical except for a one nucleotide mismatch that represents the allelic variants at the SNP position. Commonly, one member of a pair perfectly matches a reference form of a target sequence that has a more common SNP allele (i.e., the allele that is more frequent in the target population) and the other member of the pair perfectly matches a form of the target sequence that has a less common SNP allele (i.e., the allele that is rarer in the target population). In the case of an array, multiple pairs of probes can be immobilized on the same support for simultaneous analysis of multiple different polymorphisms.

In one type of PCR-based assay, an allele-specific primer hybridizes to a region on a target nucleic acid molecule that overlaps a SNP position and only primes amplification of an allelic form to which the primer exhibits perfect complementarity (Gibbs, 1989, *Nucleic Acid Res.* 17 2427-2448). Typically, the primer's 3'-most nucleotide is aligned with and complementary to the SNP position of the target nucleic acid molecule. This primer is used in conjunction with a second primer that hybridizes at a distal site. Amplification proceeds from the two primers, producing a detectable product that indicates which allelic form is present in the test sample. A control is usually performed with a second pair of primers, one of which shows a single base mismatch at the polymorphic site and the other of which exhibits perfect complementarity to a distal site. The single-base mismatch prevents amplification or substantially reduces amplification efficiency, so that either no detectable product is formed or it is formed in lower amounts or at a slower pace. The method generally works most effectively when the mismatch is at the 3'-most position of the oligonucleotide (i.e., the 3'-most position of the oligonucleotide aligns with the target SNP position) because this position is most destabilizing to elongation from the primer (see, e.g., WO 93/22456). This PCR-based assay can be utilized as part of the TaqMan assay, described below.

In a specific embodiment of the invention, a primer of the invention contains a sequence substantially complementary to a segment of a target SNP-containing nucleic acid molecule except that the primer has a mismatched nucleotide in one of the three nucleotide positions at the 3'-most end of the primer, such that the mismatched nucleotide does not base pair with a particular allele at the SNP site. In a preferred embodiment, the mismatched nucleotide in the primer is the second from the last nucleotide at the 3'-most position of the primer. In a more preferred embodiment, the mismatched nucleotide in the primer is the last nucleotide at the 3'-most position of the primer.

In another embodiment of the invention, a SNP detection reagent of the invention is labeled with a fluorogenic reporter dye that emits a detectable signal. While the preferred reporter dye is a fluorescent dye, any reporter dye that can be attached to a detection reagent such as an oligonucleotide probe or primer is suitable for use in the invention. Such dyes include, but are not limited to, Acridine, AMCA, BODIPY, Cascade Blue, Cy2, Cy3, Cy5, Cy7, Dabcyl, Edans, Eosin, Erythrosin, Fluorescein, 6-Fam, Tet, Joe, Hex, Oregon Green, Rhodamine, Rhodol Green, Tamra, Rox, and Texas Red.

In yet another embodiment of the invention, the detection reagent may be further labeled with a quencher dye such as Tamra, especially when the reagent is used as a self-quenching probe such as a TaqMan (U.S. Pat. Nos. 5,210,015 and 5,538,848) or Molecular Beacon probe (U.S. Pat. Nos. 5,118, 801 and 5,312,728), or other stemless or linear beacon probe (Livak et al., 1995, PCR Method Appl. 4:357-362; Tyagi et al., 1996, Nature Biotechnology 14: 303-308; Nazarenko et al., 1997, Nucl. Acids Res. 25:2516-2521; U.S. Pat. Nos. 5,866,336 and 6,117,635).

The detection reagents of the invention may also contain other labels, including but not limited to, biotin for streptavidin binding, hapten for antibody binding, and oligonucleotide for binding to another complementary oligonucleotide such as pairs of zipcodes.

The present invention also contemplates reagents that do not contain (or that are complementary to) a SNP nucleotide identified herein but that are used to assay one or more SNPs disclosed herein. For example, primers that flank, but do not hybridize directly to a target SNP position provided herein are useful in primer extension reactions in which the primers hybridize to a region adjacent to the target SNP position (i.e., within one or more nucleotides from the target SNP site). During the primer extension reaction, a primer is typically not able to extend past a target SNP site if a particular nucleotide (allele) is present at that target SNP site, and the primer extension product can be detected in order to determine which SNP allele is present at the target SNP site. For example, particular ddNTPs are typically used in the primer extension reaction to terminate primer extension once a ddNTP is incorporated into the extension product (a primer extension product which includes a ddNTP at the 3'-most end of the primer extension product, and in which the ddNTP is a nucleotide of a SNP disclosed herein, is a composition that is specifically contemplated by the present invention). Thus, reagents that bind to a nucleic acid molecule in a region adjacent to a SNP site and that are used for assaying the SNP site, even though the bound sequences do not necessarily include the SNP site itself, are also contemplated by the present invention.

SNP Detection Kits and Systems

A person skilled in the art will recognize that, based on the SNP and associated sequence information disclosed herein, detection reagents can be developed and used to assay any SNP of the present invention individually or in combination, and such detection reagents can be readily incorporated into one of the established kit or system formats which are well known in the art. The terms "kits" and "systems", as used herein in the context of SNP detection reagents, are intended to refer to such things as combinations of multiple SNP detection reagents, or one or more SNP detection reagents in combination with one or more other types of elements or components (e.g., other types of biochemical reagents, containers, packages such as packaging intended for commercial sale, substrates to which SNP detection reagents are attached, electronic hardware components, etc.). Accordingly, the present invention further provides SNP detection kits and systems, including but not limited to, packaged probe and primer sets (e.g., TaqMan probe/primer sets), arrays/microarrays of nucleic acid molecules, and beads that contain one or more probes, primers, or other detection reagents for detecting one or more SNPs of the present invention. The kits/systems can optionally include various electronic hardware components; for example, arrays ("DNA chips") and microfluidic systems ("lab-on-a-chip" systems) provided by various manufacturers typically comprise hardware components. Other kits/systems (e.g., probe/primer sets) may not include electronic hardware components, but may be comprised of, for example, one or more SNP detection reagents (along with, optionally, other biochemical reagents) packaged in one or more containers.

In some embodiments, a SNP detection kit typically contains one or more detection reagents and other components (e.g., a buffer, enzymes such as DNA polymerases or ligases, chain extension nucleotides such as deoxynucleotide triphosphates, and in the case of Sanger-type DNA sequencing reactions, chain terminating nucleotides, positive control sequences, negative control sequences, and the like) necessary to carry out an assay or reaction, such as amplification and/or detection of a SNP-containing nucleic acid molecule. A kit may further contain means for determining the amount of a target nucleic acid, and means for comparing the amount with a standard, and can comprise instructions for using the kit to detect the SNP-containing nucleic acid molecule of interest. In one embodiment of the present invention, kits are provided which contain the necessary reagents to carry out one or more assays to detect one or more SNPs disclosed herein. In a preferred embodiment of the present invention, SNP detection kits/systems are in the form of nucleic acid arrays, or compartmentalized kits, including microfluidic/lab-on-a-chip systems.

SNP detection kits/systems may contain, for example, one or more probes, or pairs of probes, that hybridize to a nucleic acid molecule at or near each target SNP position. Multiple pairs of allele-specific probes may be included in the kit/system to simultaneously assay large numbers of SNPs, at least one of which is a SNP of the present invention. In some kits/systems, the allele-specific probes are immobilized to a substrate such as an array or bead. For example, the same substrate can comprise allele-specific probes for detecting at least 1; 10; 100; 1000; 10,000; 100,000 (or any other number in-between) or substantially all of the SNPs shown in Table 1 and/or Table 2.

The terms "arrays", "microarrays", and "DNA chips" are used herein interchangeably to refer to an array of distinct polynucleotides affixed to a substrate, such as glass, plastic, paper, nylon or other type of membrane, filter, chip, or any other suitable solid support. The polynucleotides can be synthesized directly on the substrate, or synthesized separate from the substrate and then affixed to the substrate. In one embodiment, the microarray is prepared and used according to the methods described in U.S. Pat. No. 5,837,832, Chee et al., PCT application WO95/11995 (Chee et al.), Lockhart, D. J. et al. (1996; *Nat. Biotech.* 14: 1675-1680) and Schena, M. et al. (1996; *Proc. Natl. Acad. Sci.* 93: 10614-10619), all of which are incorporated herein in their entirety by reference.

In other embodiments, such arrays are produced by the methods described by Brown et al., U.S. Pat. No. 5,807,522.

Nucleic acid arrays are reviewed in the following references: Zammatteo et al., "New chips for molecular biology and diagnostics", *Biotechnol Annu Rev.* 2002; 8:85-101; Sosnowski et al., "Active microelectronic array system for DNA hybridization, genotyping and pharmacogenomic applications", *Psychiatr Genet.* 2002 December; 12(4):181-92; Heller, "DNA microarray technology: devices, systems, and applications", *Annu Rev Biomed Eng.* 2002; 4:129-53. Epub 2002 Mar. 22; Kolchinsky et al., "Analysis of SNPs and other genomic variations using gel-based chips", *Hum Mutat.* 2002 April; 19(4):343-60; and McGall et al., "High-density genechip oligonucleotide probe arrays", *Adv Biochem Eng Biotechnol.* 2002; 77:21-42.

Any number of probes, such as allele-specific probes, may be implemented in an array, and each probe or pair of probes can hybridize to a different SNP position. In the case of polynucleotide probes, they can be synthesized at designated areas (or synthesized separately and then affixed to designated areas) on a substrate using a light-directed chemical process. Each DNA chip can contain, for example, thousands to millions of individual synthetic polynucleotide probes arranged in a grid-like pattern and miniaturized (e.g., to the size of a dime). Preferably, probes are attached to a solid support in an ordered, addressable array.

A microarray can be composed of a large number of unique, single-stranded polynucleotides, usually either synthetic antisense polynucleotides or fragments of cDNAs, fixed to a solid support. Typical polynucleotides are preferably about 6-60 nucleotides in length, more preferably about 15-30 nucleotides in length, and most preferably about 18-25 nucleotides in length. For certain types of microarrays or other detection kits/systems, it may be preferable to use oligonucleotides that are only about 7-20 nucleotides in length. In other types of arrays, such as arrays used in conjunction with chemiluminescent detection technology, preferred probe lengths can be, for example, about 15-80 nucleotides in length, preferably about 50-70 nucleotides in length, more preferably about 55-65 nucleotides in length, and most preferably about 60 nucleotides in length. The microarray or detection kit can contain polynucleotides that cover the known 5' or 3' sequence of a gene/transcript or target SNP site, sequential polynucleotides that cover the full-length sequence of a gene/transcript; or unique polynucleotides selected from particular areas along the length of a target gene/transcript sequence, particularly areas corresponding to one or more SNPs disclosed in Table 1 and/or Table 2. Polynucleotides used in the microarray or detection kit can be specific to a SNP or SNPs of interest (e.g., specific to a particular SNP allele at a target SNP site, or specific to particular SNP alleles at multiple different SNP sites), or specific to a polymorphic gene/transcript or genes/transcripts of interest.

Hybridization assays based on polynucleotide arrays rely on the differences in hybridization stability of the probes to perfectly matched and mismatched target sequence variants. For SNP genotyping, it is generally preferable that stringency conditions used in hybridization assays are high enough such that nucleic acid molecules that differ from one another at as little as a single SNP position can be differentiated (e.g., typical SNP hybridization assays are designed so that hybridization will occur only if one particular nucleotide is present at a SNP position, but will not occur if an alternative nucleotide is present at that SNP position). Such high stringency conditions may be preferable when using, for example, nucleic acid arrays of allele-specific probes for SNP detection. Such high stringency conditions are described in the preceding section, and are well known to those skilled in the art and can be found in, for example, *Current Protocols in Molecular Biology*, John Wiley & Sons, N.Y. (1989), 6.3.1-6.3.6.

In other embodiments, the arrays are used in conjunction with chemiluminescent detection technology. The following patents and patent applications, which are all hereby incorporated by reference, provide additional information pertaining to chemiluminescent detection: U.S. patent application Ser. Nos. 10/620,332 and 10/620,333 describe chemiluminescent approaches for microarray detection; U.S. Pat. Nos. 6,124,478, 6,107,024, 5,994,073, 5,981,768, 5,871,938, 5,843,681, 5,800,999, and 5773628 describe methods and compositions of dioxetane for performing chemiluminescent detection; and U.S. published application US2002/0110828 discloses methods and compositions for microarray controls.

In one embodiment of the invention, a nucleic acid array can comprise an array of probes of about 15-25 nucleotides in length. In further embodiments, a nucleic acid array can comprise any number of probes, in which at least one probe is capable of detecting one or more SNPs disclosed in Table 1 and/or Table 2, and/or at least one probe comprises a fragment of one of the sequences selected from the group consisting of those disclosed in Table 1, Table 2, the Sequence Listing, and sequences complementary thereto, said fragment comprising at least about 8 consecutive nucleotides, preferably 10, 12, 15, 16, 18, 20, more preferably 22, 25, 30, 40, 47, 50, 55, 60, 65, 70, 80, 90, 100, or more consecutive nucleotides (or any other number in-between) and containing (or being complementary to) a novel SNP allele disclosed in Table 1 and/or Table 2. In some embodiments, the nucleotide complementary to the SNP site is within 5, 4, 3, 2, or 1 nucleotide from the center of the probe, more preferably at the center of said probe.

A polynucleotide probe can be synthesized on the surface of the substrate by using a chemical coupling procedure and an ink jet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more polynucleotides, or any other number which lends itself to the efficient use of commercially available instrumentation.

Using such arrays or other kits/systems, the present invention provides methods of identifying the SNPs disclosed herein in a test sample. Such methods typically involve incubating a test sample of nucleic acids with an array comprising one or more probes corresponding to at least one SNP position of the present invention, and assaying for binding of a nucleic acid from the test sample with one or more of the probes. Conditions for incubating a SNP detection reagent (or a kit/system that employs one or more such SNP detection reagents) with a test sample vary. Incubation conditions depend on such factors as the format employed in the assay, the detection methods employed, and the type and nature of the detection reagents used in the assay. One skilled in the art will recognize that any one of the commonly available hybridization, amplification and array assay formats can readily be adapted to detect the SNPs disclosed herein.

A SNP detection kit/system of the present invention may include components that are used to prepare nucleic acids from a test sample for the subsequent amplification and/or detection of a SNP-containing nucleic acid molecule. Such sample preparation components can be used to produce nucleic acid extracts (including DNA and/or RNA), proteins or membrane extracts from any bodily fluids (such as blood, serum, plasma, urine, saliva, phlegm, gastric juices, semen, tears, sweat, etc.), skin, hair, cells (especially nucleated cells), biopsies, buccal swabs or tissue specimens. The test samples used in the above-described methods will vary based on such factors as the assay format, nature of the detection method, and the specific tissues, cells or extracts used as the test sample to be assayed. Methods of preparing nucleic acids, proteins, and cell extracts are well known in the art and can be readily adapted to obtain a sample that is compatible with the system utilized. Automated sample preparation systems for extracting nucleic acids from a test sample are commercially available, and examples are Qiagen's BioRobot 9600, Applied Biosystems' PRISM 6700, and Roche Molecular Systems' COBAS AmpliPrep System.

Another form of kit contemplated by the present invention is a compartmentalized kit. A compartmentalized kit includes any kit in which reagents are contained in separate containers. Such containers include, for example, small glass containers, plastic containers, strips of plastic, glass or paper, or arraying material such as silica. Such containers allow one to efficiently transfer reagents from one compartment to another compartment such that the test samples and reagents are not cross-contaminated, or from one container to another vessel not included in the kit, and the agents or solutions of each container can be added in a quantitative fashion from one compartment to another or to another vessel. Such containers may include, for example, one or more containers which will accept the test sample, one or more containers which contain at least one probe or other SNP detection reagent for detecting one or more SNPs of the present invention, one or more containers which contain wash reagents (such as phosphate buffered saline, Tris-buffers, etc.), and one or more containers which contain the reagents used to reveal the presence of the bound probe or other SNP detection reagents. The kit can optionally further comprise compartments and/or reagents for, for example, nucleic acid amplification or other enzymatic reactions such as primer extension reactions, hybridization, ligation, electrophoresis (preferably capillary electrophoresis), mass spectrometry, and/or laser-induced fluorescent detection. The kit may also include instructions for using the kit. Exemplary compartmentalized kits include microfluidic devices known in the art (see, e.g., Weigl et al., "Lab-on-a-chip for drug development", Adv Drug Deliv Rev. 2003 Feb. 24; 55(3):349-77). In such microfluidic devices, the containers may be referred to as, for example, microfluidic "compartments", "chambers", or "channels".

Microfluidic devices, which may also be referred to as "lab-on-a-chip" systems, biomedical micro-electro-mechanical systems (bioMEMs), or multicomponent integrated systems, are exemplary kits/systems of the present invention for analyzing SNPs. Such systems miniaturize and compartmentalize processes such as probe/target hybridization, nucleic acid amplification, and capillary electrophoresis reactions in a single functional device. Such microfluidic devices typically utilize detection reagents in at least one aspect, of the system, and such detection reagents may be used to detect one or more SNPs of the present invention. One example of a microfluidic system is disclosed in U.S. Pat. No. 5,589,136, which describes the integration of PCR amplification and capillary electrophoresis in chips. Exemplary microfluidic systems comprise a pattern of microchannels designed onto a glass, silicon, quartz, or plastic wafer included on a microchip. The movements of the samples may be controlled by electric, electroosmotic or hydrostatic forces applied across different areas of the microchip to create functional microscopic valves and pumps with no moving parts. Varying the voltage can be used as a means to control the liquid flow at intersections between the micro-machined channels and to change the liquid flow rate for pumping across different sections of the microchip. See, for example, U.S. Pat. Nos. 6,153,073, Dubrow et al., and 6,156,181, Parce et al.

For genotyping SNPs, an exemplary microfluidic system may integrate, for example, nucleic acid amplification, primer extension, capillary electrophoresis, and a detection method such as laser induced fluorescence detection. In a first step of an exemplary process for using such an exemplary system, nucleic acid samples are amplified, preferably by PCR. Then, the amplification products are subjected to automated primer extension reactions using ddNTPs (specific fluorescence for each ddNTP) and the appropriate oligonucleotide primers to carry out primer extension reactions which hybridize just upstream of the targeted SNP. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. Such an exemplary microchip can be used to process, for example, at least 96 to 384 samples, or more, in parallel.

Uses of Nucleic ACM Molecules

The nucleic acid molecules of the present invention have a variety of uses, especially in the diagnosis and treatment of rheumatoid arthritis. For example, the nucleic acid molecules are useful as hybridization probes, such as for genotyping SNPs in messenger RNA, transcript, cDNA, genomic DNA, amplified DNA or other nucleic acid molecules, and for isolating full-length cDNA and genomic clones encoding the variant peptides disclosed in Table 1 as well as their orthologs.

A probe can hybridize to any nucleotide sequence along the entire length of a nucleic acid molecule provided in Table 1 and/or Table 2. Preferably, a probe of the present invention hybridizes to a region of a target sequence that encompasses a SNP position indicated in Table 1 and/or Table 2. More preferably, a probe hybridizes to a SNP-containing target sequence in a sequence-specific manner such that it distinguishes the target sequence from other nucleotide sequences which vary from the target sequence only by which nucleotide is present at the SNP site. Such a probe is particularly useful for detecting the presence of a SNP-containing nucleic acid in a test sample, or for determining which nucleotide (allele) is present at a particular SNP site (i.e., genotyping the SNP site).

A nucleic acid hybridization probe may be used for determining the presence, level, form, and/or distribution of nucleic acid expression. The nucleic acid whose level is determined can be DNA or RNA. Accordingly, probes specific for the SNPs described herein can be used to assess the presence, expression and/or gene copy number in a given cell, tissue, or organism. These uses are relevant for diagnosis of disorders involving an increase or decrease in gene expression relative to normal levels. In vitro techniques for detection of mRNA include, for example, Northern blot hybridizations and in situ hybridizations. In vitro techniques for detecting DNA include Southern blot hybridizations and in situ hybridizations (Sambrook and Russell, 2000, Molecular Cloning: A Laboratory Manual, Cold Spring Harbor Press, Cold Spring Harbor, N.Y.).

Probes can be used as part of a diagnostic test kit for identifying cells or tissues in which a variant protein is expressed, such as by measuring the level of a variant protein-encoding nucleic acid (e.g., mRNA) in a sample of cells from a subject or determining if a polynucleotide contains a SNP of interest.

Thus, the nucleic acid molecules of the invention can be used as hybridization probes to detect the SNPs disclosed herein, thereby determining whether an individual with the polymorphisms is at risk for rheumatoid arthritis or has developed early stage rheumatoid arthritis. Detection of a SNP associated with a disease phenotype provides a diagnostic tool for an active disease and/or genetic predisposition to the disease.

The nucleic acid molecules of the invention are also useful as primers to amplify any given region of a nucleic acid molecule, particularly a region containing a SNP identified in Table 1 and/or Table 2.

The nucleic acid molecules of the invention are also useful for constructing recombinant vectors (described in greater detail below). Such vectors include expression vectors that express a portion of, or all of, any of the variant peptide sequences provided in Table 1. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced SNPs.

The nucleic acid molecules of the invention are also useful for expressing antigenic portions of the variant proteins, particularly antigenic portions that contain a variant amino acid sequence (e.g., an amino acid substitution) caused by a SNP disclosed in Table 1 and/or Table 2.

The nucleic acid molecules of the invention are also useful for constructing vectors containing a gene regulatory region of the nucleic acid molecules of the present invention.

The nucleic acid molecules of the invention are also useful for designing ribozymes corresponding to all, or a part, of an mRNA molecule expressed from a SNP-containing nucleic acid molecule described herein.

The nucleic acid molecules of the invention are also useful for constructing host cells expressing a part, or all, of the nucleic acid molecules and variant peptides.

The nucleic acid molecules of the invention are also useful for constructing transgenic animals expressing all, or a part, of the nucleic acid molecules and variant peptides. The production of recombinant cells and transgenic animals having nucleic acid molecules which contain the SNPs disclosed in Table 1 and/or Table 2 allow, for example, effective clinical design of treatment compounds and dosage regimens.

The nucleic acid molecules of the invention are also useful in assays for drug screening to identify compounds that, for example, modulate nucleic acid expression.

The nucleic acid molecules of the invention are also useful in gene therapy in patients whose cells have aberrant gene expression. Thus, recombinant cells, which include a patient's cells that have been engineered ex vivo and returned to the patient, can be introduced into an individual where the recombinant cells produce the desired protein to treat the individual.

SNP Genotyping Methods

The process of determining which specific nucleotide (i.e., allele) is present at each of one or more SNP positions, such as a SNP position in a nucleic acid molecule disclosed in Table 1 and/or Table 2, is referred to as SNP genotyping. The present invention provides methods of SNP genotyping, such as for use in screening for rheumatoid arthritis or related pathologies, or determining predisposition thereto, or determining responsiveness to a form of treatment, or in genome mapping or SNP association analysis, etc.

Nucleic acid samples can be genotyped to determine which allele(s) is/are present at any given genetic region (e.g., SNP position) of interest by methods well known in the art. The neighboring sequence can be used to design SNP detection reagents such as oligonucleotide probes, which may optionally be implemented in a kit format. Exemplary SNP genotyping methods are described in Chen et al., "Single nucleotide polymorphism genotyping: biochemistry, protocol, cost and throughput", *Pharmacogenomics J.* 2003; 3(2):77-96; Kwok et al., "Detection of single nucleotide polymorphisms", *Curr Issues Mol Biol.* 2003 April; 5(2):43-60; Shi, "Technologies for individual genotyping: detection of genetic polymorphisms in drug targets and disease genes", *Am J Pharmacogenomics.* 2002; 2(3):197-205; and Kwok, "Methods for genotyping single nucleotide polymorphisms", *Annu Rev Genomics Hum Genet* 2001; 2:235-58. Exemplary techniques for high-throughput SNP genotyping are described in Marnellos, "High-throughput SNP analysis for genetic association studies", *Curr Opin Drug Discov Devel.* 2003 May; 6(3):317-21. Common SNP genotyping methods include, but are not limited to, TaqMan assays, molecular beacon assays, nucleic acid arrays, allele-specific primer extension, allele-specific PCR, arrayed primer extension, homogeneous primer extension assays, primer extension with detection by mass spectrometry, pyrosequencing, multiplex primer extension sorted on genetic arrays, ligation with rolling circle amplification, homogeneous ligation, OLA (U.S. Pat. No. 4,988,167), multiplex ligation reaction sorted on genetic arrays, restriction-fragment length polymorphism, single base extension-tag assays, and the Invader assay. Such methods may be used in combination with detection mechanisms such as, for example, luminescence or chemiluminescence detection, fluorescence detection, time-resolved fluorescence detection, fluorescence resonance energy transfer, fluorescence polarization, mass spectrometry, and electrical detection.

Various methods for detecting polymorphisms include, but are not limited to, methods in which protection from cleavage agents is used to detect mismatched bases in RNA/RNA or RNA/DNA duplexes (Myers et al., *Science* 230:1242 (1985); Cotton et al., *PNAS* 85:4397 (1988); and Saleeba et al., *Meth. Enzymol.* 217:286-295 (1992)), comparison of the electrophoretic mobility of variant and wild type nucleic acid molecules (Orita et al., *PNAS* 86:2766 (1989); Cotton et al., *Mutat. Res.* 285:125-144 (1993); and Hayashi et al., *Genet. Anal. Tech. Appl.* 9:73-79 (1992)), and assaying the movement of polymorphic or wild-type fragments in polyacrylamide gels containing a gradient of denaturant using denaturing gradient gel electrophoresis (DGGE) (Myers et al., *Nature* 313:495 (1985)). Sequence variations at specific locations can also be assessed by nuclease protection assays such as RNase and S1 protection or chemical cleavage methods.

In a preferred embodiment, SNP genotyping is performed using the TaqMan assay, which is also known as the 5' nuclease assay (U.S. Pat. Nos. 5,210,015 and 5,538,848). The TaqMan assay detects the accumulation of a specific amplified product during PCR. The TaqMan assay utilizes an oligonucleotide probe labeled with a fluorescent reporter dye and a quencher dye. The reporter dye is excited by irradiation at an appropriate wavelength, it transfers energy to the quencher dye in the same probe via a process called fluorescence resonance energy transfer (FRET). When attached to the probe, the excited reporter dye does not emit a signal. The proximity of the quencher dye to the reporter dye in the intact probe maintains a reduced fluorescence for the reporter. The reporter dye and quencher dye may be at the 5' most and the 3' most ends, respectively, or vice versa. Alternatively, the reporter dye may be at the 5' or 3' most end while the quencher dye is attached to an internal nucleotide, or vice versa. In yet another embodiment, both the reporter and the quencher may be attached to internal nucleotides at a distance from each other such that fluorescence of the reporter is reduced.

During PCR, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The DNA polymerase cleaves the probe between the reporter dye and the quencher dye only if the probe hybridizes to the target SNP-containing template which is amplified during PCR, and the probe is designed to hybridize to the target SNP site only if a particular SNP allele is present.

Preferred TaqMan primer and probe sequences can readily be determined using the SNP and associated nucleic acid sequence information provided herein. A number of computer programs, such as Primer Express (Applied Biosystems, Foster City, Calif.), can be used to rapidly obtain optimal primer/probe sets. It will be apparent to one of skill in the art that such primers and probes for detecting the SNPs of the present invention are useful in diagnostic assays for rheumatoid arthritis and related pathologies, and can be readily incorporated into a kit format. The present invention also includes modifications of the Taqman assay well known in the art such as the use of Molecular Beacon probes (U.S. Pat. Nos. 5,118, 801 and 5,312,728) and other variant formats (U.S. Pat. Nos. 5,866,336 and 6,117,635).

Another preferred method for genotyping the SNPs of the present invention is the use of two oligonucleotide probes in an OLA (see, e.g., U.S. Pat. No. 4,988,617). In this method, one probe hybridizes to a segment of a target nucleic acid with its 3' most end aligned with the SNP site. A second probe hybridizes to an adjacent segment of the target nucleic acid molecule directly 3' to the first probe. The two juxtaposed probes hybridize to the target nucleic acid molecule, and are ligated in the presence of a linking agent such as a ligase if there is perfect complementarity between the 3' most nucleotide of the first probe with the SNP site. If there is a mismatch, ligation would not occur. After the reaction, the ligated probes are separated from the target nucleic acid molecule, and detected as indicators of the presence of a SNP.

The following patents, patent applications, and published international patent applications, which are all hereby incorporated by reference, provide additional information pertaining to techniques for carrying out various types of OLA: U.S. Pat. Nos. 6,027,889, 6,268,148, 5,494,810, 5,830,711, and 6054564 describe OLA strategies for performing SNP detection; WO 97/31256 and WO 00/56927 describe OLA strategies for performing SNP detection using universal arrays, wherein a zipcode sequence can be introduced into one of the hybridization probes, and the resulting product, or amplified product, hybridized to a universal zip code array; U.S. application US01/17329 (and 09/584,905) describes OLA (or LDR) followed by PCR, wherein zipcodes are incorporated into OLA probes, and amplified PCR products are determined by electrophoretic or universal zipcode array readout; U.S. applications 60/427,818, 60/445,636, and 60/445,494 describe SNPlex methods and software for multiplexed SNP detection using OLA followed by PCR, wherein zipcodes are incorporated into OLA probes, and amplified PCR products are hybridized with a zipchute reagent, and the identity of the SNP determined from electrophoretic readout of the zipchute. In some embodiments, OLA is carried out prior to PCR (or another method of nucleic acid amplification). In other embodiments, PCR (or another method of nucleic acid amplification) is carried out prior to OLA.

Another method for SNP genotyping is based on mass spectrometry. Mass spectrometry takes advantage of the unique mass of each of the four nucleotides of DNA. SNPs can be unambiguously genotyped by mass spectrometry by measuring the differences in the mass of nucleic acids having alternative SNP alleles. MALDI-TOF (Matrix Assisted Laser Desorption Ionization—Time of Flight) mass spectrometry technology is preferred for extremely precise determinations of molecular mass, such as SNPs. Numerous approaches to SNP analysis have been developed based on mass spectrometry. Preferred mass spectrometry-based methods of SNP genotyping include primer extension assays, which can also be utilized in combination with other approaches, such as traditional gel-based formats and microarrays.

Typically, the primer extension assay involves designing and annealing a primer to a template PCR amplicon upstream (5') from a target SNP position. A mix of dideoxynucleotide triphosphates (ddNTPs) and/or deoxynucleotide triphosphates (dNTPs) are added to a reaction mixture containing template (e.g., a SNP-containing nucleic acid molecule which has typically been amplified, such as by PCR), primer, and DNA polymerase. Extension of the primer terminates at the first position in the template where a nucleotide complementary to one of the ddNTPs in the mix occurs. The primer can be either immediately adjacent (i.e., the nucleotide at the 3' end of the primer hybridizes to the nucleotide next to the target SNP site) or two or more nucleotides removed from the SNP position. If the primer is several nucleotides removed from the target SNP position, the only limitation is that the template sequence between the 3' end of the primer and the SNP position cannot contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide upstream from the SNP position (i.e., the nucleotide at the 3' end of the primer hybridizes to the nucleotide that is immediately adjacent to the target SNP site on the 5' side of the target SNP site). Extension by only one nucleotide is preferable, as it minimizes the overall mass of the extended primer, thereby increasing the resolution of mass differences between alternative SNP nucleotides. Furthermore, mass-tagged ddNTPs can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers can then be purified and analyzed by MALDI-TOF mass spectrometry to determine the identity of the nucleotide present at the target SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller m/z travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position. For further information regarding the use of primer extension assays in conjunction with MALDI-TOF mass spectrometry for SNP genotyping, see, e.g., Wise et al., "A standard protocol for single nucleotide primer extension in the human genome using matrix-assisted laser desorption/ionization time-of-flight mass spectrometry", *Rapid Commun Mass Spectrom.* 2003; 17(11): 1195-202.

The following references provide further information describing mass spectrometry-based methods for SNP genotyping: Bocker, "SNP and mutation discovery using base-specific cleavage and MALDI-TOF mass spectrometry", *Bioinformatics.* 2003 July; 19 Suppl 1:144-153; Storm et al., "MALDI-TOF mass spectrometry-based SNP genotyping", *Methods Mol Biol.* 2003; 212:241-62; Jurinke et al., "The use of MassARRAY technology for high throughput genotyping", *Adv Biochem Eng Biotechnol.* 2002; 77:57-74; and Jurinke et al., "Automated genotyping using the DNA MassArray technology", *Methods Mol Biol.* 2002; 187:179-92.

SNPs can also be scored by direct DNA sequencing. A variety of automated sequencing procedures can be utilized ((1995) *Biotechniques* 19:448), including sequencing by mass spectrometry (see, e.g., PCT International Publication No. WO94/16101; Cohen et al., *Adv. Chromatogr.* 36:127-162 (1996); and Griffin et al., *Appl. Biochem. Biotechnol.* 38:147-159 (1993)). The nucleic acid sequences of the present invention enable one of ordinary skill in the art to readily design sequencing primers for such automated sequencing procedures. Commercial instrumentation, such as the Applied Biosystems 377, 3100, 3700, 3730, and 3730×1 DNA Analyzers (Foster City, Calif.), is commonly used in the art for automated sequencing.

Other methods that can be used to genotype the SNPs of the present invention include single-strand conformational polymorphism (SSCP), and denaturing gradient gel electrophoresis (DGGE) (Myers et al., *Nature* 313:495 (1985)). SSCP identifies base differences by alteration in electrophoretic migration of single stranded PCR products, as described in Orita et al., *Proc. Nat. Acad.* Single-stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel (Erlich, ed., PCR Technology, *Principles and Applications for DNA Amplification*, W.H. Freeman and Co, New York, 1992, Chapter 7).

Sequence-specific ribozymes (U.S. Pat. No. 5,498,531) can also be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis SNP genotyping can include the steps of, for example, collecting a biological sample from a human subject (e.g., sample of tissues, cells, fluids, secretions, etc.), isolating nucleic acids (e.g., genomic DNA, mRNA or both) from the cells of the sample, contacting the nucleic acids with one or more primers which specifically hybridize to a region of the isolated nucleic acid containing a target SNP under conditions such that hybridization and amplification of the target nucleic acid region occurs, and determining the nucleotide present at the SNP position of interest, or, in some assays, detecting the presence or absence of an amplification product (assays can be designed so that hybridization and/or amplification will only occur if a particular SNP allele is present or absent). In some assays, the size of the amplification product is detected and compared to the length of a control sample; for example, deletions and insertions can be detected by a change in size of the amplified product compared to a normal genotype.

SNP genotyping is useful for numerous practical applications, as described below. Examples of such applications include, but are not limited to, SNP-disease association analysis, disease predisposition screening, disease diagnosis, disease prognosis, disease progression monitoring, determining therapeutic strategies based on an individual's genotype ("pharmacogenomics"), developing therapeutic agents based on SNP genotypes associated with a disease or likelihood of responding to a drug, stratifying a patient population for clinical trial for a treatment regimen, predicting the likelihood that an individual will experience toxic side effects from a therapeutic agent, and human identification applications such as forensics.

Analysis of Genetic Association Between SNPs and Phenotypic Traits

SNP genotyping for disease diagnosis, disease predisposition screening, disease prognosis, determining drug responsiveness (pharmacogenomics), drug toxicity screening, and other uses described herein, typically relies on initially establishing a genetic association between one or more specific SNPs and the particular phenotypic traits of interest.

Different study designs may be used for genetic association studies (*Modern Epidemiology*, Lippincott Williams & Wilkins (1998), 609-622). Observational studies are most frequently carried out in which the response of the patients is not interfered with. The first type of observational study identifies a sample of persons in whom the suspected cause of the disease is present and another sample of persons in whom the suspected cause is absent, and then the frequency of development of disease in the two samples is compared. These sampled populations are called cohorts, and the study is a prospective study. The other type of observational study is case-control or a retrospective study. In typical case-control studies, samples are collected from individuals with the phenotype of interest (cases) such as certain manifestations of a disease, and from individuals without the phenotype (controls) in a population (target population) that conclusions are to be drawn from. Then the possible causes of the disease are investigated retrospectively. As the time and costs of collecting samples in case-control studies are considerably less than those for prospective studies, case-control studies are the more commonly used study design in genetic association studies, at least during the exploration and discovery stage.

In both types of observational studies, there may be potential confounding factors that should be taken into consideration. Confounding factors are those that are associated with both the real cause(s) of the disease and the disease itself, and they include demographic information such as age, gender, ethnicity as well as environmental factors. When confounding factors are not matched in cases and controls in a study, and are not controlled properly, spurious association results can arise. If potential confounding factors are identified, they should be controlled for by analysis methods explained below.

In a genetic association study, the cause of interest to be tested is a certain allele or a SNP or a combination of alleles or a haplotype from several SNPs. Thus, tissue specimens (e.g., whole blood) from the sampled individuals may be collected and genomic DNA genotyped for the SNP(s) of interest. In addition to the phenotypic trait of interest, other information such as demographic (e.g., age, gender, ethnicity, etc.), clinical, and environmental information that may influence the outcome of the trait can be collected to further characterize and define the sample set. In many cases, these factors are known to be associated with diseases and/or SNP allele frequencies. There are likely gene-environment and/or gene-gene interactions as well. Analysis methods to address gene-environment and gene-gene interactions (for example, the effects of the presence of both susceptibility alleles at two different genes can be greater than the effects of the individual alleles at two genes combined) are discussed below.

After all the relevant phenotypic and genotypic information has been obtained, statistical analyses are carried out to determine if there is any significant correlation between the presence of an allele or a genotype with the phenotypic characteristics of an individual. Preferably, data inspection and cleaning are first performed before carrying out statistical tests for genetic association. Epidemiological and clinical data of the samples can be summarized by descriptive statistics with tables and graphs. Data validation is preferably performed to check for data completion, inconsistent entries, and outliers. Chi-squared tests and t-tests (Wilcoxon rank-sum tests if distributions are not normal) may then be used to check for significant differences between cases and controls for discrete and continuous variables, respectively. To ensure genotyping quality, Hardy-Weinberg disequilibrium tests can be performed on cases and controls separately. Significant deviation from Hardy-Weinberg equilibrium (HWE) in both cases and controls for individual markers can be indicative of genotyping errors. If HWE is violated in a majority of markers, it is indicative of population substructure that should be further investigated. Moreover, Hardy-Weinberg disequilibrium in cases only can indicate genetic association of the markers with the disease (*Genetic Data Analysis*, Weir B., Sinauer (1990)).

To test whether an allele of a single SNP is associated with the case or control status of a phenotypic trait, one skilled in the art can compare allele frequencies in cases and controls. Standard chi-squared tests and Fisher exact tests can be carried out on a 2×2 table (2 SNP alleles×2 outcomes in the categorical trait of interest). To test whether genotypes of a SNP are associated, chi-squared tests can be carried out on a 3×2 table (3 genotypes×2 outcomes). Score tests are also carried out for genotypic association to contrast the three genotypic frequencies (major homozygotes, heterozygotes and minor homozygotes) in cases and controls, and to look for trends using 3 different modes of inheritance, namely dominant (with contrast coefficients 2, −1, −1), additive (with contrast coefficients 1, 0, −1) and recessive (with contrast coefficients 1, 1, −2). Odds ratios for minor versus major alleles, and odds ratios for heterozygote and homozygote variants versus the wild type genotypes are calculated with the desired confidence limits, usually 95%.

In order to control for confounders and to test for interaction and effect modifiers, stratified analyses may be performed using stratified factors that are likely to be confounding, including demographic information such as age, ethnicity, and gender, or an interacting element or effect modifier, such as a known major gene (e.g., APOE for Alzheimer's disease or HLA genes for autoimmune diseases), or environmental factors such as smoking in lung cancer. Stratified association tests may be carried out using Cochran-Mantel-Haenszel tests that take into account the ordinal nature of genotypes with 0, 1, and 2 variant alleles. Exact tests by StatXact may also be performed when computationally possible. Another way to adjust for confounding effects and test for interactions is to perform stepwise multiple logistic regression analysis using statistical packages such as SAS or R. Logistic regression is a model-building technique in which the best fitting and most parsimonious model is built to describe the relation between the dichotomous outcome (for instance, getting a certain disease or not) and a set of independent variables (for instance, genotypes of different associated genes, and the associated demographic and environmental factors). The most common model is one in which the logit transformation of the odds ratios is expressed as a linear combination of the variables (main effects) and their cross-product terms (interactions) (Applied Logistic Regression, Hosmer and Lemeshow, Wiley (2000)). To test whether a certain variable or interaction is significantly associated with the outcome, coefficients in the model are first estimated and then tested for statistical significance of their departure from zero.

In addition to performing association tests one marker at a time, haplotype association analysis may also be performed to study a number of markers that are closely linked together. Haplotype association tests can have better power than genotypic or allelic association tests when the tested markers are not the disease-causing mutations themselves but are in linkage disequilibrium with such mutations. The test will even be more powerful if the disease is indeed caused by a combination of alleles on a haplotype (e.g., APOE is a haplotype formed by 2 SNPs that are very close to each other). In order to perform haplotype association effectively, marker-marker linkage disequilibrium measures, both D' and $R^2$, are typically calculated for the markers within a gene to elucidate the haplotype structure. Recent studies (Daly et al, *Nature Genetics*, 29, 232-235, 2001) in linkage disequilibrium indicate that SNPs within a gene are organized in block pattern, and a high degree of linkage disequilibrium exists within blocks and very little linkage disequilibrium exists between blocks. Haplotype association with the disease status can be performed using such blocks once they have been elucidated.

Haplotype association tests can be carried out in a similar fashion as the allelic and genotypic association tests. Each haplotype in a gene is analogous to an allele in a multi-allelic marker. One skilled in the art can either compare the haplotype frequencies in cases and controls or test genetic association with different pairs of haplotypes. It has been proposed (Schaid et al, *Am. J. Hum. Genet.*, 70, 425-434, 2002) that score tests can be done on haplotypes using the program "haplo.score". In that method, haplotypes are first inferred by EM algorithm and score tests are carried out with a generalized linear model (GLM) framework that allows the adjustment of other factors.

An important decision in the performance of genetic association tests is the determination of the significance level at which significant association can be declared when the p-value of the tests reaches that level. In an exploratory analysis where positive hits will be followed up in subsequent confirmatory testing, an unadjusted p-value <0.1 (a significance level on the lenient side) may be used for generating hypotheses for significant association of a SNP with certain phenotypic characteristics of a disease. It is preferred that a p-value <0.05 (a significance level traditionally used in the art) is achieved in order for a SNP to be considered to have an association with a disease. It is more preferred that a p-value <0.01 (a significance level on the stringent side) is achieved for an association to be declared. When hits are followed up in confirmatory analyses in more samples of the same source or in different samples from different sources, adjustment for multiple testing will be performed as to avoid excess number of hits while maintaining the experiment-wise error rates at 0.05. While there are different methods to adjust for multiple testing to control for different kinds of error rates, a commonly used but rather conservative method is Bonferroni correction to control the experiment-wise or family-wise error rate (*Multiple comparisons and multiple tests*, Westfall et al, SAS Institute (1999)). Permutation tests to control for the false discovery rates, FDR, can be more powerful (Benjamini and Hochberg, Journal of the Royal Statistical Society, Series B 57, 1289-1300, 1995, *Resampling-based Multiple Testing*, Westfall and Young, Wiley (1993)). Such methods to control for multiplicity would be preferred when the tests are dependent and controlling for false discovery rates is sufficient as opposed to controlling for the experiment-wise error rates.

In replication studies using samples from different populations after statistically significant markers have been identified in the exploratory stage, meta-analyses can then be performed by combining evidence of different studies (*Modern Epidemiology*, Lippincott Williams & Wilkins, 1998, 643-673). If available, association results known in the art for the same SNPs can be included in the meta-analyses.

Since both genotyping and disease status classification can involve errors, sensitivity analyses may be performed to see how odds ratios and p-values would change upon various estimates on genotyping and disease classification error rates.

It has been well known that subpopulation-based sampling bias between cases and controls can lead to spurious results in case-control association studies (Ewens and Spielman, *Am. J. Hum. Genet.* 62, 450-458, 1995) when prevalence of the disease is associated with different subpopulation groups. Such bias can also lead to a loss of statistical power in genetic association studies. To detect population stratification, Pritchard and Rosenberg (Pritchard et al. *Am. J. Hum. Gen.* 1999, 65:220-228) suggested typing markers that are unlinked to the disease and using results of association tests on those markers to determine whether there is any population stratification. When stratification is detected, the genomic control (GC) method as proposed by Devlin and Roeder (Devlin et al. *Biometrics* 1999, 55:997-1004) can be used to adjust for the inflation of test statistics due to population stratification. GC method is robust to changes in population structure levels as well as being applicable to DNA pooling designs (Devlin et al. *Genet. Epidem.* 20001, 21:273-284).

While Pritchard's method recommended using 15-20 unlinked microsatellite markers, it suggested using more than 30 biallelic markers to get enough power to detect population stratification. For the GC method, it has been shown (Bacanu et al. *Am. J. Hum. Genet.* 2000, 66:1933-1944) that about 60-70 biallelic markers are sufficient to estimate the inflation factor for the test statistics due to population stratification. Hence, 70 intergenic SNPs can be chosen in unlinked regions as indicated in a genome scan (Kehoe et al. *Hum. Mol. Genet.* 1999, 8:237-245).

Once individual risk factors, genetic or non-genetic, have been found for the predisposition to disease, the next step is to set up a classification/prediction scheme to predict the category (for instance, disease or no-disease) that an individual will be in depending on his genotypes of associated SNPs and other non-genetic risk factors. Logistic regression for discrete trait and linear regression for continuous trait are standard techniques for such tasks (*Applied Regression Analysis*, Draper and Smith, Wiley (1998)). Moreover, other techniques can also be used for setting up classification. Such techniques include, but are not limited to, MART, CART, neural network, and discriminant analyses that are suitable for use in comparing the performance of different methods (*The Elements of Statistical Learning*, Hastie, Tibshirani & Friedman, Springer (2002)).

Disease Diagnosis and Predisposition Screening

Information on association/correlation between genotypes and disease-related phenotypes can be exploited in several ways. For example, in the case of a highly statistically significant association between one or more SNPs with predisposition to a disease for which treatment is available, detection of such a genotype pattern in an individual may justify immediate administration of treatment, or at least the institution of regular monitoring of the individual. Detection of the susceptibility alleles associated with serious disease in a couple contemplating having children may also be valuable to the couple in their reproductive decisions. In the case of a weaker but still statistically significant association between a SNP and a human disease, immediate therapeutic intervention or monitoring may not be justified after detecting the susceptibility allele or SNP. Nevertheless, the subject can be motivated to begin simple life-style changes (e.g., diet, exercise) that can be accomplished at little or no cost to the individual but would confer potential benefits in reducing the risk of developing conditions for which that individual may have an increased risk by virtue of having the susceptibility allele(s).

The SNPs of the invention may contribute to rheumatoid arthritis in an individual in different ways. Some polymorphisms occur within a protein coding sequence and contribute to disease phenotype by affecting protein structure. Other polymorphisms occur in noncoding regions but may exert phenotypic effects indirectly via influence on, for example, replication, transcription, and/or translation. A single SNP may affect more than one phenotypic trait. Likewise, a single phenotypic trait may be affected by multiple SNPs in different genes.

As used herein, the terms "diagnose", "diagnosis", and "diagnostics" include, but are not limited to any of the following: detection of rheumatoid arthritis that an individual may presently have, predisposition screening (i.e., determining the increased risk of an individual in developing rheumatoid arthritis in the future, or determining whether an individual has a decreased risk of developing rheumatoid arthritis in the future), determining a particular type or subclass of rheumatoid arthritis in an individual known to have rheumatoid arthritis, confirming or reinforcing a previously made diagnosis of rheumatoid arthritis, pharmacogenomic evaluation of an individual to determine which therapeutic strategy that individual is most likely to positively respond to or to predict whether a patient is likely to respond to a particular treatment, predicting whether a patient is likely to experience toxic effects from a particular treatment or therapeutic compound, and evaluating the future prognosis of an individual having rheumatoid arthritis. Such diagnostic uses are based on the SNPs individually or in a unique combination or SNP haplotypes of the present invention.

Haplotypes are particularly useful in that, for example, fewer SNPs can be genotyped to determine if a particular genomic region harbors a locus that influences a particular phenotype, such as in linkage disequilibrium-based SNP association analysis.

Linkage disequilibrium (LD) refers to the co-inheritance of alleles (e.g., alternative nucleotides) at two or more different SNP sites at frequencies greater than would be expected from the separate frequencies of occurrence of each allele in a given population. The expected frequency of co-occurrence of two alleles that are inherited independently is the frequency of the first allele multiplied by the frequency of the second allele. Alleles that co-occur at expected frequencies are said to be in "linkage equilibrium". In contrast, LD refers to any non-random genetic association between allele(s) at two or more different SNP sites, which is generally due to the physical proximity of the two loci along a chromosome. LD can occur when two or more SNPs sites are in close physical proximity to each other on a given chromosome and therefore alleles at these SNP sites will tend to remain unseparated for multiple generations with the consequence that a particular nucleotide (allele) at one SNP site will show a non-random association with a particular nucleotide (allele) at a different SNP site located nearby. Hence, genotyping one of the SNP sites will give almost the same information as genotyping the other SNP site that is in LD.

For diagnostic purposes, if a particular SNP site is found to be useful for diagnosing rheumatoid arthritis, then the skilled artisan would recognize that other SNP sites which are in LD with this SNP site would also be useful for diagnosing the condition. Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome.

For diagnostic applications, polymorphisms (e.g., SNPs and/or haplotypes) that are not the actual disease-causing (causative) polymorphisms, but are in LD with such causative polymorphisms, are also useful. In such instances, the genotype of the polymorphism(s) that is/are in LD with the causative polymorphism is predictive of the genotype of the causative polymorphism and, consequently, predictive of the phenotype (e.g., rheumatoid arthritis) that is influenced by the causative SNP(s). Thus, polymorphic markers that are in LD with causative polymorphisms are useful as diagnostic markers, and are particularly useful when the actual causative polymorphism(s) is/are unknown.

Linkage disequilibrium in the human genome is reviewed in: Wall et al., "Haplotype blocks and linkage disequilibrium in the human genome", *Nat Rev Genet.* 2003 August; 4(8): 587-97; Garner et al., "On selecting markers for association studies: patterns of linkage disequilibrium between two and three diallelic loci", *Genet Epidemiol.* 2003 January; 24(1): 57-67; Ardlie et al., "Patterns of linkage disequilibrium in the human genome", *Nat Rev Genet.* 2002 April; 3(4):299-309 (erratum in *Nat Rev Genet.* 2002 July; 3(7):566); and Remm et al., "High-density genotyping and linkage disequilibrium in the human genome using chromosome 22 as a model"; *Curr Opin Chem. Biol.* 2002 February; 6(1):24-30.

The contribution or association of particular SNPs and/or SNP haplotypes with disease phenotypes, such as rheumatoid arthritis, enables the SNPs of the present invention to be used to develop superior diagnostic tests capable of identifying individuals who express a detectable trait, such as rheumatoid arthritis, as the result of a specific genotype, or individuals whose genotype places them at an increased or decreased risk of developing a detectable trait at a subsequent time as compared to individuals who do not have that genotype. As described herein, diagnostics may be based on a single SNP or a group of SNPs. Combined detection of a plurality of SNPs (for example, 2, 3, 4, 5, 6, 7, 8, 9, 10, 11, 12, 13, 14, 15, 16, 17, 18, 19, 20, 24, 25, 30, 32, 48, 50, 64, 96, 100, or any other number in-between, or more, of the SNPs provided in Table 1 and/or Table 2) typically increases the probability of an accurate diagnosis. For example, the presence of a single SNP known to correlate with rheumatoid arthritis might indicate a probability of 20% that an individual has or is at risk of developing rheumatoid arthritis, whereas detection of five SNPs, each of which correlates with rheumatoid arthritis, might indicate a probability of 80% that an individual has or is at risk of developing rheumatoid arthritis. To further increase the accuracy of diagnosis or predisposition screening, analysis of the SNPs of the present invention can be combined with that of other polymorphisms or other risk factors of rheumatoid arthritis, such as disease symptoms, pathological characteristics, family history, diet, environmental factors or lifestyle factors.

It will, of course, be understood by practitioners skilled in the treatment or diagnosis of rheumatoid arthritis that the present invention generally does not intend to provide an absolute identification of individuals who are at risk (or less at risk) of developing rheumatoid arthritis, and/or pathologies related to rheumatoid arthritis, but rather to indicate a certain increased (or decreased) degree or likelihood of developing the disease based on statistically significant association results. However, this information is extremely valuable as it can be used to, for example, initiate preventive treatments or to allow an individual carrying one or more significant SNPs or SNP haplotypes to foresee warning signs such as minor clinical symptoms, or to have regularly scheduled physical exams to monitor for appearance of a condition in order to identify and begin treatment of the condition at an early stage. Particularly with diseases that are extremely debilitating or fatal if not treated on time, the knowledge of a potential predisposition, even if this predisposition is not absolute, would likely contribute in a very significant manner to treatment efficacy.

The diagnostic techniques of the present invention may employ a variety of methodologies to determine whether a test subject has a SNP or a SNP pattern associated with an increased or decreased risk of developing a detectable trait or whether the individual suffers from a detectable trait as a result of a particular polymorphism/mutation, including, for example, methods which enable the analysis of individual chromosomes for haplotyping, family studies, single sperm DNA analysis, or somatic hybrids. The trait analyzed using the diagnostics of the invention may be any detectable trait that is commonly observed in pathologies and disorders related to rheumatoid arthritis.

Another aspect of the present invention relates to a method of determining whether an individual is at risk (or less at risk) of developing one or more traits or whether an individual expresses one or more traits as a consequence of possessing a particular trait-causing or trait-influencing allele. These methods generally involve obtaining a nucleic acid sample from an individual and assaying the nucleic acid sample to determine which nucleotide(s) is/are present at one or more SNP positions, wherein the assayed nucleotide(s) is/are indicative of an increased or decreased risk of developing the trait or indicative that the individual expresses the trait as a result of possessing a particular trait-causing or trait-influencing allele.

In another embodiment, the SNP detection reagents of the present invention are used to determine whether an individual has one or more SNP allele(s) affecting the level (e.g., the concentration of mRNA or protein in a sample, etc.) or pattern (e.g., the kinetics of expression, rate of decomposition, stability profile, Km, Vmax, etc.) of gene expression (collectively, the "gene response" of a cell or bodily fluid). Such a determination can be accomplished by screening for mRNA or protein expression (e.g., by using nucleic acid arrays, RT-PCR, TaqMan assays, or mass spectrometry), identifying genes having altered expression in an individual, genotyping SNPs disclosed in Table 1 and/or Table 2 that could affect the expression of the genes having altered expression (e.g., SNPs that are in and/or around the gene(s) having altered expression, SNPs in regulatory/control regions, SNPs in and/or around other genes that are involved in pathways that could affect the expression of the gene(s) having altered expression, or all SNPs could be genotyped), and correlating SNP genotypes with altered gene expression. In this manner, specific SNP alleles at particular SNP sites can be identified that affect gene expression.

Pharmacogenomics and Therapeutics/Drug Development

The present invention provides methods for assessing the pharmacogenomics of a subject harboring particular SNP alleles or haplotypes to a particular therapeutic agent or pharmaceutical compound, or to a class of such compounds. Pharmacogenomics deals with the roles which clinically significant hereditary variations (e.g., SNPs) play in the response to drugs due to altered drug disposition and/or abnormal action in affected persons. See, e.g., Roses, *Nature* 405, 857-865 (2000); Gould Rothberg, *Nature Biotechnology* 19, 209-211 (2001); Eichelbaum, *Clin. Exp. Pharmacol. Physiol.* 23(10-11):983-985 (1996); and Linder, *Clin. Chem.* 43(2):254-266 (1997). The clinical outcomes of these variations can result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. For example, SNPs in drug metabolizing enzymes can affect the activity of these enzymes, which in turn can affect both the intensity and duration of drug action, as well as drug metabolism and clearance.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic variants of a protein in which one or more of the protein functions in one population are different from those in another population. SNPs and the encoded variant peptides thus provide targets to ascertain a genetic predisposition that can affect treatment modality. For example, in a ligand-based treatment, SNPs may give rise to amino terminal extracellular domains and/or other ligand-binding regions of a receptor that are more or less active in ligand binding, thereby affecting subsequent protein activation. Accordingly, ligand dosage would necessarily be modified to maximize the therapeutic effect within a given population containing particular SNP alleles or haplotypes.

As an alternative to genotyping, specific variant proteins containing variant amino acid sequences encoded by alternative SNP alleles could be identified. Thus, pharmacogenomic characterization of an individual permits the selection of effective compounds and effective dosages of such compounds for prophylactic or therapeutic uses based on the individual's SNP genotype, thereby enhancing and optimizing the effectiveness of the therapy. Furthermore, the production of recombinant cells and transgenic animals containing particular SNPs/haplotypes allow effective clinical design and testing of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in treating rheumatoid arthritis. Pharmacogenomic characterization of an individual, based on an individual's SNP genotype, can identify those individuals unlikely to respond to treatment with a particular medication and thereby allows physicians to avoid prescribing the ineffective medication to those individuals. On the other hand, SNP genotyping of an individual may enable physicians to select the appropriate medication and dosage regimen that will be most effective based on an individual's SNP genotype. This information increases a physician's confidence in prescribing medications and motivates patients to comply with their drug regimens. Furthermore, pharmacogenomics may identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et. al., *Trends in Biotechnology*, August 2000.). Thus, pharmacogenomics based on the SNPs disclosed herein has the potential to both save lives and reduce healthcare costs substantially.

Pharmacogenomics in general is discussed further in Rose et al., "Pharmacogenetic analysis of clinically relevant genetic polymorphisms", *Methods Mol Med.* 2003; 85:225-37. Pharmacogenomics as it relates to Alzheimer's disease and other neurodegenerative disorders is discussed in Cacabelos, "Pharmacogenomics for the treatment of dementia", *Ann Med.* 2002; 34(5):357-79, Maimone et al., "Pharmacogenomics of neurodegenerative diseases", *Eur J Pharmacol.* 2001 Feb. 9; 413(1):11-29, and Poirier, "Apolipoprotein E: a pharmacogenetic target for the treatment of Alzheimer's disease", *Mol Diagn.* 1999 December; 4(4):335-41. Pharmacogenomics as it relates to cardiovascular disorders is discussed in Siest et al., "Pharmacogenomics of drugs affecting the cardiovascular system", *Clin Chem Lab Med.* 2003 April; 41(4):590-9, Mukherjee et al., "Pharmacogenomics in cardiovascular diseases", *Prog Cardiovasc Dis.* 2002 May-June; 44(6):479-98, and Mooser et al., "Cardiovascular pharmacogenetics in the SNP era", *J Thromb Haemost.* 2003 July; 1(7):1398-402. Pharmacogenomics as it relates to cancer is discussed in McLeod et al., "Cancer pharmacogenomics: SNPs, chips, and the individual patient", *Cancer Invest.* 2003; 21(4):630-40 and Watters et al., "Cancer pharmacogenomics: current and future applications", *Biochim Biophys Acta.* 2003 Mar. 17; 1603(2):99-111.

The SNPs of the present invention also can be used to identify novel therapeutic targets for rheumatoid arthritis. For example, genes containing the disease-associated variants ("variant genes") or their products, as well as genes or their products that are directly or indirectly regulated by or interacting with these variant genes or their products, can be targeted for the development of therapeutics that, for example, treat the disease or prevent or delay disease onset. The therapeutics may be composed of, for example, small molecules, proteins, protein fragments or peptides, antibodies, nucleic acids, or their derivatives or mimetics which modulate the functions or levels of the target genes or gene products.

The SNP-containing nucleic acid molecules disclosed herein, and their complementary nucleic acid molecules, may be used as antisense constructs to control gene expression in cells, tissues, and organisms. Antisense technology is well established in the art and extensively reviewed in *Antisense Drug Technology: Principles, Strategies, and Applications*, Crooke (ed.), Marcel Dekker, Inc.: New York (2001). An antisense nucleic acid molecule is generally designed to be complementary to a region of mRNA expressed by a gene so that the antisense molecule hybridizes to the mRNA and thereby blocks translation of mRNA into protein. Various classes of antisense oligonucleotides are used in the art, two of which are cleavers and blockers. Cleavers, by binding to target RNAs, activate intracellular nucleases (e.g., RNaseH or RNase L) that cleave the target RNA. Blockers, which also bind to target RNAs, inhibit protein translation through steric hindrance of ribosomes. Exemplary blockers include peptide nucleic acids, morpholinos, locked nucleic acids, and methylphosphonates (see, e.g., Thompson, *Drug Discovery Today*, 7 (17): 912-917 (2002)). Antisense oligonucleotides are directly useful as therapeutic agents, and are also useful for determining and validating gene function (e.g., in gene knock-out or knock-down experiments).

Antisense technology is further reviewed in: Lavery et al., "Antisense and RNAi: powerful tools in drug target discovery and validation", *Curr Opin Drug Discov Devel.* 2003 July; 6(4):561-9; Stephens et al., "Antisense oligonucleotide therapy in cancer", *Curr Opin Mol Ther.* 2003 April; 5(2): 118-22; Kurreck, "Antisense technologies. Improvement through novel chemical modifications", *Eur J Biochem.* 2003 April; 270(8):1628-44; Dias et al., "Antisense oligonucleotides: basic concepts and mechanisms", *Mol Cancer Ther.* 2002 March; 1(5):347-55; Chen, "Clinical development of antisense oligonucleotides as anti-cancer therapeutics", *Methods Mol Med.* 2003; 75:621-36; Wang et al., "Antisense anticancer oligonucleotide therapeutics", *Curr Cancer Drug Targets.* 2001 November; 1(3):177-96; and Bennett, "Efficiency of antisense oligonucleotide drug discovery", *Antisense Nucleic Acid Drug Dev.* 2002 June; 12(3):215-24.

The SNPs of the present invention are particularly useful for designing antisense reagents that are specific for particular nucleic acid variants. Based on the SNP information disclosed herein, antisense oligonucleotides can be produced that specifically target mRNA molecules that contain one or more particular SNP nucleotides. In this manner, expression of mRNA molecules that contain one or more undesired polymorphisms (e.g., SNP nucleotides that lead to a defective protein such as an amino acid substitution in a catalytic domain) can be inhibited or completely blocked. Thus, antisense oligonucleotides can be used to specifically bind a particular polymorphic form (e.g., a SNP allele that encodes a defective protein), thereby inhibiting translation of this form, but which do not bind an alternative polymorphic form (e.g., an alternative SNP nucleotide that encodes a protein having normal function).

Antisense molecules can be used to inactivate mRNA in order to inhibit gene expression and production of defective proteins. Accordingly, these molecules can be used to treat a disorder, such as rheumatoid arthritis, characterized by abnormal or undesired gene expression or expression of certain defective proteins. This technique can involve cleavage by means of ribozymes containing nucleotide sequences complementary to one or more regions in the mRNA that attenuate the ability of the mRNA to be translated. Possible mRNA regions include, for example, protein-coding regions and particularly protein-coding regions corresponding to catalytic activities, substrate/ligand binding, or other functional activities of a protein.

The SNPs of the present invention are also useful for designing RNA interference reagents that specifically target nucleic acid molecules having particular SNP variants. RNA interference (RNAi), also referred to as gene silencing, is based on using double-stranded RNA (dsRNA) molecules to turn genes off. When introduced into a cell, dsRNAs are processed by the cell into short fragments (generally about 21, 22, or 23 nucleotides in length) known as small interfering RNAs (siRNAs) which the cell uses in a sequence-specific manner to recognize and destroy complementary RNAs (Thompson, *Drug Discovery Today*, 7 (17): 912-917 (2002)). Accordingly, an aspect of the present invention specifically contemplates isolated nucleic acid molecules that are about 18-26 nucleotides in length, preferably 21, 22, or 23 nucleotides in length, and the use of these nucleic acid molecules for RNAi. Because RNAi molecules, including siRNAs, act in a sequence-specific manner, the SNPs of the present invention can be used to design RNAi reagents that recognize and destroy nucleic acid molecules having specific SNP alleles/nucleotides (such as deleterious alleles that lead to the production of defective proteins), while not affecting nucleic acid molecules having alternative SNP alleles (such as alleles that encode proteins having normal function). As with antisense reagents, RNAi reagents may be directly useful as therapeutic agents (e.g., for turning off defective, disease-causing genes), and are also useful for characterizing and validating gene function (e.g., in gene knock-out or knock-down experiments).

The following references provide a further review of RNAi: Reynolds et al., "Rational siRNA design for RNA interference", *Nat Biotechnol.* 2004 March; 22(3):326-30. Epub 2004 Feb. 1; Chi et al., "Genomewide view of gene silencing by small interfering RNAs", *PNAS* 100(11):6343-6346, 2003; Vickers et al., "Efficient Reduction of Target RNAs by Small Interfering RNA and RNase H-dependent Antisense Agents", *J. Biol. Chem.* 278: 7108-7118, 2003; Agami, "RNAi and related mechanisms and their potential use for therapy", *Curr Opin Chem Biol.* 2002 December; 6(6):829-34; Lavery et al., "Antisense and RNAi: powerful tools in drug target discovery and validation", *Curr Opin Drug Discov Devel.* 2003 July; 6(4):561-9; Shi, "Mammalian RNAi for the masses", *Trends Genet* 2003 January; 19(1):9-12), Shuey et al., "RNAi: gene-silencing in therapeutic intervention", *Drug Discovery Today* 2002 October; 7(20):1040-1046; McManus et al., *Nat Rev Genet* 2002 October; 3(10): 737-47; Xia et al., *Nat Biotechnol* 2002 October; 20(10): 1006-10; Plasterk et al., *Curr Opin Genet Dev* 2000 October; 10(5):562-7; Bosher et al., *Nat Cell Biol* 2000 February; 2(2):E31-6; and Hunter, *Curr Biol* 1999 Jun. 17; 9(12):R440-2).

A subject suffering from a pathological condition, such as rheumatoid arthritis, ascribed to a SNP may be treated so as to correct the genetic defect (see Kren et al., *Proc. Natl. Acad. Sci. USA* 96:10349-10354 (1999)). Such a subject can be identified by any method that can detect the polymorphism in a biological sample drawn from the subject. Such a genetic defect may be permanently corrected by administering to such a subject a nucleic acid fragment incorporating a repair sequence that supplies the normal/wild-type nucleotide at the position of the SNP. This site-specific repair sequence can encompass an RNA/DNA oligonucleotide that operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induce incorporation of the normal sequence into the subject's genome. Upon incorporation, the normal gene product is expressed, and the replacement is propagated, thereby engendering a permanent repair and therapeutic enhancement of the clinical condition of the subject.

In cases in which a cSNP results in a variant protein that is ascribed to be the cause of, or a contributing factor to, a pathological condition, a method of treating such a condition can include administering to a subject experiencing the pathology the wild-type/normal cognate of the variant protein. Once administered in an effective dosing regimen, the wild-type cognate provides complementation or remediation of the pathological condition.

The invention further provides a method for identifying a compound or agent that can be used to treat rheumatoid arthritis. The SNPs disclosed herein are useful as targets for the identification and/or development of therapeutic agents. A method for identifying a therapeutic agent or compound typically includes assaying the ability of the agent or compound to modulate the activity and/or expression of a SNP-containing nucleic acid or the encoded product and thus identifying an agent or a compound that can be used to treat a disorder characterized by undesired activity or expression of the SNP-containing nucleic acid or the encoded product. The assays can be performed in cell-based and cell-free systems. Cell-based assays can include cells naturally expressing the nucleic acid molecules of interest or recombinant cells genetically engineered to express certain nucleic acid molecules.

Variant gene expression in a rheumatoid arthritis patient can include, for example, either expression of a SNP-containing nucleic acid sequence (for instance, a gene that contains a SNP can be transcribed into an mRNA transcript molecule containing the SNP, which can in turn be translated into a variant protein) or altered expression of a normal/wild-type nucleic acid sequence due to one or more SNPs (for instance, a regulatory/control region can contain a SNP that affects the level or pattern of expression of a normal transcript).

Assays for variant gene expression can involve direct assays of nucleic acid levels (e.g., mRNA levels), expressed protein levels, or of collateral compounds involved in a signal pathway. Further, the expression of genes that are up- or down-regulated in response to the signal pathway can also be assayed. In this embodiment; the regulatory regions of these genes can be operably linked to a reporter gene such as luciferase.

Modulators of variant gene expression can, be identified in a method wherein, for example, a cell is contacted with a candidate compound/agent and the expression of mRNA determined. The level of expression of mRNA in the presence of the candidate compound is compared to the level of expression of mRNA in the absence of the candidate compound. The candidate compound can then be identified as a modulator of variant gene expression based on this comparison and be used to treat a disorder such as rheumatoid arthritis that is characterized by variant gene expression (e.g., either expression of a SNP-containing nucleic acid or altered expression of a normal/wild-type nucleic acid molecule due to one or more SNPs that affect expression of the nucleic acid molecule) due to one or more SNPs of the present invention. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP or associated nucleic acid domain (e.g., catalytic domain, ligand/substrate-binding domain, regulatory/control region, etc.) or gene, or the encoded mRNA transcript, as a target, using a compound identified through drug screening as a gene modulator to modulate variant nucleic acid expression. Modulation can include either up-regulation (i.e., activation or agonization) or down-regulation (i.e., suppression or antagonization) of nucleic acid expression.

Expression of mRNA transcripts and encoded proteins, either wild type or variant, may be altered in individuals with a particular SNP allele in a regulatory/control element, such as a promoter or transcription factor binding domain, that regulates expression. In this situation, methods of treatment and compounds can be identified, as discussed herein, that regulate or overcome the variant regulatory/control element, thereby generating normal, or healthy, expression levels of either the wild type or variant protein.

The SNP-containing nucleic acid molecules of the present invention are also useful for monitoring the effectiveness of modulating compounds on the expression or activity of a variant gene, or encoded product, in clinical trials or in a treatment regimen. Thus, the gene expression pattern can serve as an indicator for the continuing effectiveness of treatment with the compound, particularly with compounds to which a patient can develop resistance, as well as an indicator for toxicities. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

In another aspect of the present invention, there is provided a pharmaceutical pack comprising a therapeutic agent (e.g., a small molecule drug, antibody, peptide, antisense or RNAi nucleic acid molecule, etc.) and a set of instructions for administration of the therapeutic agent to humans diagnostically tested for one or more SNPs or SNP haplotypes provided by the present invention.

The SNPs/haplotypes of the present invention are also useful for improving many different aspects of the drug development process. For example, individuals can be selected for clinical trials based on their SNP genotype. Individuals with SNP genotypes that indicate that they are most likely to respond to the drug can be included in the trials and those individuals whose SNP genotypes indicate that they are less likely to or would not respond to the drug, or suffer adverse reactions, can be eliminated from the clinical trials. This not only improves the safety of clinical trials, but also will enhance the chances that the trial will demonstrate statistically significant efficacy. Furthermore, the SNPs of the present invention may explain why certain previously developed drugs performed poorly in clinical trials and may help identify a subset of the population that would benefit from a drug that had previously performed poorly in clinical trials, thereby "rescuing" previously developed drugs, and enabling the drug to be made available to a particular rheumatoid arthritis patient population that can benefit from it.

SNPs have many important uses in drug discovery, screening, and development. A high probability exists that, for any gene/protein selected as a potential drug target, variants of that gene/protein will exist in a patient population. Thus, determining the impact of gene/protein variants on the selection and delivery of a therapeutic agent should be an integral aspect of the drug discovery and development process. (Jazwinska, *A Trends Guide to Genetic Variation and Genomic Medicine,* 2002 March; S30-S36).

Knowledge of variants (e.g., SNPs and any corresponding amino acid polymorphisms) of a particular therapeutic target (e.g., a gene, mRNA transcript, or protein) enables parallel screening of the variants in order to identify therapeutic candidates (e.g., small molecule compounds, antibodies, antisense or RNAi nucleic acid compounds, etc.) that demonstrate efficacy across variants (Rothberg, *Nat Biotechnol* 2001 March; 19(3):209-11). Such therapeutic candidates would be expected to show equal efficacy across a larger segment of the patient population, thereby leading to a larger potential market for the therapeutic candidate.

Furthermore, identifying variants of a potential therapeutic target enables the most common form of the target to be used for selection of therapeutic candidates, thereby helping to ensure that the experimental activity that is observed for the selected candidates reflects the real activity expected in the largest proportion of a patient population (Jazwinska, *A Trends Guide to Genetic Variation and Genomic Medicine,* 2002 March; S30-S36).

Additionally, screening therapeutic candidates against all known variants of a target can enable the early identification of potential toxicities and adverse reactions relating to particular variants. For example, variability in drug absorption, distribution, metabolism and excretion (ADME) caused by, for example, SNPs in therapeutic targets or drug metabolizing genes, can be identified, and this information can be utilized during the drug development process to minimize variability in drug disposition and develop therapeutic agents that are safer across a wider range of a patient population. The SNPs of the present invention, including the variant proteins and encoding polymorphic nucleic acid molecules provided in Tables 1-2, are useful in conjunction with a variety of toxicology methods established in the art, such as those set forth in *Current Protocols in Toxicology,* John Wiley & Sons, Inc., N.Y.

Furthermore, therapeutic agents that target any art-known proteins (or nucleic acid molecules, either RNA or DNA) may cross-react with the variant proteins (or polymorphic nucleic acid molecules) disclosed in Table 1, thereby significantly affecting the pharmacokinetic properties of the drug. Consequently, the protein variants and the SNP-containing nucleic acid molecules disclosed in Tables 1-2 are useful in developing, screening, and evaluating therapeutic agents that target corresponding art-known protein forms (or nucleic acid molecules). Additionally, as discussed above, knowledge of all polymorphic forms of a particular drug target enables the design of therapeutic agents that are effective against most or all such polymorphic forms of the drug target.

Pharmaceutical Compositions and Administration Thereof

Any of the rheumatoid arthritis-associated proteins, and encoding nucleic acid molecules, disclosed herein can be used as therapeutic targets (or directly used themselves as therapeutic compounds) for treating rheumatoid arthritis and related pathologies, and the present disclosure enables therapeutic compounds (e.g., small molecules, antibodies, therapeutic proteins, RNAi and antisense molecules, etc.) to be developed that target (or are comprised of) any of these therapeutic targets.

In general, a therapeutic compound will be administered in a therapeutically effective amount by any of the accepted modes of administration for agents that serve similar utilities. The actual amount of the therapeutic compound of this invention, i.e., the active ingredient, will depend upon numerous factors such as the severity of the disease to be treated, the age and relative health of the subject, the potency of the compound used, the route and form of administration, and other factors.

Therapeutically effective amounts of therapeutic compounds may range from, for example, approximately 0.01-50 mg per kilogram body weight of the recipient per day; preferably about 0.1-20 mg/kg/day. Thus, as an example, for administration to a 70 kg person, the dosage range would most preferably be about 7 mg to 1.4 g per day.

In general, therapeutic compounds will be administered as pharmaceutical compositions by any one of the following routes: oral, systemic (e.g., transdermal, intranasal, or by suppository), or parenteral (e.g., intramuscular, intravenous, or subcutaneous) administration. The preferred manner of administration is oral or parenteral using a convenient daily dosage regimen, which can be adjusted according to the degree of affliction. Oral compositions can take the form of tablets, pills, capsules, semisolids, powders, sustained release formulations, solutions, suspensions, elixirs, aerosols, or any other appropriate compositions.

The choice of formulation depends on various factors such as the mode of drug administration (e.g., for oral administration, formulations in the form of tablets, pills, or capsules are preferred) and the bioavailability of the drug substance. Recently, pharmaceutical formulations have been developed especially for drugs that show poor bioavailability based upon the principle that bioavailability can be increased by increasing the surface area, i.e., decreasing particle size. For example, U.S. Pat. No. 4,107,288 describes a pharmaceutical formulation having particles in the size range from 10 to 1,000 nm in which the active material is supported on a cross-linked matrix of macromolecules. U.S. Pat. No. 5,145,684 describes the production of a pharmaceutical formulation in which the drug substance is pulverized to nanoparticles (average particle size of 400 nm) in the presence of a surface modifier and then dispersed in a liquid medium to give a pharmaceutical formulation that exhibits remarkably high bioavailability.

Pharmaceutical compositions are comprised of, in general, a therapeutic compound in combination with at least one pharmaceutically acceptable excipient. Acceptable excipients are non-toxic, aid administration, and do not adversely affect the therapeutic benefit of the therapeutic compound. Such excipient may be any solid, liquid, semi-solid or, in the case of an aerosol composition, gaseous excipient that is generally available to one skilled in the art.

Solid pharmaceutical excipients include starch, cellulose, talc, glucose, lactose, sucrose, gelatin, malt, rice, flour, chalk, silica gel, magnesium stearate, sodium stearate, glycerol monostearate, sodium chloride, dried skim milk and the like. Liquid and semisolid excipients may be selected from glycerol, propylene glycol, water, ethanol and various oils, including those of petroleum, animal, vegetable or synthetic origin, e.g., peanut oil, soybean oil, mineral oil, sesame oil, etc. Preferred liquid carriers, particularly for injectable solutions, include water, saline, aqueous dextrose, and glycols.

Compressed gases may be used to disperse a compound of this invention in aerosol form. Inert gases suitable for this purpose are nitrogen, carbon dioxide, etc.

Other suitable pharmaceutical excipients and their formulations are described in Remington's Pharmaceutical Sciences, edited by E. W. Martin (Mack Publishing Company, 18th ed., 1990).

The amount of the therapeutic compound in a formulation can vary within the full range employed by those skilled in the art. Typically, the formulation will contain, on a weight percent (wt %) basis, from about 0.01-99.99 wt % of the therapeutic compound based on the total formulation, with the balance being one or more suitable pharmaceutical excipients. Preferably, the compound is present at a level of about 1-80 wt %.

Therapeutic compounds can be administered alone or in combination with other therapeutic compounds or in combination with one or more other active ingredient(s). For example, an inhibitor or stimulator of a rheumatoid arthritis-associated protein can be administered in combination with another agent that inhibits or stimulates the activity of the same or a different rheumatoid arthritis-associated protein to thereby counteract the affects of rheumatoid arthritis.

For further information regarding pharmacology, see *Current Protocols in Pharmacology*, John Wiley & Sons, Inc., N.Y.

Human Identification Applications

In addition to their diagnostic and therapeutic uses in rheumatoid arthritis and related pathologies, the SNPs provided by the present invention are also useful as human identification markers for such applications as forensics, paternity testing, and biometrics (see, e.g., Gill, "An assessment of the utility of single nucleotide polymorphisms (SNPs) for forensic purposes", *Int J Legal Med.* 2001; 114(4-5):204-10). Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked (i.e., inherited independently). Thus, preferred sets of SNPs can be selected from among the SNPs disclosed herein, which may include SNPs on different chromosomes, SNPs on different chromosome arms, and/or SNPs that are dispersed over substantial distances along the same chromosome arm.

Furthermore, among the SNPs disclosed herein, preferred SNPs for use in certain forensic/human identification applications include SNPs located at degenerate codon positions (i.e., the third position in certain codons which can be one of two or more alternative nucleotides and still encode the same amino acid), since these SNPs do not affect the encoded protein. SNPs that do not affect the encoded protein are expected to be under less selective pressure and are therefore expected to be more polymorphic in a population, which is typically an advantage for forensic/human identification applications. However, for certain forensics/human identification applications, such as predicting phenotypic characteristics (e.g., inferring ancestry or inferring one or more physical characteristics of an individual) from a DNA sample, it may be desirable to utilize SNPs that affect the encoded protein.

For many of the SNPs disclosed in Tables 1-2 (which are identified as "Applera" SNP source), Tables 1-2 provide SNP allele frequencies obtained by re-sequencing the DNA of chromosomes from 39 individuals (Tables 1-2 also provide allele frequency information for "Celera" source SNPs and, where available, public SNPs from dbEST, HGBASE, and/or HGMD). The allele frequencies provided in Tables 1-2 enable these SNPs to be readily used for human identification applications. Although any SNP disclosed in Table 1 and/or Table 2 could be used for human identification, the closer that the frequency of the minor allele at a particular SNP site is to 50%, the greater the ability of that SNP to discriminate between different individuals in a population since it becomes increasingly likely that two randomly selected individuals would have different alleles at that SNP site. Using the SNP allele frequencies provided in Tables 1-2, one of ordinary skill in the art could readily select a subset of SNPs for which the frequency of the minor allele is, for example, at least 1%, 2%, 5%, 10%, 20%, 25%, 30%, 40%, 45%, or 50%, or any other frequency in-between. Thus, since Tables 1-2 provide allele frequencies based on the re-sequencing of the chromosomes from 39 individuals, a subset of SNPs could readily be selected for human identification in which the total allele count of the minor allele at a particular SNP site is, for example, at least 1, 2, 4, 8, 10, 16, 20, 24, 30, 32, 36, 38, 39, 40, or any other number in-between.

Furthermore, Tables 1-2 also provide population group (interchangeably referred to herein as ethnic or racial groups) information coupled with the extensive allele frequency information. For example, the group of 39 individuals whose DNA was re-sequenced was made-up of 20 Caucasians and 19 African-Americans. This population group information enables further refinement of SNP selection for human identification. For example, preferred SNPs for human identification can be selected from Tables 1-2 that have similar allele frequencies in both the Caucasian and African-American populations; thus, for example, SNPs can be selected that have equally high discriminatory power in both populations. Alternatively, SNPs can be selected for which there is a statistically significant difference in allele frequencies between the Caucasian and African-American populations (as an extreme example, a particular allele may be observed only in either the Caucasian or the African-American population group but not observed in the other population group); such SNPs are useful, for example, for predicting the race/ethnicity of an unknown perpetrator from a biological sample such as a hair or blood stain recovered at a crime scene. For a discussion of using SNPs to predict ancestry from a DNA sample, including statistical methods, see Frudakis et al., "A Classifier for the SNP-Based Inference of Ancestry", *Journal of Forensic Sciences* 2003; 48(4):771-782.

SNPs have numerous advantages over other types of polymorphic markers, such as short tandem repeats (STRs). For example, SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationaly more stable than repeat polymorphisms. SNPs are not susceptible to artefacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Another significant advantage of SNP markers over STR markers is the much shorter length of nucleic acid needed to score a SNP. For example, STR markers are generally several hundred base pairs in length. A SNP, on the other hand, comprises a single nucleotide, and generally a short conserved region on either side of the SNP position for primer and/or probe binding. This makes SNPs more amenable to typing in highly degraded or aged biological samples that are frequently encountered in forensic casework in which DNA may be fragmented into short pieces.

SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units than has been previously seen in the population, or more or less repeat alleles than are included in a reference allelic ladder. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis.

SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, and therefore the statistical significance of a matching genotype may be questionable. All these advantages of SNP analysis are considerable in light of the consequences of most DNA identification cases, which may lead to life imprisonment for an individual, or re-association of remains to the family of a deceased individual.

DNA can be isolated from biological samples such as blood, bone, hair, saliva, or semen, and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs known in the art or STRs, in order to identify an individual or to associate an individual with a particular biological sample.

Furthermore, the SNPs provided by the present invention can be genotyped for inclusion in a database of DNA genotypes, for example, a criminal DNA databank such as the FBI's Combined DNA Index System (CODIS) database. A genotype obtained from a biological sample of unknown source can then be queried against the database to find a matching genotype, with the SNPs of the present invention providing nucleotide positions at which to compare the known and unknown DNA sequences for identity. Accordingly, the present invention provides a database comprising novel SNPs or SNP alleles of the present invention (e.g., the database can comprise information indicating which alleles are possessed by individual members of a population at one or more novel SNP sites of the present invention), such as for use in forensics, biometrics, or other human identification applications. Such a database typically comprises a computer-based system in which the SNPs or SNP alleles of the present invention are recorded on a computer readable medium (see the section of the present specification entitled "Computer-Related Embodiments").

The SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child, with the SNPs of the present invention providing nucleotide positions at which to compare the putative father's and child's DNA sequences for identity. If the set of polymorphisms in the child attributable to the father does not match the set of polymorphisms of the putative father, it can be concluded, barring experimental error, that the putative father is not the father of the child. If the set of polymorphisms in the child attributable to the father match the set of polymorphisms of the putative father, a statistical calculation can be performed to determine the probability of coincidental match, and a conclusion drawn as to the likelihood that the putative father is the true biological father of the child.

In addition to paternity testing, SNPs are also useful for other types of kinship testing, such as for verifying familial relationships for immigration purposes, or for cases in which an individual alleges to be related to a deceased individual in order to claim an inheritance from the deceased individual, etc. For further information regarding the utility of SNPs for paternity testing and other types of kinship testing, including methods for statistical analysis, see Krawczak, "Informativity assessment for biallelic single nucleotide polymorphisms", *Electrophoresis* 1999 June; 20(8):1676-81.

The use of the SNPs of the present invention for human identification further extends to various authentication systems, commonly referred to as biometric systems, which typically convert physical characteristics of humans (or other organisms) into digital data. Biometric systems include various technological devices that measure such unique anatomical or physiological characteristics as finger, thumb, or palm prints; hand geometry; vein patterning on the back of the hand; blood vessel patterning of the retina and color and texture of the iris; facial characteristics; voice patterns; signature and typing dynamics; and DNA. Such physiological measurements can be used to verify identity and, for example, restrict or allow access based on the identification. Examples of applications for biometrics include physical area security, computer and network security, aircraft passenger check-in and boarding, financial transactions, medical records access, government benefit distribution, voting, law enforcement, passports, visas and immigration, prisons, various military applications, and for restricting access to expensive or dangerous items, such as automobiles or guns (see, for example, O'Connor, Stanford Technology Law Review and U.S. Pat. No. 6,119,096).

Groups of SNPs, particularly the SNPs provided by the present invention, can be typed to uniquely identify an individual for biometric applications such as those described above. Such SNP typing can readily be accomplished using, for example, DNA chips/arrays. Preferably, a minimally invasive means for obtaining a DNA sample is utilized. For example, PCR amplification enables sufficient quantities of DNA for analysis to be obtained from buccal swabs or fingerprints, which contain DNA-containing skin cells and oils that are naturally transferred during contact.

Further information regarding techniques for using SNPs in forensic/human identification applications can be found in, for example, *Current Protocols in Human Genetics*, John Wiley & Sons, N.Y. (2002), 14.1-14.7.

Variant Proteins, Antibodies, Vectors & Host Cells, & Uses Thereof

Variant Proteins Encoded by SNP-Containing Nucleic Acid Molecules

The present invention provides SNP-containing nucleic acid molecules, many of which encode proteins having variant amino acid sequences as compared to the art-known (i.e., wild-type) proteins. Amino acid sequences encoded by the polymorphic nucleic acid molecules of the present invention are provided as SEQ ID NOS:84-166 in Table 1 and the Sequence Listing. These variants will generally be referred to herein as variant proteins/peptides/polypeptides, or polymorphic proteins/peptides/polypeptides of the present invention. The terms "protein", "peptide", and "polypeptide" are used herein interchangeably.

A variant protein of the present invention may be encoded by, for example, a nonsynonymous nucleotide substitution at any one of the cSNP positions disclosed herein. In addition, variant proteins may also include proteins whose expression, structure, and/or function is altered by a SNP disclosed herein, such as a SNP that creates or destroys a stop codon, a SNP that affects splicing, and a SNP in control/regulatory elements, e.g. promoters, enhancers, or transcription factor binding domains.

As used herein, a protein or peptide is said to be "isolated" or "purified" when it is substantially free of cellular material or chemical precursors or other chemicals. The variant proteins of the present invention can be purified to homogeneity or other lower degrees of purity. The level of purification will be based on the intended use. The key feature is that the preparation allows for the desired function of the variant protein, even if in the presence of considerable amounts of other components.

As used herein, "substantially free of cellular material" includes preparations of the variant protein having less than about 30% (by dry weight) other proteins (i.e., contaminating protein), less than about 20% other proteins, less than about 10% other proteins, or less than about 5% other proteins. When the variant protein is recombinantly produced, it can also be substantially free of culture medium, i.e., culture medium represents less than about 20% of the volume of the protein preparation.

The language "substantially free of chemical precursors or other chemicals" includes preparations of the variant protein in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

An isolated variant protein may be purified from cells that naturally express it, purified from cells that have been altered to express it (recombinant host cells), or synthesized using known protein synthesis methods. For example, a nucleic acid molecule containing SNP(s) encoding the variant protein can be cloned into an expression vector, the expression vector introduced into a host cell, and the variant protein expressed in the host cell. The variant protein can then be isolated from the cells by any appropriate purification scheme using standard protein purification techniques. Examples of these techniques are described in detail below (Sambrook and Russell, 2000, Molecular Cloning: A Laboratory Manual, Cold Spring Harbor Laboratory Press, Cold Spring Harbor, N.Y.).

The present invention provides isolated variant proteins that comprise, consist of or consist essentially of amino acid sequences that contain one or more variant amino acids encoded by one or more codons which contain a SNP of the present invention.

Accordingly, the present invention provides variant proteins that consist of amino acid sequences that contain one or more amino acid polymorphisms (or truncations or extensions due to creation or destruction of a stop codon, respectively) encoded by the SNPs provided in Table 1 and/or Table 2. A protein consists of an amino acid sequence when the amino acid sequence is the entire amino acid sequence of the protein.

The present invention further provides variant proteins that consist essentially of amino acid sequences that contain one or more amino acid polymorphisms (or truncations or extensions due to creation or destruction of a stop codon, respectively) encoded by the SNPs provided in Table 1 and/or Table 2. A protein consists essentially of an amino acid sequence when such an amino acid sequence is present with only a few additional amino acid residues in the final protein.

The present invention further provides variant proteins that comprise amino acid sequences that contain one or more amino acid polymorphisms (or truncations or extensions due to creation or destruction of a stop codon, respectively) encoded by the SNPs provided in Table 1 and/or Table 2. A protein comprises an amino acid sequence when the amino acid sequence is at least part of the final amino acid sequence of the protein. In such a fashion, the protein may contain only the variant amino acid sequence or have additional amino acid residues, such as a contiguous encoded sequence that is naturally associated with it or heterologous amino acid residues. Such a protein can have a few additional amino acid residues or can comprise many more additional amino acids. A brief description of how various types of these proteins can be made and isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the coding sequences for the variant protein and the heterologous protein are ligated in-frame. The heterologous protein can be fused to the N-terminus or C-terminus of the variant protein. In another embodiment, the fusion protein is encoded by a fusion polynucleotide that is synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., *Current Protocols in Molecular Biology*, 1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

In many uses, the fusion protein does not affect the activity of the variant protein. The fusion protein can include, but is not limited to, enzymatic fusion proteins, for example, beta-galactosidase fusions, yeast two-hybrid GAL fusions, poly-His fusions, MYC-tagged, HI-tagged and Ig fusions. Such fusion proteins, particularly poly-His fusions, can facilitate their purification following recombinant expression. In certain host cells (e.g., mammalian host cells), expression and/or secretion of a protein can be increased by using a heterologous signal sequence. Fusion proteins are further described in, for example, Terpe, "Overview of tag protein fusions: from molecular and biochemical fundamentals to commercial systems", *Appl Microbiol Biotechnol.* 2003 January; 60(5):523-33. Epub 2002 Nov. 7; Graddis et al., "Designing proteins that work using recombinant technologies", *Curr Pharm Biotechnol.* 2002 December; 3(4):285-97; and Nilsson et al., "Affinity fusion strategies for detection, purification, and immobilization of recombinant proteins", *Protein Expr Purif* 1997 October; 11(1):1-16.

The present invention also relates to further obvious variants of the variant polypeptides of the present invention, such as naturally-occurring mature forms (e.g., alleleic variants), non-naturally occurring recombinantly-derived variants, and orthologs and paralogs of such proteins that share sequence homology. Such variants can readily be generated using art-known techniques in the fields of recombinant nucleic acid technology and protein biochemistry. It is understood, however, that variants exclude those known in the prior art before the present invention.

Further variants of the variant polypeptides disclosed in Table 1 can comprise an amino acid sequence that shares at least 70-80%, 80-85%, 85-90%, 91%, 92%, 93%, 94%, 95%, 96%, 97%, 98%, or 99% sequence identity with an amino acid sequence disclosed in Table 1 (or a fragment thereof) and that includes a novel amino acid residue (allele) disclosed in Table 1 (which is encoded by a novel SNP allele). Thus, an aspect of the present invention that is specifically contemplated are polypeptides that have a certain degree of sequence variation compared with the polypeptide sequences shown in Table 1, but that contain a novel amino acid residue (allele) encoded by a novel SNP allele disclosed herein. In other words, as long as a polypeptide contains a novel amino acid residue disclosed herein, other portions of the polypeptide that flank the novel amino acid residue can vary to some degree from the polypeptide sequences shown in Table 1.

Full-length pre-processed forms, as well as mature processed forms, of proteins that comprise one of the amino acid sequences disclosed herein can readily be identified as having complete sequence identity to one of the variant proteins of the present invention as well as being encoded by the same genetic locus as the variant proteins provided herein.

Orthologs of a variant peptide can readily be identified as having some degree of significant sequence homology/identity to at least a portion of a variant peptide as well as being encoded by a gene from another organism. Preferred orthologs will be isolated from non-human mammals, preferably primates, for the development of human therapeutic targets and agents. Such orthologs can be encoded by a nucleic acid sequence that hybridizes to a variant peptide-encoding nucleic acid molecule under moderate to stringent conditions depending on the degree of relatedness of the two organisms yielding the homologous proteins.

Variant proteins include, but are not limited to, proteins containing deletions, additions and substitutions in the amino acid sequence caused by the SNPs of the present invention. One class of substitutions is conserved amino acid substitutions in which a given amino acid in a polypeptide is substituted for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in, for example, Bowie et al., *Science* 247:1306-1310 (1990).

Variant proteins can be fully functional or can lack function in one or more activities, e.g. ability to bind another molecule, ability to catalyze a substrate, ability to mediate signaling, etc. Fully functional variants typically contain only conservative variations or variations in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, truncations or extensions, or a substitution, insertion, inversion, or deletion of a critical residue or in a critical region.

Amino acids that are essential for function of a protein can be identified by methods known in the art, such as site-directed mutagenesis or alanine-scanning mutagenesis (Cunningham et al., *Science* 244:1081-1085 (1989)), particularly using the amino acid sequence and polymorphism information provided in Table 1. The latter procedure introduces single alanine mutations at every residue in the molecule. The resulting mutant molecules are then tested for biological activity such as enzyme activity or in assays such as an in vitro proliferative activity. Sites that are critical for binding partner/substrate binding can also be determined by structural analysis such as crystallization, nuclear magnetic resonance or photoaffinity labeling (Smith et al., *J. Mol. Biol.* 224:899-904 (1992); de Vos et al. *Science* 255:306-312 (1992)).

Polypeptides can contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Accordingly, the variant proteins of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (e.g., polyethylene glycol), or in which additional amino acids are fused to the mature polypeptide, such as a leader or secretory sequence or a sequence for purification of the mature polypeptide or a pro-protein sequence.

Known protein modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such protein modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as *Proteins—Structure and Molecular Properties*, 2nd Ed., T. E. Creighton, W. H. Freeman and Company, New York (1993); Wold, F., *Posttranslational Covalent Modification of Proteins*, B. C. Johnson, Ed., Academic Press, New York 1-12 (1983); Seifter et al., *Meth. Enzymol.* 182: 626-646 (1990); and Rattan et al., *Ann. N.Y. Acad. Sci.* 663:48-62 (1992).

The present invention further provides fragments of the variant proteins in which the fragments contain one or more amino acid sequence variations (e.g., substitutions, or truncations or extensions due to creation or destruction of a stop codon) encoded by one or more SNPs disclosed herein. The fragments to which the invention pertains, however, are not to be construed as encompassing fragments that have been disclosed in the prior art before the present invention.

As used herein, a fragment may comprise at least about 4, 8, 10, 12, 14, 16, 18, 20, 25, 30, 50, 100 (or any other number in-between) or more contiguous amino acid residues from a variant protein, wherein at least one amino acid residue is affected by a SNP of the present invention, e.g., a variant amino acid residue encoded by a nonsynonymous nucleotide substitution at a cSNP position provided by the present invention. The variant amino acid encoded by a cSNP may occupy any residue position along the sequence of the fragment. Such fragments can be chosen based on the ability to retain one or more of the biological activities of the variant protein or the ability to perform a function, e.g., act as an immunogen. Particularly important fragments are biologically active fragments. Such fragments will typically comprise a domain or motif of a variant protein of the present invention, e.g., active site, transmembrane domain, or ligand/substrate binding domain. Other fragments include, but are not limited to, domain or motif-containing fragments, soluble peptide fragments, and fragments containing immunogenic structures. Predicted domains and functional sites are readily identifiable by computer programs well known to those of skill in the art (e.g., PROSITE analysis) (*Current Protocols in Protein Science*, John Wiley & Sons, N.Y. (2002)).

Uses of Variant Proteins

The variant proteins of the present invention can be used in a variety of ways, including but not limited to, in assays to determine the biological activity of a variant protein, such as in a panel of multiple proteins for high-throughput screening; to raise antibodies or to elicit another type of immune response; as a reagent (including the labeled reagent) in assays designed to quantitatively determine levels of the variant protein (or its binding partner) in biological fluids; as a marker for cells or tissues in which it is preferentially expressed (either constitutively or at a particular stage of tissue differentiation or development or in a disease state); as a target for screening for a therapeutic agent; and as a direct therapeutic agent to be administered into a human subject. Any of the variant proteins disclosed herein may be developed into reagent grade or kit format for commercialization as research products. Methods for performing the uses listed above are well known to those skilled in the art (see, e.g., Molecular Cloning: A Laboratory Manual, Cold Spring Harbor Laboratory Press, Sambrook and Russell, 2000, and Methods in Enzymology: Guide to Molecular Cloning Techniques, Academic Press, Berger, S. L. and A. R. Kimmel eds., 1987).

In a specific embodiment of the invention, the methods of the present invention include detection of one or more variant proteins disclosed herein. Variant proteins are disclosed in Table 1 and in the Sequence Listing as SEQ ID NOS: 84-166. Detection of such proteins can be accomplished using, for example, antibodies, small molecule compounds, aptamers, ligands/substrates, other proteins or protein fragments, or other protein-binding agents. Preferably, protein detection agents are specific for a variant protein of the present invention and can therefore discriminate between a variant protein of the present invention and the wild-type protein or another variant form. This can generally be accomplished by, for example, selecting or designing detection agents that bind to the region of a protein that differs between the variant and wild-type protein, such as a region of a protein that contains one or more amino acid substitutions that is/are encoded by a non-synonymous cSNP of the present invention, or a region of a protein that follows a nonsense mutation-type SNP that creates a stop codon thereby leading to a shorter polypeptide, or a region of a protein that follows a read-through mutation-type SNP that destroys a stop codon thereby leading to a longer polypeptide in which a portion of the polypeptide is present in one version of the polypeptide but not the other.

In another specific aspect of the invention, the variant proteins of the present invention are used as targets for diagnosing rheumatoid arthritis or for determining predisposition to rheumatoid arthritis in a human. Accordingly, the invention provides methods for detecting the presence of, or levels of, one or more variant proteins of the present invention in a cell, tissue, or organism. Such methods typically involve contacting a test sample with an agent (e.g., an antibody, small molecule compound, or peptide) capable of interacting with the variant protein such that specific binding of the agent to the variant protein can be detected. Such an assay can be provided in a single detection format or a multi-detection format such as an array, for example, an antibody or aptamer array (arrays for protein detection may also be referred to as "protein chips"). The variant protein of interest can be isolated from a test sample and assayed for the presence of a variant amino acid sequence encoded by one or more SNPs disclosed by the present invention. The SNPs may cause changes to the protein and the corresponding protein function/activity, such as through non-synonymous substitutions in protein coding regions that can lead to amino acid substitutions, deletions, insertions, and/or rearrangements; formation or destruction of stop codons; or alteration of control elements such as promoters. SNPs may also cause inappropriate post-translational modifications.

One preferred agent for detecting a variant protein in a sample is an antibody capable of selectively binding to a variant form of the protein (antibodies are described in greater detail in the next section). Such samples include, for example, tissues, cells, and biological fluids isolated from a subject, as well as tissues, cells and fluids present within a subject.

In vitro methods for detection of the variant proteins associated with rheumatoid arthritis that are disclosed herein and fragments thereof include, but are not limited to, enzyme linked immunosorbent assays (ELISAs), radioimmunoassays (RIA), Western blots, immunoprecipitations, immunofluorescence, and protein arrays/chips (e.g., arrays of antibodies or aptamers). For further information regarding immunoassays and related protein detection methods, see *Current Protocols in Immunology*, John Wiley & Sons, N.Y., and Hage, "Immunoassays", *Anal Chem.* 1999 Jun. 15; 71(12):294R-304R.

Additional analytic methods of detecting amino acid variants include, but are not limited to, altered electrophoretic mobility, altered tryptic peptide digest, altered protein activity in cell-based or cell-free assay, alteration in ligand or antibody-binding pattern, altered isoelectric point, and direct amino acid sequencing.

Alternatively, variant proteins can be detected in vivo in a subject by introducing into the subject a labeled antibody (or other type of detection reagent) specific for a variant protein. For example, the antibody can be labeled with a radioactive marker whose presence and location in a subject can be detected by standard imaging techniques.

Other uses of the variant peptides of the present invention are based on the class or action of the protein. For example, proteins isolated from humans and their mammalian orthologs serve as targets for identifying agents (e.g., small molecule drugs or antibodies) for use in therapeutic applications, particularly for modulating a biological or pathological response in a cell or tissue that expresses the protein. Pharmaceutical agents can be developed that modulate protein activity.

As an alternative to modulating gene expression, therapeutic compounds can be developed that modulate protein function. For example, many SNPs disclosed herein affect the amino acid sequence of the encoded protein (e.g., non-synonymous cSNPs and nonsense mutation-type SNPs). Such alterations in the encoded amino acid sequence may affect protein function, particularly if such amino acid sequence variations occur in functional protein domains, such as catalytic domains, ATP-binding domains, or ligand/substrate binding domains. It is well established in the art that variant proteins having amino acid sequence variations in functional domains can cause or influence pathological conditions. In such instances, compounds (e.g., small molecule drugs or antibodies) can be developed that target the variant protein and modulate (e.g., up- or down-regulate) protein function/activity.

The therapeutic methods of the present invention further include methods that target one or more variant proteins of the present invention. Variant proteins can be targeted using, for example, small molecule compounds, antibodies, aptamers, ligands/substrates, other proteins, or other protein-binding agents. Additionally, the skilled artisan will recognize that the novel protein variants (and polymorphic nucleic acid molecules) disclosed in Table 1 may themselves be directly used as therapeutic agents by acting as competitive inhibitors of corresponding art-known proteins (or nucleic acid molecules such as mRNA molecules).

The variant proteins of the present invention are particularly useful in drug screening assays, in cell-based or cell-free systems. Cell-based systems can utilize cells that naturally express the protein, a biopsy specimen, or cell cultures. In one embodiment, cell-based assays involve recombinant host cells expressing the variant protein. Cell-free assays can be used to detect the ability of a compound to directly bind to a variant protein or to the corresponding SNP-containing nucleic acid fragment that encodes the variant protein.

A variant protein of the present invention, as well as appropriate fragments thereof, can be used in high-throughput screening assays to test candidate compounds for the ability to bind and/or modulate the activity of the variant protein. These candidate compounds can be further screened against a protein having normal function (e.g., a wild-type/non-variant protein) to further determine the effect of the compound on the protein activity. Furthermore, these compounds can be tested in animal or invertebrate systems to determine in vivo activity/effectiveness. Compounds can be identified that activate (agonists) or inactivate (antagonists) the variant protein, and different compounds can be identified that cause various degrees of activation or inactivation of the variant-protein.

Further, the variant proteins can be used to screen a compound for the ability to stimulate or inhibit interaction between the variant protein and a target molecule that normally interacts with the protein. The target can be a ligand, a substrate or a binding partner that the protein normally interacts with (for example, epinephrine or norepinephrine). Such assays typically include the steps of combining the variant protein with a candidate compound under conditions that allow the variant protein, or fragment thereof, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., *Nature* 354:82-84 (1991); Houghten et al., *Nature* 354:84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., *Cell* 72:767-778 (1993)); 3) antibodies (e.g., polyclonal, monoclonal, humanized, anti-idiotypic, chimeric, and single chain antibodies as well as Fab, F(ab72, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art. Binding and/or activating compounds can also be screened by using chimeric variant proteins in which an amino terminal extracellular domain or parts thereof, an entire transmembrane domain or subregions, and/or the carboxyl terminal intracellular domain or parts thereof, can be replaced by heterologous domains or subregions. For example, a substrate-binding region can be used that interacts with a different substrate than that which is normally recognized by a variant protein. Accordingly, a different set of signal transduction components is available as an end-point assay for activation. This allows for assays to be performed in other than the specific host cell from which the variant protein is derived.

The variant proteins are also useful in competition binding assays in methods designed to discover compounds that interact with the variant protein. Thus, a compound can be exposed to a variant protein under conditions that allow the compound to bind or to otherwise interact with the variant protein. A binding partner, such as ligand, that normally interacts with the variant protein is also added to the mixture. If the test compound interacts with the variant protein or its binding partner, it decreases the amount of complex formed or activity from the variant protein. This type of assay is particularly useful in screening for compounds that interact with specific regions of the variant protein (Hodgson, *Bio/technology,* 1992, Sep. 10(9), 973-80).

To perform cell-free drug screening assays, it is sometimes desirable to immobilize either the variant protein or a fragment thereof, or its target molecule, to facilitate separation of complexes from uncomplexed forms of one or both of the proteins, as well as to accommodate automation of the assay. Any method for immobilizing proteins on matrices can be used in drug screening assays. In one embodiment, a fusion protein containing an added domain allows the protein to be bound to a matrix. For example, glutathione-S=transferase/$^{125}$I fusion proteins can be adsorbed onto glutathione sepharose beads (Sigma. Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads can be washed to remove any unbound label, and the matrix immobilized and radiolabel determined directly, or in the supernatant after the complexes are dissociated. Alternatively, the complexes can be dissociated from the matrix, separated by SDS-PAGE, and the level of bound material found in the bead fraction quantitated from the gel using standard electrophoretic techniques.

Either the variant protein or its target molecule can be immobilized utilizing conjugation of biotin and streptavidin. Alternatively, antibodies reactive with the variant protein but which do not interfere with binding of the variant protein to its target molecule can be derivatized to the wells of the plate, and the variant protein trapped in the wells by antibody conjugation. Preparations of the target molecule and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, and enzyme-linked assays that rely on detecting an enzymatic activity associated with the target molecule.

Modulators of variant protein activity identified according to these drug screening assays can be used to treat a subject with a disorder mediated by the protein pathway, such as rheumatoid arthritis. These methods of treatment typically include the steps of administering the modulators of protein activity in a pharmaceutical composition to a subject in need of such treatment.

The variant proteins, or fragments thereof, disclosed herein can themselves be directly used to treat a disorder characterized by an absence of, inappropriate, or unwanted expression or activity of the variant protein. Accordingly, methods for treatment include the use of a variant protein disclosed herein or fragments thereof.

In yet another aspect of the invention, variant proteins can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) *Oncogene* 8:1693-1696; and Brent WO94/10300) to identify other proteins that bind to or interact with the variant protein and are involved in variant protein activity. Such variant protein-binding proteins are also likely to be involved in the propagation of signals by the variant proteins or variant protein targets as, for example, elements of a protein-mediated signaling pathway. Alternatively, such variant protein-binding proteins are inhibitors of the variant protein. The two-hybrid system is based on the modular nature of most transcription factors, which typically consist of separable DNA-binding and activation domains. Briefly, the assay typically utilizes two different DNA constructs. In one construct, the gene that codes for a variant protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a variant protein-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected, and cell colonies containing the functional transcription factor can be isolated and used to obtain the cloned gene that encodes the protein that interacts with the variant protein.

Antibodies Directed to Variant Proteins

The present invention also provides antibodies that selectively bind to the variant proteins disclosed herein and fragments thereof. Such antibodies may be used to quantitatively or qualitatively detect the variant proteins of the present invention. As used herein, an antibody selectively binds a target variant protein when it binds the variant protein and does not significantly bind to non-variant proteins, i.e., the antibody does not significantly bind to normal, wild-type, or art-known proteins that do not contain a variant amino acid sequence due to one or more SNPs of the present invention (variant amino acid sequences may be due to, for example, nonsynonymous cSNPs, nonsense SNPs that create a stop codon, thereby causing a truncation of a polypeptide or SNPs that cause read-through mutations resulting in an extension of a polypeptide).

As used herein, an antibody is defined in terms consistent with that recognized in the art: they are multi-subunit proteins produced by an organism in response to an antigen challenge. The antibodies of the present invention include both monoclonal antibodies and polyclonal antibodies, as well as antigen-reactive proteolytic fragments of such antibodies, such as Fab, F(ab)'$_2$, and Fv fragments. In addition, an antibody of the present invention further includes any of a variety of engineered antigen-binding molecules such as a chimeric antibody (U.S. Pat. Nos. 4,816,567 and 4,816,397; Morrison et al., *Proc. Natl. Acad. Sci. USA,* 81:6851, 1984; Neuberger et al., *Nature* 312:604, 1984), a humanized antibody (U.S. Pat. Nos. 5,693,762; 5,585,089; and 5,565,332), a single-chain Fv (U.S. Pat. No. 4,946,778; Ward et al., *Nature* 334:544, 1989), a bispecific antibody with two binding specificities (Segal et al., *J. Immunol. Methods* 248:1, 2001; Carter, *J. Immunol. Methods* 248:7, 2001), a diabody, a triabody, and a tetrabody (Todorovska et al., *J. Immunol. Methods,* 248:47, 2001), as well as a Fab conjugate (dimer or trimer), and a minibody.

Many methods are known in the art for generating and/or identifying antibodies to a given target antigen (Harlow, Antibodies, Cold Spring Harbor Press, (1989)). In general, an isolated peptide (e.g., a variant protein of the present invention) is used as an immunogen and is administered to a mammalian organism, such as a rat, rabbit, hamster or mouse. Either a full-length protein, an antigenic peptide fragment (e.g., a peptide fragment containing a region that varies between a variant protein and a corresponding wild-type protein), or a fusion protein can be used. A protein used as an immunogen may be naturally-occurring, synthetic or recombinantly produced, and may be administered in combination with an adjuvant, including but not limited to, Freund's (complete and incomplete), mineral gels such as aluminum hydroxide, surface active substance such as lysolecithin, pluronic polyols, polyanions, peptides, oil emulsions, keyhole limpet hemocyanin, dinitrophenol, and the like.

Monoclonal antibodies can be produced by hybridoma technology (Kohler and Milstein, *Nature,* 256:495, 1975), which immortalizes cells secreting a specific monoclonal antibody. The immortalized cell lines can be created in vitro by fusing two different cell types, typically lymphocytes, and tumor cells. The hybridoma cells may be cultivated in vitro or in vivo. Additionally, fully human antibodies can be generated by transgenic animals (He et al., *J. Immunol.,* 169:595, 2002). Fd phage and Fd phagemid technologies may be used to generate and select recombinant antibodies in vitro (Hoogenboom and Chames, *Immunol. Today* 21:371, 2000; Liu et al., *J. Mol. Biol.* 315:1063, 2002). The complementarity-determining regions of an antibody can be identified, and synthetic peptides corresponding to such regions may be used to mediate antigen binding (U.S. Pat. No. 5,637,677).

Antibodies are preferably prepared against regions or discrete fragments of a variant protein containing a variant amino acid sequence as compared to the corresponding wild-type protein (e.g., a region of a variant protein that includes an amino acid encoded by a nonsynonymous cSNP, a region affected by truncation caused by a nonsense SNP that creates a stop codon, or a region resulting from the destruction of a stop codon due to read-through mutation caused by a SNP). Furthermore, preferred regions will include those involved in function/activity and/or protein/binding partner interaction. Such fragments can be selected on a physical property, such as fragments corresponding to regions that are located on the surface of the protein, e.g., hydrophilic regions, or can be selected based on sequence uniqueness, or based on the position of the variant amino acid residue(s) encoded by the SNPs provided by the present invention. An antigenic fragment will typically comprise at least about 8-10 contiguous amino acid residues in which at least one of the amino acid residues is an amino acid affected by a SNP disclosed herein. The antigenic peptide can comprise, however, at least 12, 14, 16, 20, 25, 50, 100 (or any other number in-between) or more amino acid residues, provided that at least one amino acid is affected by a SNP disclosed herein.

Detection of an antibody of the present invention can be facilitated by coupling (i.e., physically linking) the antibody or an antigen-reactive fragment thereof to a detectable substance. Detectable substances include, but are not limited to, various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

Antibodies, particularly the use of antibodies as therapeutic agents, are reviewed in: Morgan, "Antibody therapy for Alzheimer's disease", *Expert Rev Vaccines.* 2003 February; 2(1):53-9; Ross et al., "Anticancer antibodies", *Am J Clin Pathol.* 2003 April; 119(4):472-85; Goldenberg, "Advancing role of radiolabeled antibodies in the therapy of cancer", *Cancer Immunol Immunother.* 2003 May; 52(5):281-96. Epub 2003 Mar. 11; Ross et al., "Antibody-based therapeutics in oncology", *Expert Rev Anticancer Ther.* 2003 February; 3(1):107-21; Cao et al., "Bispecific antibody conjugates in therapeutics", *Adv Drug Deliv Rev.* 2003 Feb. 10; 55(2):171-97; von Mehren et al., "Monoclonal antibody therapy for cancer", *Annu Rev Med.* 2003; 54:343-69. Epub 2001 Dec. 3; Hudson et al., "Engineered antibodies", *Nat Med.* 2003 January; 9(1):129-34; Brekke et al., "Therapeutic antibodies for human diseases at the dawn of the twenty-first century", *Nat Rev Drug Discov.* 2003 January; 2(1):52-62 (Erratum in: *Nat Rev Drug Discov.* 2003 March; 2(3):240); Houdebine, "Antibody manufacture in transgenic animals and comparisons with other systems", *Curr Opin Biotechnol.* 2002 December; 13(6):625-9; Andreakos et al., "Monoclonal antibodies in immune and inflammatory diseases", *Curr Opin Biotechnol.* 2002 December; 13(6):615-20; Kellermann et al., "Antibody discovery: the use of transgenic mice to generate human monoclonal antibodies for therapeutics"; *Curr Opin Biotechnol.* 2002 December; 13(6):593-7; Pini et al., "Phage display and colony filter screening for high-throughput selection of antibody libraries"; *Comb Chem High Throughput Screen.* 2002 November; 5(7):503-10; Batra et al., "Pharmacokinetics and biodistribution of genetically engineered antibodies", *Curr Opin Biotechnol.* 2002 December; 13(6):603-8; and Tangri et al., "Rationally engineered proteins or antibodies with absent or reduced immunogenicity", *Curr Med Chem.* 2002 December; 9(24):2191-9.

Uses of Antibodies

Antibodies can be used to isolate the variant proteins of the present invention from a natural cell source or from recombinant host cells by standard techniques, such as affinity chromatography or immunoprecipitation. In addition, antibodies are useful for detecting the presence of a variant protein of the present invention in cells or tissues to determine the pattern of expression of the variant protein among various tissues in an organism and over the course of normal development or disease progression. Further, antibodies can be used to detect variant protein in situ, in vitro, in a bodily fluid, or in a cell lysate or supernatant in order to evaluate the amount and pattern of expression. Also, antibodies can be used to assess abnormal tissue distribution, abnormal expression during development, or expression in an abnormal condition, such as rheumatoid arthritis. Additionally, antibody detection of circulating fragments of the full-length variant protein can be used to identify turnover.

Antibodies to the variant proteins of the present invention are also useful in pharmacogenomic analysis. Thus, antibodies against variant proteins encoded by alternative SNP alleles can be used to identify individuals that require modified treatment modalities.

Further, antibodies can be used to assess expression of the variant protein in disease states such as in active stages of the disease or in an individual with a predisposition to a disease related to the protein's function, particularly rheumatoid arthritis. Antibodies specific for a variant protein encoded by a SNP-containing nucleic acid molecule of the present invention can be used to assay for the presence of the variant protein, such as to screen for predisposition to rheumatoid arthritis as indicated by the presence of the variant protein.

Antibodies are also useful as diagnostic tools for evaluating the variant proteins in conjunction with analysis by electrophoretic mobility, isoelectric point, tryptic peptide digest, and other physical assays well known in the art.

Antibodies are also useful for tissue typing. Thus, where a specific variant protein has been correlated with expression in a specific tissue, antibodies that are specific for this protein can be used to identify a tissue type.

Antibodies can also be used to assess aberrant subcellular localization of a variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of a variant protein, antibodies directed against the variant protein or relevant fragments can be used to monitor therapeutic efficacy.

The antibodies are also useful for inhibiting variant protein function, for example, by blocking the binding of a variant protein to a binding partner. These uses can also be applied in a therapeutic context in which treatment involves inhibiting a variant protein's function. An antibody can be used, for example, to block or competitively inhibit binding, thus modulating (agonizing or antagonizing) the activity of a variant protein. Antibodies can be prepared against specific variant protein fragments containing sites required for function or against an intact variant protein that is associated with a cell or cell membrane. For in vivo administration, an antibody may be linked with an additional therapeutic payload such as a radionuclide, an enzyme, an immunogenic epitope, or a cytotoxic agent. Suitable cytotoxic agents include, but are not limited to, bacterial toxin such as diphtheria, and plant toxin such as ricin. The in vivo half-life of an antibody or a fragment thereof may be lengthened by pegylation through conjugation to polyethylene glycol (Leong et al., *Cytokine* 16:106, 2001).

The invention also encompasses kits for using antibodies, such as kits for detecting the presence of a variant protein in a test sample. An exemplary kit can comprise antibodies such as a labeled or labelable antibody and a compound or agent for detecting variant proteins in a biological sample; means for determining the amount, or presence/absence of variant protein in the sample; means for comparing the amount of variant protein in the sample with a standard; and instructions for use.

Vectors and Host Cells

The present invention also provides vectors containing the SNP-containing nucleic acid molecules described herein. The term "vector" refers to a vehicle, preferably a nucleic acid molecule, which can transport a SNP-containing nucleic acid molecule. When the vector is a nucleic acid molecule, the SNP-containing nucleic acid molecule can be covalently linked to the vector nucleic acid. Such vectors include, but are not limited to, a plasmid, single or double stranded phage, a single or double stranded RNA or DNA viral vector, or artificial chromosome, such as a BAC, PAC, YAC, or MAC.

A vector can be maintained in a host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in prokaryotic or eukaryotic cells or in both (shuttle vectors).

Expression vectors typically contain cis-acting regulatory regions that are operably linked in the vector to the SNP-containing nucleic acid molecules such that transcription of the SNP-containing nucleic acid molecules is allowed in a host cell. The SNP-containing nucleic acid molecules can also be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region, a ribosome-binding site for translation. Other regulatory control elements for expression include initiation and termination codons as well as polyadenylation signals. A person of ordinary skill in the art would be aware of the numerous regulatory sequences that are useful in expression vectors (see, e.g., Sambrook and Russell, 2000, Molecular Cloning: A Laboratory Manual, Cold Spring Harbor Laboratory Press, Cold Spring Harbor, N.Y.).

A variety of expression vectors can be used to express a SNP-containing nucleic acid molecule. Such vectors include chromosomal, episomal, and virus-derived vectors, for example, vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors can also be derived from combinations of these sources such as those derived from plasmid and bacteriophage genetic elements, e.g., cosmids and phagemids. Appropriate cloning and expression vectors for prokaryotic and eukaryotic hosts are described in Sambrook and Russell, 2000, Molecular Cloning: A Laboratory Manual, Cold Spring Harbor Laboratory Press, Cold Spring Harbor, N.Y.

The regulatory sequence in a vector may provide constitutive expression in one or more host cells (e.g., tissue specific expression) or may provide for inducible expression in one or more cell types such as by temperature, nutrient additive, or exogenous factor, e.g., a hormone or other ligand. A variety of vectors that provide constitutive or inducible expression of a nucleic acid sequence in prokaryotic and eukaryotic host cells are well known to those of ordinary skill in the art.

A SNP-containing nucleic acid molecule can be inserted into the vector by methodology well-known in the art. Generally, the SNP-containing nucleic acid molecule that will ultimately be expressed is joined to an expression vector by cleaving the SNP-containing nucleic acid molecule and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial host cells include, but are not limited to, *E. coli, Streptomyces*, and *Salmonella typhimurium*. Eukaryotic host cells include, but are not limited to, yeast, insect cells such as *Drosophila*, animal cells such as COS and CHO cells, and plant cells.

As described herein, it may be desirable to express the variant peptide as a fusion protein. Accordingly, the invention provides fusion vectors that allow for the production of the variant peptides. Fusion vectors can, for example, increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes suitable for such use include, but are not limited to, factor Xa, thrombin, and enterokinase. Typical fusion expression vectors include pGEX (Smith et al., *Gene* 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., *Gene* 69:301-315 (1988)) and pET 11d (Studier et al., *Gene Expression Technology: Methods in Enzymology* 185:60-89 (1990)).

Recombinant protein expression can be maximized in a bacterial host by providing a genetic background wherein the host cell has an impaired capacity to proteolytically cleave the recombinant protein (Gottesman, S., *Gene Expression Technology: Methods in Enzymology* 185, Academic Press, San Diego, Calif. (1990) 119-128). Alternatively, the sequence of the SNP-containing nucleic acid molecule of interest can be altered to provide preferential codon usage for a specific host cell, for example, *E. coli* (Wada et al., *Nucleic Acids Res.* 20:2111-2118 (1992)).

The SNP-containing nucleic acid molecules can also be expressed by expression vectors that are operative in yeast. Examples of vectors for expression in yeast (e.g., *S. cerevisiae*) include pYepSec1 (Baldari, et al., *EMBO J.* 6:229-234 (1987)), pMFa (Kurjan et al., Cell 30:933-943 (1982)), pJRY88 (Schultz et al., *Gene* 54:113-123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol. Cell Biol.* 3:2156-2165 (1983)) and the pVL series (Lucklow et al., *Virology* 170:31-39 (1989)).

In certain embodiments of the invention, the SNP-containing nucleic acid molecules described herein are expressed in mammalian cells using mammalian expression vectors. Examples of mammalian expression vectors include pCDM8 (Seed, B. *Nature* 329:840 (1987)) and pMT2PC (Kaufman et al., *EMBO J.* 6:187-195 (1987)).

The invention also encompasses vectors in which the SNP-containing nucleic acid molecules described herein are cloned into the vector in reverse orientation, but operably linked to a regulatory sequence that permits transcription of antisense RNA. Thus, an antisense transcript can be produced to the SNP-containing nucleic acid sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include, for example, prokaryotic cells, lower eukaryotic cells such as yeast, other eukaryotic cells such as insect cells, and higher eukaryotic cells such as mammalian cells.

The recombinant host cells can be prepared by introducing the vector constructs described herein into the cells by techniques readily available to persons of ordinary skill in the art. These include, but are not limited to, calcium phosphate transfection, DEAE-dextran-mediated transfection, cationic lipid-mediated transfection, electroporation, transduction, infection, lipofection, and other techniques such as those described in Sambrook and Russell, 2000, Molecular Cloning: A Laboratory Manual, Cold Spring Harbor Laboratory, Cold Spring Harbor Laboratory Press, Cold Spring Harbor, N.Y.).

Host cells can contain more than one vector: Thus, different SNP-containing nucleotide sequences can be introduced in different vectors into the same cell. Similarly, the SNP-containing nucleic acid molecules can be introduced either alone or with other nucleic acid molecules that are not related to the SNP-containing nucleic acid molecules, such as those providing trans-acting factors for expression vectors. When more than one vector is introduced into a cell, the vectors can be introduced independently, co-introduced, or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication can occur in host cells that provide functions that complement the defects.

Vectors generally include selectable markers that enable the selection of the subpopulation of cells that contain the recombinant vector constructs. The marker can be inserted in the same vector that contains the SNP-containing nucleic acid molecules described herein or may be in a separate vector. Markers include, for example, tetracycline or ampicillin-resistance genes for prokaryotic host cells, and dihydrofolate reductase or neomycin resistance genes for eukaryotic host cells. However, any marker that provides selection for a phenotypic trait can be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

Where secretion of the variant protein is desired, which is difficult to achieve with multi-transmembrane domain containing proteins such as G-protein-coupled receptors (GPCRs), appropriate secretion signals can be incorporated into the vector. The signal sequence can be endogenous to the peptides or heterologous to these peptides.

Where the variant protein is not secreted into the medium, the protein can be isolated from the host cell by standard disruption procedures, including freeze/thaw, sonication, mechanical disruption, use of lysing agents, and the like. The variant protein can then be recovered and purified by well-known purification methods including, for example, ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that, depending upon the host cell in which recombinant production of the variant proteins described herein occurs, they can have various glycosylation patterns, or may be non-glycosylated, as when produced in bacteria. In addition, the variant proteins may include an initial modified methionine in some cases as a result of a host-mediated process.

For further information regarding vectors and host cells, see *Current Protocols in Molecular Biology*, John Wiley & Sons, N.Y.

Uses of Vectors and Host Cells, and Transgenic Animals

Recombinant host cells that express the variant proteins described herein have a variety of uses. For example, the cells are useful for producing a variant protein that can be further purified into a preparation of desired amounts of the variant protein or fragments thereof. Thus, host cells containing expression vectors are useful for variant protein production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function. Such an ability of a compound to modulate variant protein function may not be apparent from assays of the compound on the native/wild-type protein, or from cell-free assays of the compound. Recombinant host cells are also useful for assaying functional alterations in the variant proteins as compared with a known function.

Genetically-engineered host cells can be further used to produce non-human transgenic animals. A transgenic animal is preferably a non-human mammal, for example, a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more of its cell types or tissues. Such animals are useful for studying the function of a variant protein in vivo, and identifying and evaluating modulators of variant protein activity. Other examples of transgenic animals include, but are not limited to, non-human primates, sheep, dogs, cows, goats, chickens, and amphibians. Transgenic non-human mammals such as cows and goats can be used to produce variant proteins which can be secreted in the animal's milk and then recovered.

A transgenic animal can be produced by introducing a SNP-containing nucleic acid molecule into the male pronuclei of a fertilized oocyte, e.g., by microinjection or retroviral infection, and allowing the oocyte to develop in a pseudopregnant female foster animal. Any nucleic acid molecules that contain one or more SNPs of the present invention can potentially be introduced as a transgene into the genome of a non-human animal.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the variant protein in particular cells or tissues.

Methods for generating transgenic animals via embryo manipulation and microinjection, particularly animals such as mice, have become conventional in the art and are described in, for example, U.S. Pat. Nos. 4,736,866 and 4,870,009, both by Leder et al., U.S. Pat. No. 4,873,191 by Wagner et al., and in Hogan, B., *Manipulating the Mouse Embryo*, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes a non-human animal in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1 (Lakso et al. *PNAS* 89:6232-6236 (1992)). Another example of a recombinase system is the FLP recombinase system of *S. cerevisiae* (O'Gorman et al. *Science* 251: 1351-1355 (1991)). If a cre/loxP recombinase system is used to regulate expression of the transgene, animals containing transgenes encoding both the Cre recombinase and a selected protein are generally needed. Such animals can be provided through the construction of "double" transgenic animals, e.g., by mating two transgenic animals, one containing a transgene encoding a selected variant protein and the other containing a transgene encoding a recombinase.

Clones of the non-human transgenic animals described herein can also be produced according to the methods described in, for example, Wilmut, I. et al. *Nature* 385:810-813 (1997) and PCT International Publication Nos. WO 97/07668 and WO 97/07669. In brief, a cell (e.g., a somatic cell) from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell (e.g., a somatic cell) is isolated.

Transgenic animals containing recombinant cells that express the variant proteins described herein are useful for conducting the assays described herein in an in vivo context.

Accordingly, the various physiological factors that are present in vivo and that could influence ligand or substrate binding, variant protein activation, signal transduction, or other processes or interactions, may not be evident from in vitro cell-free or cell-based assays. Thus, non-human transgenic animals of the present invention may be used to assay in vivo variant protein function as well as the activities of a therapeutic agent or compound that modulates variant protein function/activity or expression. Such animals are also suitable for assessing the effects of null mutations (i.e., mutations that substantially or completely eliminate one or more variant protein functions).

For further information regarding transgenic animals, see Houdebine, "Antibody manufacture in transgenic animals and comparisons with other systems", *Curr Opin Biotechnol.* 2002 December; 13(6):625-9; Petters et al., "Transgenic animals as models for human disease", *Transgenic Res.* 2000; 9(4-5):347-51; discussion 345-6; Wolf et al., "Use of transgenic animals in understanding molecular mechanisms of toxicity", *J Pharm Pharmacol.* 1998 June; 50(6):567-74; Echelard, "Recombinant protein production in transgenic animals", *Curr Opin Biotechnol.* 1996 October; 7(5):536-40; Houdebine, "Transgenic animal bioreactors", *Transgenic Res.* 2000; 9(4-5):305-20; Pirity et al., "Embryonic stem cells, creating transgenic animals", *Methods Cell Biol.* 1998; 57:279-93; and Robl et al., "Artificial chromosome vectors and expression of complex proteins in transgenic animals", *Theriogenology.* 2003 Jan. 1; 59(1):107-13.

Computer-Related Embodiments

The SNPs provided in the present invention may be "provided" in a variety of mediums to facilitate use thereof. As used in this section, "provided" refers to a manufacture, other than an isolated nucleic acid molecule, that contains SNP information of the present invention. Such a manufacture provides the SNP information in a form that allows a skilled artisan to examine the manufacture using means not directly applicable to examining the SNPs or a subset thereof as they exist in nature or in purified form. The SNP information that may be provided in such a form includes any of the SNP information provided by the present invention such as, for example, polymorphic nucleic acid and/or amino acid sequence information such as SEQ ID NOS:1-83, SEQ ID NOS:84-166, SEQ ID NOS:1662-1717, SEQ ID NOS:167-1661, and SEQ ID NOS:1718-6607; information about observed SNP alleles, alternative codons, populations, allele frequencies, SNP types, and/or affected proteins; or any other information provided by the present invention in Tables 1-2 and/or the Sequence Listing.

In one application of this embodiment, the SNPs of the present invention can be recorded on a computer readable medium. As used herein, "computer readable medium" refers to any medium that can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable media can be used to create a manufacture comprising computer readable medium having recorded thereon a nucleotide sequence of the present invention. One such medium is provided with the present application, namely, the present application contains computer readable medium (CD-R) that has nucleic acid sequences (and encoded protein sequences) containing SNPs provided/recorded thereon in ASCII text format in a Sequence Listing along with accompanying Tables that contain detailed SNP and sequence information (transcript sequences are provided as SEQ ID NOS:1-83, protein sequences are provided as SEQ ID NOS:84-166, genomic sequences are provided as SEQ ID NOS:1662-1717, transcript-based context sequences are provided as SEQ ID NOS: 167-1661, and genomic-based context sequences are provided as SEQ ID NOS:1718-6607).

As used herein, "recorded" refers to a process for storing information on computer readable medium. A skilled artisan can readily adopt any of the presently known methods for recording information on computer readable medium to generate manufactures comprising the SNP information of the present invention.

A variety of data storage structures are available to a skilled artisan for creating a computer readable medium having recorded thereon a nucleotide or amino acid sequence of the present invention. The choice of the data storage structure will generally be based on the means chosen to access the stored information. In addition, a variety of data processor programs and formats can be used to store the nucleotide/amino acid sequence information of the present invention on computer readable medium. For example, the sequence information can be represented in a word processing text file, formatted in commercially-available software such as WordPerfect and Microsoft Word, represented in the form of an ASCII file, or stored in a database application, such as OB2, Sybase, Oracle, or the like. A skilled artisan can readily adapt any number of data processor structuring formats (e.g., text file or database) in order to obtain computer readable medium having recorded thereon the SNP information of the present invention.

By providing the SNPs of the present invention in computer readable form, a skilled artisan can routinely access the SNP information for a variety of purposes. Computer software is publicly available which allows a skilled artisan to access sequence information provided in a computer readable medium. Examples of publicly available computer software include BLAST (Altschul et at, *J. Mol. Biol.* 215:403-410 (1990)) and BLAZE (Brutlag et at, *Comp. Chem.* 17:203-207 (1993)) search algorithms.

The present invention further provides systems, particularly computer-based systems, which contain the SNP information described herein. Such systems may be designed to store and/or analyze information on, for example, a large number of SNP positions, or information on SNP genotypes from a large number of individuals. The SNP information of the present invention represents a valuable information source. The SNP information of the present invention stored/analyzed in a computer-based system may be used for such computer-intensive applications as determining or analyzing SNP allele frequencies in a population, mapping disease genes, genotype-phenotype association studies, grouping SNPs into haplotypes, correlating SNP haplotypes with response to particular drugs, or for various other bioinformatic, pharmacogenomic, drug development, or human identification/forensic applications.

As used herein, "a computer-based system" refers to the hardware means, software means, and data storage means used to analyze the SNP information of the present invention. The minimum hardware means of the computer-based systems of the present invention typically comprises a central processing unit (CPU), input means, output means, and data storage means. A skilled artisan can readily appreciate that any one of the currently available computer-based systems are suitable for use in the present invention. Such a system can be changed into a system of the present invention by utilizing the SNP information provided on the CD-R, or a subset thereof, without any experimentation.

As stated above, the computer-based systems of the present invention comprise a data storage means having stored therein SNPs of the present invention and the necessary hardware means and software means for supporting and implementing a search means. As used herein, "data storage means" refers to memory which can store SNP information of the present invention, or a memory access means which can access manufactures having recorded thereon the SNP information of the present invention.

As used herein, "search means" refers to one or more programs or algorithms that are implemented on the computer-based system to identify or analyze SNPs in a target sequence based on the SNP information stored within the data storage means. Search means can be used to determine which nucleotide is present at a particular SNP position in the target sequence. As used herein, a "target sequence" can be any DNA sequence containing the SNP position(s) to be searched or queried.

As used herein, "a target structural motif," or "target motif," refers to any rationally selected sequence or combination of sequences containing a SNP position in which the sequence(s) is chosen based on a three-dimensional configuration that is formed upon the folding of the target motif. There are a variety of target motifs known in the art. Protein target motifs include, but are not limited to, enzymatic active sites and signal sequences. Nucleic acid target motifs include, but are not limited to, promoter sequences, hairpin structures, and inducible expression elements (protein binding sequences).

A variety of structural formats for the input and output means can be used to input and output the information in the computer-based systems of the present invention. An exemplary format for an output means is a display that depicts the presence or absence of specified nucleotides (alleles) at particular SNP positions of interest. Such presentation can provide a rapid, binary scoring system for many SNPs simultaneously.

One exemplary embodiment of a computer-based system comprising SNP information of the present invention is provided in FIG. 1. FIG. 1 provides a block diagram of a computer system 102 that can be used to implement the present invention. The computer system 102 includes a processor 106 connected to a bus 104. Also connected to the bus 104 are a main memory 108 (preferably implemented as random access memory, RAM) and a variety of secondary storage devices 110, such as a hard drive 112 and a removable medium storage device 114. The removable medium storage device 114 may represent, for example, a floppy disk drive, a CD-ROM drive, a magnetic tape drive, etc. A removable storage medium 116 (such as a floppy disk, a compact disk, a magnetic tape, etc.) containing control logic and/or data recorded therein may be inserted into the removable medium storage device 114. The computer system 102 includes appropriate software for reading the control logic and/or the data from the removable storage medium 116 once inserted in the removable medium storage device 114.

The SNP information of the present invention may be stored in a well-known manner in the main memory 108, any of the secondary storage devices 110, and/or a removable storage medium 116. Software for accessing and processing the SNP information (such as SNP scoring tools, search tools, comparing tools, etc.) preferably resides in main memory 108 during execution.

EXAMPLES

Statistical Analysis of SNP Allele Association with Rheumatoid Arthritis

The association of SNP alleles in the human genome with rheumatoid arthritis (RA) was tested using genomic DNA from individuals in two independently collected case-control sample sets, a "Discovery Set" and a "Replication Set".

The Discovery Set consisted of 475 unrelated cases with rheumatoid arthritis and 475 controls (one control matched to each patient on age, sex, and grandparental country of origin). All cases in the Discovery Set met the American College of Rheumatology (ACR) criteria for rheumatoid arthritis and were positive for the autoantibody rheumatoid factor. All subjects who were included had signed informed, written consent and the study protocol was IRB approved.

The Replication Set consisted of 840 cases in 463 families (families consisted of one to six affected siblings), and 926 controls (two controls matched to a single patient, referred to as a proband, from each family on the basis of age, sex, and grandparental country of origin). All cases in the Replication Set met the ACR criteria for rheumatoid arthritis. The Replication Set was considered in two different ways for analysis: as "Replication, All Cases", with 840 patients and 926 controls (statistics given are unadjusted for the relatedness of the cases); or as "Replication, Probands", using only proband cases, with 463 cases and 926 controls. All subjects who were included had signed informed, written consent and the study protocol was IRB approved.

DNA was extracted from blood samples using standard protocols. Some markers were genotyped individually to generate a specific genotype for every individual. The remaining markers were genotyped in pools of DNA, in which DNA from about 40 individuals was pooled together, and allele frequencies were estimated for the pool. Cases were pooled together on the basis of shared characteristics such as age, gender, and HLA-DRB1 genotype. Controls were pooled based on the pooling of the matched case. Genotypes and pool allele frequencies were measured using a PRISM 7900HT sequence detection PCR system (Applied Biosystems, Foster City, Calif.) by allele-specific PCR, similar to the method described by Germer et al. (Germer S., Holland M. J., Higuchi R. 2000, *Genome Res.* 10: 258-266). Primers for the allele-specific PCR reactions are disclosed in Table 5.

Association of a SNP allele with RA was calculated by applying a Fisher exact test to the counts of each allele in cases and controls. The counts of alleles were determined exactly from independent genotyping or estimated from pooled genotyping. Tests of association were carried out using all cases and controls (stratum=All), as well as in rheumatoid factor positive cases and matched controls (stratum=RF+) in the Replication Set. No correction for multiple testing was made.

Effect sizes were estimated by allelic odds ratios. The reported "Allele1." may be under-represented in cases (with a lower allele frequency in cases than in controls and an odds ratio less than 1, indicating that Allele1 is associated with protection from RA and the other allele is a risk factor for RA) or over-represented in cases (with a higher allele frequency in cases than in controls and an odds ratio greater than 1, indicating that Allele1 is a risk factor in the development of RA).

For markers that have been genotyped in the Discovery Set only, markers listed in Table 6 have a significant p-value of allelic association (less than 0.05) in the All stratum.

For markers that have been genotyped in both the Discovery Set and the Replication Set, markers listed in Table 6 have replicated, significant p-values of allelic association (less than 0.05) in the stratum indicated. Results in the Discovery Set were compared to results in the "Replication, All Cases" set and in the "Replication, Probands" set. If a marker was significantly associated in the All stratum of the Discovery Set, association in either the All or RF+ strata of the Replication Set was assessed to determine if the association was replicated (as all cases in the Discovery Set were RF+, both comparisons are appropriate). If association of a marker was not replicated in the All or RF+ strata, replicated association was assessed within substrata (for example, a marker showing association in the Male stratum of the Discovery Set and the Male stratum of the "Replication, Probands" set would be considered replicated; conversely, a marker showing association in the Male stratum of the Discovery Set and the Female stratum of the Replication Set would not be sufficient to be considered replicated). Replicated markers are listed in Table 6 only if Allele1 was protective in both sample sets or a risk factor in both samples set (markers for which Allele1 was protective in one sample set and a risk factor in another sample set are not listed in Table 6). Replication of a significant association provides further verification that a SNP is associated with RA.

hCV8863093 is an example of a replicated marker typed in both sample sets. For hCV8863093, Allele1 (G) is a protective allele (OR<1) that is significantly associated with not having RA in the All stratum of the Discovery Set, the "Replication, All Cases" set, and the "Replication, Probands" set. hCV8863093 was also significantly associated with not having RA in the RF+ stratum of the "Replication, All Cases" set and the "Replication, Probands" set. Because it was replicated in the All stratum (by being significant in the All strata of the Discovery Set and the All or RF+ strata of at least one of the Replication Sets), not all substratum in which it was also replicated are listed.

hCV940309 is an example of a marker that was typed in the Discovery Set only. For hCV940309, Allele1 (G) is a risk allele (OR>1) that is significantly associated with the development of RA in the All stratum of the Discovery Set.

Although the specific examples described herein are directed towards rheumatoid arthritis, the skilled artisan will appreciate that, since autoimmune diseases share certain similar features that may be due to common genetic factors that are involved in their underlying mechanisms, the SNPs identified herein as being associated with rheumatoid arthritis may also be used as markers for other autoimmune diseases. Such autoimmune diseases include, but are not limited to, type 1 diabetes, multiple sclerosis, systemic lupus erythematosus, inflammatory bowel diseases, psoriasis, thyroiditis, celiac disease, pernicious anemia, asthma, vitiligo, glomerulonephritis, Graves' disease, myocarditis, Sjogren disease, and primary systemic vasculitis. Moreover, the genes containing the SNPs identified herein, and the transcripts and proteins encoded by these genes, can be used in the treatment of other autoimmune diseases, in addition to rheumatoid arthritis. For example, the genes and encoded gene products can serve as targets for the development of therapeutic agents (e.g., small molecule compounds, antibodies, antisense/RNAi agents, etc.) or used directly as therapeutic agents (e.g., therapeutic proteins, etc.) for the treatment of not only rheumatoid arthritis, but various other autoimmune diseases as well.

All publications and patents cited in this specification are herein incorporated by reference in their entirety. Various modifications and variations of the described compositions, methods and systems of the invention will be apparent to those skilled in the art without departing from the scope and spirit of the invention. Although the invention has been described in connection with specific preferred embodiments and certain working examples, it should be understood that the invention as claimed should not be unduly limited to such specific embodiments. Indeed, various modifications of the above-described modes for carrying out the invention that are obvious to those skilled in the field of molecular biology, genetics and related fields are intended to be within the scope of the following claims.

TABLE 5

| hCV | Alleles | Sequence A (allele-specific primer) |
| --- | --- | --- |
| hCV1129864 | C/G | GAAGGAATCGCTTTCTGG (SEQ ID NO: 6608) |
| hCV11697322 | A/G | CAGTTCGTGCTATTGAGAAAAT (SEQ ID NO: 6611) |
| hCV11713583 | A/G | GGCTTTTCTGCCAAGAA (SEQ ID NO: 6614) |
| hCV11916245 | G/T | CAGGAGAGCCAGGATGG (SEQ ID NO: 6617) |
| hCV12011889 | G/T | CTCACCTTCCAGACCCC (SEQ ID NO: 6620) |
| hCV1387523 | A/G | TGGGGTTGGGGTTCT (SEQ ID NO: 6623) |
| hCV1575287 | C/G | CCAGGTGATCCAGGAGAG (SEQ ID NO: 6626) |
| hCV163035 | C/T | GGAAGTGACAACACAAAACC (SEQ ID NO: 6629) |
| hCV1985480 | A/G | CAGCTGCTGCTGTCCAT (SEQ ID NO: 6632) |
| hCV22271781 | C/T | GGTGGTGATCCCAGTCAC (SEQ ID NO: 6635) |
| hCV22274508 | T/A | TTCTGACATTTCTTTTCTGTCA (SEQ ID NO: 6638) |
| hCV2536595 | A/G | CATCCCGCGCCAT (SEQ ID NO: 6641) |
| hCV2567435 | A/G | GGGGTTAGGTTTATAGCT (SEQ ID NO: 6644) |
| hCV27150310 | C/T | GTATGTTTGCTGCCATTTG (SEQ ID NO: 6647) |
| hCV27150326 | C/T | AGATGGGGAAGCATGTAAC (SEQ ID NO: 6650) |
| hCV27493749 | C/T | CCTCCAGGGCTTGTAGG (SEQ ID NO: 6653) |
| hCV3125472 | G/T | ACCTCCAAGGAGATGCAC (SEQ ID NO: 6656) |
| hCV3281637 | C/T | CAGGTCTTTGAGGATCTGG (SEQ ID NO: 6659) |
| hCV8687513 | A/T | TCAAGTCTCATTCCAACCTTT (SEQ ID NO: 6662) |
| hCV8705506 | C/G | CCACTTCGGGTTCCTC (SEQ ID NO: 6665) |
| hCV8726337 | A/G | CACATTCACGGTCACCTT (SEQ ID NO: 6668) |
| hCV8863093 | C/G | GCTCTGCTGTAAGCTCGG (SEQ ID NO: 6671) |
| hCV940309 | A/G | GCCTTGTGACCACACCA (SEQ ID NO: 6674) |

| hCV | Alleles | Sequence B (allele-specific primer) |
| --- | --- | --- |
| hCV1129864 | C/G | GAAGGAATCGCTTTCTGC (SEQ ID NO: 6609) |

TABLE 5-continued

| | | |
|---|---|---|
| hCV11697322 | A/G | CAGTTCGTGCTATTGAGAAAAC (SEQ ID NO: 6612) |
| hCV11713583 | A/G | GGCTTTTCTGCCCAAGAG (SEQ ID NO: 6615) |
| hCV11916245 | G/T | GCAGGAGAGCCAGGATGT (SEQ ID NO: 6618) |
| hCV12011889 | G/T | CTCACCTTCCAGACCCA (SEQ ID NO: 6621) |
| hCV1387523 | A/G | GGGGTTGGGGTTCC (SEQ ID NO: 6624) |
| hCV1575287 | C/G | CCAGGTGATCCAGGAGAC (SEQ ID NO: 6627) |
| hCV163035 | C/T | CGGAAGTGACAACACAAAACT (SEQ ID NO: 6630) |
| hCV1985480 | A/G | CAGCTGCTGCTGTCCAC (SEQ ID NO: 6633) |
| hCV22271781 | C/T | GGTGGTGATCCCAGTCAT (SEQ ID NO: 6636) |
| hCV22274508 | T/A | TTTCTGACATTTCTTTTCTGTCT (SEQ ID NO: 6639) |
| hCV2536595 | A/G | CATCCCGCGCCAC (SEQ ID NO: 6642) |
| hCV2567435 | A/G | GGGTTAGGTTTATAGCC (SEQ ID NO: 6645) |
| hCV27150310 | C/T | TGTATGTTTGCTGCCATTTA (SEQ ID NO: 6648) |
| hCV27150326 | C/T | AGATGGGGAAGCATGTAAT (SEQ ID NO: 6651) |
| hCV27493749 | C/T | CCTCCAGGGCTTGTAGA (SEQ ID NO: 6654) |
| hCV3125472 | G/T | CCTCCAAGGAGATGCAA (SEQ ID NO: 6657) |
| hCV3281637 | C/T | TCAGGTCTTTGAGGATCTGA (SEQ ID NO: 6660) |
| hCV8687513 | A/T | ATCAAGTCTCATTCCAACCTTA (SEQ ID NO: 6663) |
| hCV8705506 | C/G | CCACTTCGGGTTCCTG (SEQ ID NO: 6666) |
| hCV8726337 | A/G | CACATTCACGGTCACCTC (SEQ ID NO: 6669) |
| hCV8863093 | C/G | GCTCTGCTGTAAGCTCGC (SEQ ID NO: 6672) |
| hCV940309 | A/G | CCTTGTGACCACACCG (SEQ ID NO: 6675) |

| hCV | Alleles | Sequence C (common primer) |
|---|---|---|
| hCV1129864 | C/G | GGGTGTATTCACAAATTCTGTTAC (SEQ ID NO: 6610) |
| hCV11697322 | A/G | CAAAGAAAAACAGATCACACAGAT (SEQ ID NO: 6613) |
| hCV11713583 | A/G | GCAGTTGTGCGTAGTAGAGTACA (SEQ ID NO: 6616) |
| hCV11916245 | G/T | CCAGGTAGCACTGAACACCTAA (SEQ ID NO: 6619) |
| hCV12011889 | G/T | AAAGGACCCCTCAAAACAG (SEQ ID NO: 6622) |
| hCV1387523 | A/G | TGTCCCTGTCCTCCTTCAG (SEQ ID NO: 6625) |
| hCV1575287 | C/G | TCCATGGCGAAAATTTTG (SEQ ID NO: 6628) |
| hCV163035 | C/T | CCGCCCAGGATTCTCTA (SEQ ID NO: 6631) |
| hCV1985480 | A/G | CATGAACCTGTCAATCTTCTCA (SEQ ID NO: 6634) |
| hCV22271781 | C/T | TCTTGTTTTGGCACCATTTAC (SEQ ID NO: 6637) |
| hCV22274508 | T/A | TGGAGTGGGCATCTTCAT (SEQ ID NO: 6640) |
| hCV2536595 | A/G | CCTCCAGAGAAGAAGAAGACAC (SEQ ID NO: 6643) |
| hCV2567435 | A/G | TGTCCCCTCAGAGTGAC (SEQ ID NO: 6646) |
| hCV27150310 | C/T | GAGCAGATTCCTGATTTTGATAA (SEQ ID NO: 6649) |
| hCV27150326 | C/T | GGCCATTCCCTCACTTATG (SEQ ID NO: 6652) |
| hCV27493749 | C/T | GAGTAGCCGCGTCTTCTC (SEQ ID NO: 6655) |
| hCV3125472 | G/T | CCTTTCCCAGCCTTCAAG (SEQ ID NO: 6658) |
| hCV3281637 | C/T | GGGCACTGCTTTTCTGAAT (SEQ ID NO: 6661) |
| hCV8687513 | A/T | CTTGCACATCCTATAAACTCATTAC (SEQ ID NO: 6664) |
| hCV8705506 | C/G | CCCTGGCTTCAACATGA (SEQ ID NO: 6667) |
| hCV8726337 | A/G | CATTGCCCGAGCTCAA (SEQ ID NO: 6670) |
| hCV8863093 | C/G | CCCAAGTCCCTCTCCTATCA (SEQ ID NO: 6673) |
| hCV940309 | A/G | CCTCCCTAGCATCTCTGACTT (SEQ ID NO: 6676) |

TABLE 6

| Marker | Gene | Typed in Discovery and Replication? | Study | Geno-typing | Stratum | Allele1 | Case Freq | Control Freq | Allelic p-value | Odds Ratio |
|---|---|---|---|---|---|---|---|---|---|---|
| hCV163035 | hCG95980 | Replicated | Discovery | Pool | All | T | 0.647971386 | 0.696763421 | 0.027764206 | 0.801076717 |
| hCV163035 | hCG95980 | Replicated | Replication, All Cases | Pool | All | T | 0.676508911 | 0.710320615 | 0.030939947 | 0.85285337 |
| hCV8863093 | hCG22818 | Replicated | Discovery | Pool | All | G | 0.723012704 | 0.772056569 | 0.015245492 | 0.770662159 |
| hCV8863093 | hCG22818 | Replicated | Replication, All Cases | Pool | All | G | 0.746751505 | 0.785857818 | 0.007538905 | 0.803502956 |

TABLE 6-continued

| Marker | Gene | Typed in Discovery and Replication? | Study | Geno-typing | Stratum | Allele1 | Case Freq | Control Freq | Allelic p-value | Odds Ratio |
|---|---|---|---|---|---|---|---|---|---|---|
| hCV8863093 | hCG22818 | Replicated | Replication, All Cases | Pool | RF+ | G | 0.748426071 | 0.785807503 | 0.019529029 | 0.810907574 |
| hCV8863093 | hCG22818 | Replicated | Replication, Probands | Pool | RF+ | G | 0.744128659 | 0.785807503 | 0.027156193 | 0.79271024 |
| hCV8863093 | hCG22818 | Replicated | Replication, Probands | Pool | All | G | 0.749444758 | 0.786967283 | 0.028907246 | 0.809703025 |
| hCV22274508 | hCG17514 | no | Discovery | Pool | All | A | 0.298966492 | 0.350156567 | 0.018279848 | 0.791462237 |
| hCV27150310 | hCG25461 | no | Discovery | Pool | All | T | 0.331861068 | 0.384693816 | 0.018631334 | 0.79444823 |
| hCV27150326 | hCG25461 | no | Discovery | Pool | All | T | 0.267477656 | 0.311227693 | 0.037364057 | 0.808098082 |
| hCV27493749 | hCG22935 | no | Discovery | Pool | All | T | 0.094309823 | 0.06068761 | 0.007383834 | 1.611711427 |
| hCV3125472 | hCG43706 | no | Discovery | Pool | All | T | 0.043152465 | 0.069400644 | 0.016540249 | 0.604730844 |
| hCV3281637 | hCG39697 | no | Discovery | Pool | All | T | 0.479850134 | 0.54284765 | 0.006642422 | 0.77689106 |
| hCV8687513 | hCG34285 | no | Discovery | Pool | All | T | 0.906133628 | 0.869774185 | 0.015990721 | 1.445349201 |
| hCV940309 | hCG43698 | no | Discovery | Pool | All | G | 0.977586304 | 0.954931467 | 0.007122917 | 2.058461989 |
| hCV1985480 | hCG14741 | no | Discovery | Pool | All | G | 0.86735496 | 0.905386564 | 0.009020449 | 0.683320767 |
| hCV27150310 | hCG25461 | no | Discovery | Pool | All | T | 0.331861068 | 0.384693816 | 0.018631334 | 0.79444823 |
| hCV27150326 | hCG25461 | no | Discovery | Pool | All | T | 0.267477656 | 0.311227693 | 0.037364057 | 0.808098082 |
| hCV1575287 | hCG14778 | no | Discovery | Pool | All | G | 0.071297561 | 0.033777372 | 0.000285458 | 2.196086489 |
| hCV1129864 | hCG26772 | no | Discovery | Pool | All | G | 0.115898089 | 0.158596606 | 0.007367128 | 0.695479472 |
| hCV3281637 | hCG39697 | no | Discovery | Pool | All | T | 0.479850134 | 0.54284765 | 0.006642422 | 0.77689106 |
| hCV12011889 | hCG23475 | no | Discovery | Pool | All | T | 0.917433036 | 0.947541682 | 0.013175181 | 0.615154343 |
| hCV11916245 | hCG27692 | no | Discovery | Pool | All | T | 0.698020575 | 0.772929802 | 0.000211362 | 0.679064387 |
| hCV2567435 | hCG40366 | no | Discovery | Pool | All | G | 0.37748986 | 0.333165248 | 0.048897742 | 1.213716878 |
| hCV11697322 | hCG27468 | no | Discovery | Pool | All | G | 0.739439317 | 0.778451911 | 0.046726092 | 0.807662416 |
| hCV11713583 | hCG1640727 | no | Discovery | Pool | All | G | 0.388672316 | 0.331516083 | 0.009688552 | 1.282023264 |
| hCV1387523 | hCG28718 | no | Discovery | Pool | All | G | 0.833961452 | 0.796165931 | 0.038214461 | 1.285908988 |
| hCV2536595 | hCG31810 | no | Discovery | Pool | All | G | 0.558344796 | 0.502956158 | 0.016575624 | 1.249348754 |
| hCV8687513 | hCG34285 | no | Discovery | Pool | All | T | 0.906133628 | 0.869774185 | 0.015990721 | 1.445349201 |
| hCV8726337 | hCG28476 | no | Discovery | Pool | All | G | 0.557472386 | 0.634032091 | 0.000622242 | 0.727134495 |
| hCV8705506 | hCG22931 | no | Discovery | Pool | All | G | 0.694333845 | 0.643186064 | 0.019056137 | 1.260161374 |
| hCV27493749 | hCG1641509 | no | Discovery | Pool | All | T | 0.094309823 | 0.06068761 | 0.007383834 | 1.611711427 |
| hCV27493749 | hCG22935 | no | Discovery | Pool | All | T | 0.094309823 | 0.06068761 | 0.007383834 | 1.611711427 |
| hCV27493749 | hCG1641508 | no | Discovery | Pool | All | T | 0.094309823 | 0.06068761 | 0.007383834 | 1.611711427 |
| hCV22271781 | hCG41527 | no | Discovery | Pool | All | T | 0.092790586 | 0.061628891 | 0.012242924 | 1.55735149 |

SEQUENCE LISTING (6676 sequences)

SEQ ID NO: 1 - DNA, 2675 bp, Homo sapiens
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcmtygtgacccggccrggggaagaagctgcygttgttctgggtactacagcagaagggtatgcrgaagcsagcaccccagtctgagatggctcctgccggtgtgagcctgagggccaccatcctctgcctcctggcctgggctggcctggctgcaggtgaccgggtgtacatacaccccttccacytcgtcatccacaatgagagtaccygtgagyagctggcaaaggccaatgccgggaagcccaaagaccccaccttcatacctgctccaattcaggccaagacatcccctgtggatgaaaaggccctacaggaccagctggtgctagtcgctgcaaaacttgacacygaagacaagttgagggccgcaatggtcgggatgctggcyaacttcttgkgcttccgtatatatggcatgcacagtgagctatggggcgtggtccatggggccaccgtcctctccccaayggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccayggtggtgggcgtgttcacagccccaggcctgcacctgaagcagccgtttgtgcagggcctggctctctatacccctgtggtcctcccacgctctctggacttcayagaackggatgttgctgctgagaagattgacaggttcatgcaggctgtgacaggatggaagactggctgctccctgaygggagccagtgtggacagcaccctggctttcaacacctrcgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactrtctccccggaccatccacctgaccatgccccaactggygctgcaaggatcttatgacmtgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgyccctggcctttgaggcaaaggccagcagcagataacaaccccggacaaatcagcgatgtgtcacccccagtctcccaccttttcttctaatgagtcgactttgagctggaaagcagcsgtttctccytggtctaagtgtgctgyatkkagtgagcagtagaagcctgcagcggcacaaatgcacctcccagtttgctgggtttattttagagaatgggggtggggaggcaagaaccagtgtttagcgcgggactactgttccaaaaagaattccarccgaccagcttgtttgtgaaamaaaaaagtgttcccttttcaagttgagaacaaaaattgggttttaaaattaaagtatacatttttgcattgccttcggtttgtakttagtgtcttgaatgtaagaacatgacctccgtgtagtgtctgtaataccttagttttttccacagatgcttgtgatttttgaacaatacgtgaaagatgcaagcacctgaatttctgtttgaatgcggaacmatagctggttatttctcccttgtgttagtaataaacgtcttgccacaataagcctccaaaaattttatctttyatttagcagccaaacagatgtatacaattcagcagatagactgtgcaaacgaaagtgctttcctggactttggatggaatttccatgggaggtctgagccagtacttagcagtcctttgaagttttaggtgatgcttttctctggacacttccattggtaagcagtggtggccatctgtgtgatggacagggggcgggaagagggtgacagggaaggccccataccccatgtggcacctgggaaaggaaccaggcagatgggacttcttccgtcctggtgacacagggccagactgctgctggtattgtgccccgggagtggaaggtagagaaataaatcttcacaaataaatatttgcaattttcccccatc

SEQ ID NO: 2 - DNA, 2285 bp, Homo sapiens
aaagaaaggcgatgctaagaaacrtgctgcaggggaggctggcacattctgctccttagctaaccgcacaggcccatgggtccacacacatcagaccatggctctctgtggtctatctttgccattactttaaccaggctgtttctcatgcgctcatggagggtgactgaagatgccaccccgaggtgcaccctcagcctcgctggacacttacggctcgcattctccagccggaccaggcagttgaggaagtcatcgaagtccagctggagctcctcatccgcatacctgagcacaatcagctgcaggaggtggctgctcagctgaaagcctgtggggacaaaggaggagacccaggactcgctgtatccgagccccgagggtatgcrgaagcsagcaccccagtctgagatggctcctgccggtgtgagcctgagggccaccatcctctgcctcctggcctgggctggcctggctgcaggtgaccgggtgtacatacaccccttccacytcgtcatccacaatgagagtaccygtgagyagctggcaaaggccaatgccgggaagcccaaagaccccaccttcatacctgctccaattcaggccaagacatcccctgtggatgaaaaggccctacaggaccagctggtgctagtcgctgcaaaacttgacacygaagacaagttgagggccgcaatggtcgggatgctggcyaacttcttgkgcttccgtatatatggcatgcacagtgagctatggggcgtggtccatggggccaccgtcctctccccaayggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccayggtggtgggcgtgttcacagccccaggcctgcacctgaagcagccgtttgtgcagggcctggctctctatacccctgtggtcctcccacgctctctggacttcayagaackggatgttgctgctgagaagattgacaggttcatgcaggctgtgacaggatggaagactggctgctccctgaygggagccagtgtggacagcaccctggctttcaacacctrcgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactrtctccccggaccatccacctgaccatgccccaactggygctgcaaggatcttatgacmtgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgyccctggcctttgaggcaaaggccagcagcagataacaaccccggacaaatcagcgatgtgtcacccccagtctcccaccttttcttctaatgagtcgactttgagctggaaagcagcsgtttctccytggtctaagtgtgctgyatkkagtgagcagtagaagcctgcagcggcacaaatgcacctcccagtttgctgggtttattttagagaatgggggtggggaggcaagaaccagtgtttagcgcgggactactgttccaaaaagaattccarccgaccagcttgtttgtgaaamaaaaaagtgttcccttttcaagttgagaacaaaaattgggttttaaaaacatgacctccgtgtagtgtctgtaataccttagttttttccacagatgcttgtgat

SEQ ID NO: 3 - DNA, 2496 bp, Homo sapiens
agctgttaagtcactctgatctctgactgcagctcctactgttggacacacctggccggtgcttcagttagatcaaaccattgctgaaactgaagaggacatgtcaaatattacagatccacagatgtgggattttgatgatctaaatttcactggcatgccacctgcagatgaagattacagcccctgtakgctagaaactgagacactcaacaagtatgttgtgatcatcgcctatgccctrgtrttcctgctgagcctgctgggaaactccctsgtgatgctggtcatcttatacagcagggtcggccgctccgtcactgatgtctacctgctgaacctggccttggccgacctactctttgccctgaccttgcccatctgggcygcctccaaggtgaatggctggatttttggcacattcctgtgcaaggtggtctcactcctgaaggaagtcaacttctayagtggcatcctgctrytggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcmtgaggacccaggtgatccaggagasctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagtggaacgagacaagcagcccttagcccttcccctctgcagcttccaggctggcrtgcagcatcagcatccctagaaagccatgtgcagccaccagtccattgggcaggcagatgttcctaataaagcttctgttccgtgcttgtccctgtggaagtatcttggttgtgacagagtcaagggtgtgtgcagcattgttggctgttcctgcagtagaatgggggcagcacctcctaagaaggcacctctctgggttgaagggcagtgttccctggggctttaactcctgctagaacagtctcttgaggcacagaaactcctgttcatgcccatacccctggccaaggaagatccctttgtccacaagtaaaaggaaatsctcctccagggagtctcagcttmaccctgaggtgagcatcatcttctgggttaggccttgcctaggcatagccctgcctcaagctatgtgagctcaccagtccctccccaaatgctttccatgagttgcagttttttcctagtctgttttccctccttggagacagggccctgtcggtttrttcactgtatgtccttggtgcctggagcctactaaatgctcaataaataatgatcacaggaatgaaygcatgctgaaaagaccactctttt

SEQ ID NO: 4 - DNA, 1765 bp, Homo sapiens
attttatttgtatcaactcaaagcaaaatagagcattttattaaatatgtcttcataaattacgcacagtaaaatcccattaattggaccacacccagttcattatagtgtttattataattttagcattagttgaactgaaaattggtttttgtttactatgagaaaaaggtagactaaacaagatgaaacctgttgtttgcatattatgtttgtacatctttattagcaactatttttccaactattttcaactatttttccaactattttctagttataaaagcaatacataaatactatagaaaatttagcaatgcagaaatgaatttttaaaaatccctcatagatagccattgttaacattttggtgtattttcttcaagtcttagtaaaatggaacctttaaatatagatccctgtatcttaggaattagaaaggcagcaaaggcagttcctaatgagatggagaaaatgttgatttagtcatgcccttgtactgtgggggccatactgtctgttgacagagcatattaaaagacgttccctacattcgtcagccttagctaattggcagtctggtatttatgattttatattttgttaatcagcttgggagctgcagtaccccccagcctcctagaaacttggcttcccctgcctgggaggcctcgttccaggagtcgttgttgagagtcaagccagggaagtgtgtttttgtcagggagcagccagtcctgtgctgggagcrtctcagggggcacctgccgttgaattgttctcacttgtgtttgtaagaatccaagtatgtcacccttacaccaagtgagcacacagtgacacartcccctttcaatgtagataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggtaagtgccccaaatttcatgagctgacgttctattacaaaataagcagcgtgcttatgaaactgtgttgctgaggtaagagccctccctgccttgttaaagagaagaaaggaggaagccgcagtattgcctgtgctgctcgagtaggtcttgggtggagtcatggttctccattcttaggaggttgctgtttggaaaacagagatgttatcacccttactggattttgcctcatcagtcaagggttgcgtgtctgactgtgaccagtgagacggcagacgggggtgcrcttagggcttttctgccaagartgacagcagttggtctggagtgctcacctccctgtgaaatcattgttcgcgcgaccctcatctgcctcaggatgctgtactctactacgcacaactgctccatcttttaagatattggaagtgagagcacrggaggagcatgggcggttcgttttgttagaaagaaaccyggattcacgagatggtttttattgattagtttacaggatttgcactattgatagagtttttgccttggcacaggcctgctttgtgataggggttttaaaataaccgtgggcttttcactggaggataaaagccggtgcttattgcatgcacaattgctttccagccgtcagcctgtgtgtacctttgcatatgtacttttctctttaaactctcccttttaaatacgactcttgccaggctttaagtgaatgcttcaaaataaaaggagttatcaatt

SEQ ID NO: 5 - DNA, 5229 bp, Homo sapiens
ttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcackgtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgagraacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgagggrtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacrtcctgcatttcacctccaccaccacgtcgaagaatcgcatcatcataacctggcaccrgtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaayggcaacctgagttactacattgtgcgctggcagcrgcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcacygacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgaraggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgygcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttaygcccacatgaacgggggccgcaagaacgagcgggccttgccgctgccccagtcttcgacctgctgatccttggatcctgaatctgtgcaaacagtaacgtgtgcgcacrcgcagcggggtsgggkgggagagagagttttaacaatccattcacaagcctcctgtacctcagtggatcttcagwwctgcccttgctgccygcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagyctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaag

SEQ ID NO: 6 - DNA, 5232 bp, Homo sapiens
ttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcackgtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgagraacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgagggrtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacrtcctgcatttcacctccaccaccacgtcgaagaatcgcatcatcataacctggcaccrgtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaayggcaacctgagttactacattgtgcgctggcagcrgcagcctcaggacggctacctttaccggcacaattactgctccaaagaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcacygacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgaraggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgygcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttaygcccacatgaacgggggccgcaagaacgagcgggccttgccgctgccccagtcttcgacctgctgatccttggatcctgaatctgtgcaaacagtaacgtgtgcgcacrcgcagcggggtsgggkgggagagagagttttaacaatccattcacaagcctcctgtacctcagtggatcttcagwwctgcccttgctgccygcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagyctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaag

SEQ ID NO: 7 - DNA, 1451 bp, Homo sapiens
  misc_feature (1)...(1451): n = A,T,C or G, or insertion/deletion polymorphism (see Tables 1-2)
scraggatgtccttctggctgttccagtactccgcagcaggccgccccagctccgtcaccgcccggaactcccccacgtcgctgtcgaagcgcgcraactcctcccggttgtagatgtatctctccaggaagcgctgtwkccmattaarcgcytagcattcctgccytcccyggraaagytgaatcccagccatgctgattcctctccacwcatttccagtyctagasgcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtytccgmggagctggggccatcaaggcggyccatgtgycaacttatgccgcgtttgtacagacgcatawaccaacaggggagtttatgtttgaatttgatgaagatgagatgttctatgtggatctggacaagaaggagaccgtctggcatstggaggagtttggccaagycttttcctttgagnctcagggcgygctggctaacattgctatattgaayaacaycttgaataccttgatccagcgytycaaccacactcaggccaccyycgatccccctgkggtgaccgtgtttcccaaggascctktgkagctgggccagcccaacaccctcatctgccacatygacaagttcttcccaccagtgrtcwrcgtcasgtggctgtgcaacggggagctggtcactgagggtgtcgctgagagcctcttcctgcccagaacannttacwgmtsccacaagttccattacctgacctttgtgccctcagcasaggacttctatgactgcagggtggagcactggggcttggaccagccgctcctcaagyactrggaygcccaagagccaatccagatgcctgagacaayggaractgtgctcwgtgccctgggcctggtgctgggcctagtcggcatcatcgtgggcaccgtcctcatcataaagtctctgcgttctggccatgacccccgggcccaggggaccctgtgaaatactgryaaggtgacaaaasatctgamcagaagargacttagkagagatrtgaactcchgctgccmwacaaactccatctcagctyttrttctcacttcatgtgaaaactactccagtggctgrcrgaattgctgacccttcaagctctgtccttatccattacctcaaagyagtcattccttagtaaagtttccaacaaatagaaattaatgacactttgrtagcyctaatatggagattatcctttcattgagccttttatcctctgttctcctttgaagaacccctcactgtcaccttcccgaraataccctaagaccaataaatycttcartatttcagagcy

SEQ ID NO: 8 - DNA, 1513 bp, Homo sapiens
tccaggatgtccttctggctgttccagtactccgcagsaggccgccccagctccgtcaccgcccggaactcccccacgtcgctgtcgaagcgcgygaartccycccggttgtagatgtatctctccaggaagcgytgtrtcccattaawcgcgtagcattcctgccgtccctggaaaagcaccttccagcgtcctctttacccagcaacagagaatgtcagctctatgatttctctgataggtgaatcccagccatgctgattrytctccacccattsccagtgmtagaggcrcacagttkcagtctratctgccthcactcgmwctcagttcctcatcactgytcrtgtgctcacagtcatcaattatagaccccacaacrtrcgccctgaagacagaatgttccatatcagagctgtgatcttgagayccctctccttggctttcctgctgagtctccgaggagctggggccatcaargcggyccatgtgtcaacttatgccgcgtttgtacagacgcatagaccaacaggggagtttatgtttgaatttgatgaagatgagrtgttctatgtggatctggacaygaaggrgaccgtctggcytctrgagyrgtttggccaagccttttcctttgaygctcagggcgggctggctaacattgctatattgaacaacaacttgaataccttgarccagcgttccaaccakactcaggccaccaacgatccccctgaggtgaccgtgtttcccaaggagcctgtggagctgggccagcccaacaccctcatctgccacattgacaagttcttcccaccagtgctcaacgtcacgtggctgtgcascggggagctggtcactgagggtgtcgctgagagcctcttcctgcccagaacagattacagcttccacaagttccattacctgacctttgtgccctcagcagaggacttctatgactgcagggtggagcaytggggcttggaccagccgctcctcaarcawtgggaggcccaagagccaatccagatgcctgayacaacggagactgtgctctgtgccctgggcctggtgctgggcctagrcggcathatcgtgggcaccgtcctcatcataaagtctctgcgttctggccatgacccccggrcccagggraccytgtgaaatactgtaaaggtgacaaaatatctgaackgyayaggacttrgragagatctgaactccagctyccctacaayctccatctcagcttttcttctcacttcatgtgaraactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcagagcg

SEQ ID NO: 9 - DNA, 1410 bp, Homo sapiens
  misc_feature (1)...(1410): n = A,T,C or G, or insertion/deletion polymorphism (see Tables 1-2)
scraggatgtccttctggctgttccagtactccgcagcaggccgccccagctccgtcaccgcccggaactcccccacgtcgctgtcgaagcgcgcraactcctcccggttgtagatgtatctctccaggaagcgctgtwkccmattaarcgcytagcattcctgccytcccyggraaagygctagaggcccacagtttcagtctcatctgwctccactcggyctcagstcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacytatgmcgcgtttgtacagacgcatagaycaacaggygagtttatgtttgaatttgatgaagatgagwtgttctatgtggatctggacaagaaggagaccgtctggcatctggaggagtttggccaagccttttcctttgaggctcagggsgggctggctaacattgctytattgaacaacaanttgaataccytgatccagcgttccaaccacactcyggccyccaacgatccccctgaggtgaycytgtttcccaaggagcctgtyyagctgggccagkccaacaccctcatctgccacastgakaakttcttcccaccagtgctcaacgtcacgtggctgtycaacggggagctggtcactgarggwrtcgctsagagcctcttcctgcccagaacagattacagcttccacaagttccattacctgacctttgtgccnncagcwgmgsacttctatgactgcaggytggrgcactggggwttggaccagccgctcctcaagcactgggaggcccaagagccaatccagatgcctgagacaacggagactgtgctctgtgccctgggcctggtgctgggcctagtcggcatcatcrygggcaccgtcctsatcatamagtctctrcgttctgkccatgarccccgggchcaggggmwcctgtgaaatactgtaaaygtracaaaatatctgaacagaagaggacttaggagagrtrtgaactccagctgccctacaaactccatctcagcttttcttctcayttcatgtgaaaactactccagtggctgactgaattgctgacccttcaagrtctgyccttatccattacctcaaagcagtcattccttagtaaagtttccaacaaatagaaattaatgacactttggtagcactartatggagattatcctttcattyagcctrttatcctctgtyctcrtttyragaacccctcactgtcaccttcccyagaataccctaagaccaataaatacttcagtatttcagagcg

SEQ ID NO: 10 - DNA, 1626 bp, Homo sapiens
  misc_feature (1)...(1626): n = A,T,C or G, or insertion/deletion polymorphism (see Tables 1-2)
caggagctccctttagcgagtccttcttttcctgactgcagctcttttcattttgccatccttttccwgctccatgatggttctgcaggtttctgcggccccsckgwcagtnnctctgacggcgttactgatggtgctgctcacatctgtggtccagggcagggccactccagagaastacctywtcyagggacggcaggaatgctacgrgtttaatgggacacagcgcttcctggagagatacmtcmacasccgggaggagttcgcgcgcttmgacagcgacgtrrgggagttccgggcggtgacrgrgctggggcggcctgctgcggagdacrgsasragccagaaggacatcctggaggagaagrgggcagygccggacaggatgtgcagaracaaytacgagctgggcgggcccatgaccrtgcagcgccragtccagcctaggrtgaatgtttccccctccasgaaggggcccttgcagcaccacaacctgcttgtctgccacgtgacggatttctacccaggcagcattcaagtccgatggttcwtgaatggacaggaggaaacagctggggtcgygtccaccyacctgatccgtaatggagactgmacctyccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcstcatcygtggagtgggwatcttcatgcacaggaggagcaagaaagagycacartcygattytgcccggagtaagycatrgacggmagkwgggggcttcgtgctggggctcatcatctgtggagtgggcatcrtcatgcacaggaggagcaagaaagttcaacgaggatctgcataaacagggttcctgagctcactgaaaagactattgtgccttaggaaaagcrtstgctgtytttcgttagcatctggctcyaggacaraccttcaayttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactctkctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacacttt

SEQ ID NO: 11 - DNA, 1515 bp, Homo sapiens
  misc_feature (1)...(1515): n = A,T,C or G, or insertion/deletion polymorphism (see Tables 1-2)
caggagctccctttagcgagtccttcttttcctgactgcagctyttttcattttgccatccttttccagctccatgatggttctgcaggtttctgcggccccccggacagtggctctgacggcgttactgatggtgctgctcacatctgtggtccagggcagggccactccagagaastkcwttttnnagggacggcaggaatgctacgcgtttaatgggacacagcgcttcctggagagatacatctacaascgggaywagytcgcgcgcttcgacagcgacgrgggggagttccgggcggtgacggagctggggcggmctmctgsggagtactggaacagccagaamgacatcctggarragaagcgggcagtgccggarargatgtgcagacacaactacgagdtgrgsgsrcccatgaccctgcagcgccgagtccagrctagggygaatgtttccccctccaagragggycccttgcagcaccacaacctgcttrtctgccacgrgacggatttctacrcaggcagcattcaagtccsatggttcctgaatggacaggaggaaacagctggggtcgtgtccaccaacctgatccgtaatggagactggaccttccagatcwtggtgatgctggaaatgaccccccagcaggyagatgtcyacacctgccaagtggagcacacmagccyggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcstgagcycactgaaaagwctattgtgccttaggaaaagcatttgctgtytttcrttygcatytggctccaggacayaccrtcaacmtckwaattggatactgctgccaagaagttgctctgaagtcagtttcratcattctgctctttgattcaaagcactgtttctctcactgggcctccaaccatgttcccttcttcttagcaccacaaataatcaaaacccarcstgactgyttgttttcctttaaaaataygcaccaratcatctcycatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccaktaagaagttaaatgaacatcagaatttaaaatcataaatataatctaatacacttt

SEQ ID NO: 12 - DNA, 1643 bp, Homo sapiens
  misc_feature (1)...(1643): n = A,T,C or G, or insertion/deletion polymorphism (see Tables 1-2)
caggagctccctttagcgagtccttcttttcctgactgcagctyttttcattttgccatccttttccagctccatgatggttctgcaggtttctgcggccccccggacagtggctctgacggcgttactgatggtgctgctcacatctgtggtccagggcagggccactccagagaastkcwttttnnagggacggcaggaatgctacgcgtttaatgggacacagcgcttcctggagagatacatctacaascgggaywagytcgcgcgcttcgacagcgacgrgggggagttccgggcggtgacggagctggggcggmctmctgsggagtactggaacagccagaamgacatcctggarragaagcgggcagtgccggarargatgtgcagacacaactacgagdtgrgsgsrcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctgggstcgtgyccaccaacctwatccgtaatggagackwgaccttccagatcctggtgatgctggaaatgaccccccagcarggagatgtctacacctgccaagtggagcacaccagcctggatagtcctgtcaccgtggagtggaaggcacagtctgattctgcccggagtaaracattgacgggagctgggggcttcgtgctggggctcatcatctgtggagtgggcatcttcatgcacaggaggagcaagaaagaggcacagtctgattctgcccggagtaagacattgacgggagctgggggcttcgtgctggggctcatcatctgtggagtgggcatcttcatgcacaggaggagcaagaaaggtgagaaagcctgcaggttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacacttt

SEQ ID NO: 13 - DNA, 2016 bp, Homo sapiens
  misc_feature (1)...(2016): n = A,T,C or G, or insertion/deletion polymorphism (see Tables 1-2)
caggagctccctttagcgagtccttcttttcctgactgcagctyttttcattttgccatccttttccagctccatgatggttctgcaggtttctgcggccccccggacagtggctctgacggcgttactgatggtgctgctcacatctgtggtccagggcagggccactccagagaastkcwttttnnagggacggcaggaatgctacgcgtttaatgggacacagcgcttcctggagagatacatctacaascgggaywagytcgcgcgcttcgacagcgacgrgggggagttccgggcggtgacggagctggggcggmctmctgsggagtactggaacagccagaamgacatcctggarragaagcgggcagtgccggarargatgtgcagacacaactacgagdtgrgsgsrcccatgaccctgcagcgccgaggctggagtgctgtggcaccatcatggctcactgcagcctcaacctcctgggctcaagtgatcctcctgcctcagcctcccatgtagctagaactacagatacacgtaccaccatgtctggctaatttatttttctttttagagatgggttctcactatgttgcccaggccggtctcaaaaccctgggctcaagtgatcctcatgcctcaacctcccaaagtgctaagattataggcatgaccaccatgcctggccttttctgctttctgaggaggaaaaaggtactggtggcagagatccaaaagaaaagttgccagtggcagtgtggaaattcacctgagaacaacaggacaagctggggcacaaatgcaaagatgcagagggaggcaacacctggtcatctgtgagaccttcatgggacctgaagacgcagcacagaggaggaacttgaaaaaggacgggatttctactactcaagcatgtaggagctcaggatattcttccagrctagggygaatgtttccccctccaagragggycccttgcagcaccacaacctgcttrtctgccacgrgacggatttctacrcaggcagcattcaagtccsatggttcctgaatggacaggaggaaacagctggggtcgtgtccaccaacctgatccgtaatggagactggaccttccagatcwtggtgatgctggaaatgaccccccagcaggyagatgtcyacacctgccaagtggagcacacmagccyggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcstgagcycactgaaaagwctattgtgccttaggaaaagcatttgctgtytttcrttygcatytggctccaggacayaccrtcaacmtckwaattggatactgctgccaagaagttgctctgaagtcagtttcratcattctgctctttgattcaaagcactgtttctctcactgggcctccaaccatgttcccttcttcttagcaccacaaataatcaaaacccarcatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacacttt

SEQ ID NO: 14 - DNA, 1621 bp, Homo sapiens
gtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggmcaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttrgcatggtccggaaggcaaagtaccgggarctgctcctatcagagctcctgggccggcgggygcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtrctgttattactctgtcttgaaataggaaggtgggatttctggggaggctggtgaaggagggcagggttcttttctctaygtgtcatgttaaaattgccaaataaagtacctctgcctgtgat

SEQ ID NO: 15 - DNA, 1484 bp, Homo sapiens
gtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggmcaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttrgcatggtccggaaggcaaagtaccgggarctgctcctatcagagctcctgggccggcgggygcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtrctgttattactctgtcttgaaataggaaggtgggatttctggggaggctggtgaaggagggcagggttcttttctctaygtgtcatgttaaaattgccaaataaagtacctctgcctgtgat

SEQ ID NO: 16 - DNA, 1633 bp, Homo sapiens
gtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggmcaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtatgtgactgtgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttrgcatggtccggaaggcaaagtaccgggarctgctcctatcagagctcctgggccggcgggygcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtrctgttattactctgtcttgaaataggaaggtgggatttctggggaggctggtgaaggagggcagggttcttttctctaygtgtcatgttaaaattgccaaataaagtacctctgcctgtgat

SEQ ID NO: 17 - DNA, 1031 bp, Homo sapiens
tggaaatcgaatctgtgctctgtgagagatcctaggaaaggaaactgggagcccgggagaactaaaattcccaattaaaagtgaatttaaatctgagctgttcttagacccagaatttcttgcctgaaggaggartcaggtccccacaaggaaagaccctgcaactgtataaaaaaagaatctaaaaagatcatgactccttcagtcctttcccaaagagacctatggaaatttcctcaggagcacccacaacagaatagacattaaacagctgcataaacaaatgactcagccagttgatgtcagtcagcctgtgtcaacagccaccccaatgctggcacaaaaggcactagaacagaatagcctgatggcagagatgaagtgtgcatggctccagcagcacggactcctctcattaaggctgatctagctactgttgctgccccatgtctaacttgccagcaacggagaccaaagttgagccccggaatcagcaccattcctcatagagaccagctagtcactgggtggaagagggaccaagcaaaaccccagaagagttgatctcaaagcttattttatgaagaaaattgacctgagtgacacaaagggttggactgtagtagatgtcacgttttgctgcctagatctccatccagggatgaactcttatttcctcagcttctttgtctcctcagcttctgggagggttggcagctgatattctcacctgagtccctttctaggacttgcccttgcctgaagagagctgtgctgcccaacatgatgcctcctccaaggtacaatccacacccagtgactaataaacaggggttacaaaggcatgcctgcttgccccagtttgggwcaamtttaccaggccaacccagcctcaaggctctccacaggaacaggtgasgccatagttgtgattacatcacaggtcagtttctcctctgcccaagccttcttccttcattcctccacagatgctgatcctgagattcctttccagtaaacttcctccatgc

SEQ ID NO: 18 - DNA, 752 bp, Homo sapiens
gctggcaaagcacacaggctgagcgctgaggagagggaccagctgctgccaaacctgagggctgtggggtggaatkagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtccacatcacgctgagcayccatgagtgtgccggcctttcakaacrggacataaacctggccagcttcatcraayaagtagcagtgtccatgacatagaccctgcccttcctctttgaattcttccgggggaargggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacrgggtgaaataaagtcttgtcttagaaaccaggaccctaaaccccacactatgtaatagaaacacatgtgtttttatgtctcaaataaaactattatatcacttgg

SEQ ID NO: 19 - DNA, 829 bp, Homo sapiens
ccgccccgggacggcagcctgcgcgcccrgccgccgcctgccctctccgctggccacctgctgccgcccgcgccatggctggcaaagcacacaggctgagcgctgaggagagggaccagctgctgccaaacctgagggctgtggggtggaatkagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtccacatcacgctgagcayccatgagtgtgccggcctttcakaacrggacataaacctggccagcttcatcraayaagtagcagtgtccatgacatagaccctgcccttcctctttgaattcttccgggggaargggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacrgggtgaaataaagtcttgtcttagaaaccaggaccctaaaccccacactatgtaatagaaacacatgtgtttttatgtctcaaataaaactattatatcacttgg

SEQ ID NO: 20 - DNA, 484 bp, Homo sapiens
ccgccccgggacggcagcctgcgcgcccrgccgccgcctgccctctccgctggccacctgctgccgcccgcgccatggctggcaaagcacacaggctgagcgctgaggagagggaccagctgctgccaaacctgagggctgtggggtggaatkagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtctcaaggctacaagcctccggtgtgcaacaataccatctgctttsctggttctccagcttgccaactacagatcttgggacttgtcagcctccataatcacatgagccaattccttataagaaatctctttgtgtgtattggttctgtttctctggagaatcataatacacaggcctatcatatcagatatg

SEQ ID NO: 21 - DNA, 1060 bp, Homo sapiens
ctagttctcactctgacgtcccgcgtcctttttcatttgtctgcttctcgctcccttccgtgttctgttccctcttcctccctcttccctgggcctgtttctcgctgtccctgtcttttatccttctcatctgcctcttttttgctcaccctgtttctcactgccctcccctccgcctttytcacccctctgtccttttgagctcttttttgctctgtctcttcatttgccttttgcactctcaaamtctttcatcttcccattcgctgtctgtatttctccataactatatctttcttcctctgtctccgcccacccacatttttctctttccctttctctctttggggaccctcccccatgctcccctgccccatccccttttccccttcccrtcttctcatccctccattcccatctttccccagcaattaccagctctggctgggtcrccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagaygctgtgaaggtcgtggagttgcccaccsaggaacccgaagtggggagcacctgtttggcttccggctggggcagcatcgaaccagagaatttctcatttccagatgatctccagtgtgtggacctcaaaatcctgcctaatgatgagtgcraaaaagcccacgtccagaaggwgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatccaat

SEQ ID NO: 22 - DNA, 874 bp, Homo sapiens
tcctccacctgctggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcrccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagaygctgtgaaggtcgtggagttgcccaccsaggaacccgaagtggggagcacctgtttggcttccggctggggcagcatcgaaccagagaatttctcatttccagatgatctccagtgtgtggacctcaaaatcctgcctaatgatgagtgcraaaaagcccacgtccagaaggwgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatccaat

SEQ ID NO: 23 - DNA, 1198 bp, Homo sapiens
agggtggagtgcaggcttggaaagcaggagagctcagcctacgtctttaatcctcctgcccaccccttggattctgtctccactgggactcaagagaggaacctggggcccgctcctcccccctccagrccatgaggattctgcagttaatcctgcttgctctggcaacagggcttgtagrgggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcaygctgtgtcactgctggcaccagctgcctcatttccggctggggcagcacgtccagcccccagttacgcctgcctcacaccttgcgatgcgccaacatcrccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctrcgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaa

SEQ ID NO: 24 - DNA, 1260 bp, Homo sapiens
cctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccaaggaacctggggcccgctcctcccccctccagrccatgaggattctgcagttaatcctgcttgctctggcaacagggcttgtagrgggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcaygctgtgtcactgctggcaccagctgcctcatttccggctggggcagcacgtccagcccccagttacgcctgcctcacaccttgcgatgcgccaacatcrccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctrcgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaa

SEQ ID NO: 25 - DNA, 4391 bp, Homo sapiens
attttgbctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaatcccgtwtgttggcaccattccygatcagctggatcctggaactttgattgtgataygtgggcatgttcctagtgacgcagacagattccaggtggatctgcagaatggcagcagyrtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctraaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagrcatttctaaaatcgcacccagaactgtctacaccaagagcaaakattcractgtcaatcacacttwgacttgcaccaaaataccacctatgaactatgtgtcaaagagsctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttaytgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattagrtcctgctgggtgttctcagtccttgccatgamgtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgargagctaggatatatacttggtgaaacaaaccagtatgttccctgttctcttgagcttcgactcttctgtgckctaytgctgcgcactgctttttctacaggcattacatcaactcctaaggggtcctctgggattagttawgcagmtattaaatcacccgaagacactaayttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatytgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatygctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaawctcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtrtgagctgttttagaagcagcgtgttgccttcatctctcccgtttcccaaaagaacaaaggataaaggtgacagtcacactcctgggttaaaaaaagcattcmagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatrtaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaamgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatct

SEQ ID NO: 26 - DNA, 4047 bp, Homo sapiens
acctgctccgtggagcgcctgaaacaccagtctttggatggagtctcgttctgttgcccaggctggagtgcagtggcacaatctcggctcacttcaacctccgtctcccaggttcaagcaattstcctgtctcagcctcctgagtagctgggactacagggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaatcccgtwtgttggcaccattccygatcagctggatcctggaactttgattgtgataygtgggcatgttcctagtgacgcagacagattccaggtggatctgcagaatggcagcagyrtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctraaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagsctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttaytgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattagrtcctgctgggtgttctcagtccttgccatgamgtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgargagctaggatatatacttggtgaaacaaaccagtatgttccctgttctcttgagcttcgactcttctgtgckctaytgctgcgcactgctttttctacaggcattacatcaactcctaaggggtcctctgggattagttawgcagmtattaaatcacccgaagacactaayttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatytgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatygctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaawctcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtrtgagctgttttagaagcagcgtgttgccttcatctctcccgtttcccaaaagaacaaaggataaaggtgacagtcacactcctgggttaaaaaaagcattcmagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatrtaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaamgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatct

SEQ ID NO: 27 - DNA, 4265 bp, Homo sapiens
attttgbctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaatcccgtwtgttggcaccattccygatcagctggatcctggaactttgattgtgataygtgggcatgttcctagtgacgcagacagattccaggtggatctgcagaatggcagcagyrtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctraaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagsctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttaytgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattagrtcctgctgggtgttctcagtccttgccatgamgtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgargagctaggatatatacttggtgaaacaaaccagtatgttccctgttctcttgagcttcgactcttctgtgckctaytgctgcgcactgctttttctacaggcattacatcaactcctaaggggtcctctgggattagttawgcagmtattaaatcacccgaagacactaayttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatytgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatygctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaawctcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtrtgagctgttttagaagcagcgtgttgccttcatctctcccgtttcccaaaagaacaaaggataaaggtgacagtcacactcctgggttaaaaaaagcattcmagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatrtaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaamgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatct

SEQ ID NO: 28 - DNA, 4299 bp, Homo sapiens
tggacttggatccgaggcagacgaggaagctgagaaaaccctggcgttgaccccgtggacctgggcgccccgggaaggccrgcgcttggtccaggcaggcggggcctgtgcggtgaccaccctggtcctgaaaagtcccagccccgagcgccctccctcctagacctggaggcctggaacagccagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaatcccgtwtgttggcaccattccygatcagctggatcctggaactttgattgtgataygtgggcatgttcctagtgacgcagacagattccaggtggatctgcagaatggcagcagyrtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctraaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttgcagactgtctctcccctcstgggatttacagggtcatggctctgaaacattcygkagtgttstttggacacgagttttccctggagatcgctttctgcaggcctcttggtcctgactgtgscttcttttcagagsctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttaytgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattagrtcctgctgggtgttctcagtccttgccatgamgtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgargagctaggatatatacttggtgaaacaaaccagtatgttccctgttctcttgagcttcgactcttctgtgckctaytgctgcgcactgctttttctacaggcattacatcaactcctaaggggtcctctgggattagttawgcagmtattaaatcacccgaagacactaayttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatytgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatygctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaawctcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtrtgagctgttttagaagcagcgtgttgccttcatctctcccgtttcccaaaagaacaaaggataaaggtgacagtcacactcctgggttaaaaaaagcattcmagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatrtaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaamgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatct

SEQ ID NO: 29 - DNA, 3186 bp, Homo sapiens
tgtctttttccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagrgtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgaacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgatwgagagcactcaacaggctcgctgcttaagagatactgaacagatcttcagagaaggtccggttgaaattggtctcccatgctccatcaaaaatgaagcaaggcygccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacrcacatgttttgtacattycagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatygcggattttggaatgtgcaaggagaacatgttaggagatgccaagacgaataccttctgtgggacacctgactacatcgccccagagatcttgctgggtcagaaatacaaccactctgtggactggtggtccttyggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgmgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacacwgcttgggttcctttttcaacttggaaaaagaaagaaacactcaacaataaakactgagacccgttcgcccccrtgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaaygaaatgcttgttgaatcaggggcaaacggagtacagacgtctcaagactgaaacggccccrttgcctggtctagtagcggatctcactcagccgcagacaagtaatcactaacccgttttattctattcctatctgtggatgtrtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcrtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttmatggcaaacaggtggatgtgtaaaaatggaat

SEQ ID NO: 30 - DNA, 3189 bp, Homo sapiens
tgtctttttccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagrgtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgatwgagagcactcaacaggctcgctgcttaagagatactgaacagatcttcagagaaggtccggttgaaattggtctcccatgctccatcaaaaatgaagcaaggcygccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacrcacatgttttgtacattycagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatygcggattttggaatgtgcaaggagaacatgttaggagatgccaagacgaataccttctgtgggacacctgactacatcgccccagagatcttgctgggtcagaaatacaaccactctgtggactggtggtccttyggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgmgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacacwgcttgggttcctttttcaacttggaaaaagaaagaaacactcaacaataaakactgagacccgttcgcccccrtgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaaygaaatgcttgttgaatcaggggcaaacggagtacagacgtctcaagactgaaacggccccrttgcctggtctagtagcggatctcactcagccgcagacaagtaatcactaacccgttttattctattcctatctgtggatgtrtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcrtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttmatggcaaacaggtggatgtgtaaaaatggaat

SEQ ID NO: 31 - DNA, 1455 bp, Homo sapiens
agtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagrgtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgaacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgatwgagagcactcaacaggctcgctgcttaagagatactgaacagatcttcagagaaggtccggttgaaattggtctcccatgctccatcaaaaatgaagcaaggcygccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacrcacatgttttgtacattycagaccaaggtatggcttctgctccgacaaccctacctc

SEQ ID NO: 32 - DNA, 3242 bp, Homo sapiens
agtccccgcgcagtccccgcgcagtcccagcgccaccgggcagcagcggcgccgtgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagrgtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgatwgagagcactcaacaggctcgctgcttaagagatactgaacagatcttcagagaaggtccggttgaaattggtctcccatgctccatcaaaaatgaagcaaggcygccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacrcacatgttttgtacattycagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatygcggattttggaatgtgcaaggagaacatgttaggagatgccaagacgaataccttctgtgggacacctgactacatcgccccagagatcttgctgggtcagaaatacaaccactctgtggactggtggtccttyggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgmgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacacwgcttgggttcctttttcaacttggaaaaagaaagaaacactcaacaataaakactgagacccgttcgcccccrtgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaaygaaatgcttgttgaatcaggggcaaacggagtacagacgtctcaagactgaaacggccccrttgcctggtctagtagcggatctcactcagccgcagacaagtaatcactaacccgttttattctattcctatctgtggatgtrtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcrtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttmatggcaaacaggtggatgtgtaaaaatggaat

SEQ ID NO: 33 - DNA, 8238 bp, Homo sapiens
ggtttccgggtgagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcrgccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaarcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagggattgaaatcatctttaccagattacagagctgcaacatacatgataatatgtcagatttctgtgaaagtgaccatggaaaatacctttgtgaattcattggcatcacagatcatcaaaacattgaccaagattccctctttgatcaaggatgggttaagttgcttgatagtgctcctgcagagacagaagccagagagccttgggaaaaagccattccctcacttatgtaatgttcctgatcttattacaatacttcatgggatttctgaaacttacgatgtcagtcctcttctgcrttacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattagrcttttagaaagcaaataccccagaacattagatgttgtattagaggaacacttaaaggaaattgcagatctgaaaaaacaagagcttttccatcagtttgtttctctttctacaagtggaggaaagtatcagtttttagcagattctgatacttctttgatgctcagcctgaatcatccacttgctcctgtgagaattctggccatgaatcatttgaaaaagatcatgaaaacatcaaaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttrtggttatcaataatgatgatacrgaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggtggaggatttrataagcgtgggtgaggaggagtcctttaacctgaagcagaaagtaacgtttcatgtgatcctgtctgtgctygtctcttgttgttcatctttaaaagaaacccactttccatttgcgataagagtcttcagtttgttgcagaaaaaaataaagaagcttgaaagtgtcattactgcagtggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtkcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcartgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcrttgtataccttaaagcttttatgcaagaattttggtgcagaaaatccagatscttttgtcccagtgctgarcactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgraccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgcacagttttcrgtggccatggcggatgactctctttggaaaccactgaactaccagattctgctaaagacgagagactcctygcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaactgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttayatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcayacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataatagtaaagtggaagagtgctttgatctcagttgctaatgatgatggactaatctttagaagaacggaggccttgattggtgatttcatgggaacaaaacagatttctgcattacctctgcctg

SEQ ID NO: 34 - DNA, 7846 bp, Homo sapiens
ggtttccgggtgagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcrgccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaarcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagtctttgtacctcactggaaggaggacggagcagacagtctctttgaggcatcatcaaaacattgaccaagattccctctttgatcaaggatgggttaagttgcttgatagtgctcctgcagagacagaagccagagagccttgggaaaaagtatgtacaattgaattgagaaatggtgctagtcagaggccattccctcacttatgtaatgttcctgatcttattacaatacttcatgggatttctgaaacttacgatgtcagtcctcttctgcrttacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattagrcttttagaaagcaaataccccagaacattagatgttgtattagaggaacacttaaaggaaattgcagatctgaaaaaacaagagcttttccatcagtttgtttctctttctacaagtggaggaaagtatcaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttrtggttatcaataatgatgatacrgaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtkcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcartgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcrttgtataccttaaagcttttatgcaagaattttggtgcagaaaatccagatscttttgtcccagtgctgarcactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgraccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgcacagttttcrgtggccatggcggatgactctctttggaaaccactgaactaccagattctgctaaagacgagagactcctygcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaaatccccacctggcttgtgctgccacataagcctctcctgcctatcgtatagagctgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttayatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcayacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataata

SEQ ID NO: 35 - DNA, 7914 bp, Homo sapiens
ggtttccgggtgagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcrgccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaarcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagtctttgtacctcactggaaggaggacggagcagacagtctctttgaggcatcatcaaaacattgaccaagattccctctttgatcaaggatgggttaagttgcttgatagtgctcctgcagagacagaagccagagagccttgggaaaaagtatgtacaattgaattgagaaatggtgctagtcagaggccattccctcacttatgtaatgttcctgatcttattacaatacttcatgggatttctgaaacttacgatgtcagtcctcttctgcrttacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattagrcttttagaaagcaaataccccagaacattagatgttgtattagaggaacacttaaaggaaattgcagatctgaaaaaacaagagcttttccatcagtttgtttctctttctacaagtggaggaaagtatcaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttrtggttatcaataatgatgatacrgaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtkcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcartgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcrttgtataccttaaagcttttatgcaagaattttggtgcagaaaatccagatscttttgtcccagtgctgarcactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgraccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgcacagttttcrgtggccatggcggatgactctctttggaaaccactgaactaccagattctgctaaagacgagagactcctygcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaactgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttayatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcayacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataatagtaaagtggaagagtgctttgatctcagttgctaatgatgatggactaatctttagaagaacggaggccttgattggtgatttcatgggaacaaaacagatttctgcattacctctgcctg

SEQ ID NO: 36 - DNA, 7967 bp, Homo sapiens
ggtttccgggtgagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcrgccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaarcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagtctttgtacctcactggaaggaggacggagcagacagtctctttgaggcatcatcaaaacattgaccaagattccctctttgatcaaggatgggttaagttgcttgatagtgctcctgcagagacagaagccagagagccttgggaaaaagtatgtacaattgaattgagaaatggtgctagtcagaggccattccctcacttatgtaatgttcctgatcttattacaatacttcatgggatttctgaaacttacgatgtcagtcctcttctgcrttacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattagrcttttagaaagcaaataccccagaacattagatgttgtattagaggaacacttaaaggaaattgcagatctgaaaaaacaagagcttttccatcagtttgtttctctttctacaagtggaggaaagtatcaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttrtggttatcaataatgatgatacrgaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtkcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcartgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcrttgtataccttaaagcttttatgcaagaattttggtgcagaaaatccagatscttttgtcccagtgctgarcactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgraccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgcacagttttcrgtggccatggcggatgactctctttggaaaccactgaactaccagattctgctaaagacgagagactcctygcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaaatccccacctggcttgtgctgccacataagcctctcctgcctatcgtatagagctgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttayatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcayacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataatagtaaagtggaagagtgctttgatctcagttgctaatgatgatggactaatctttagaagaacggaggccttgattggtgatttcatgggaacaaaacagatttctgcattacctctgcctg

SEQ ID NO: 37 - DNA, 2840 bp, Homo sapiens
cctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgraccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgcacagttttcrgtggccatggcggatgactctctttggaaaccactgaactaccagattctgctaaagacgagagactcctygcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaaatccccacctggcttgtgctgccacataagcctctcctgcctatcgtatagagctgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttayatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcayacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataata

SEQ ID NO: 38 - DNA, 7870 bp, Homo sapiens
ggtttccgggtgagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcrgccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaarcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagggattgaaatcatctttaccagattacagagctgcaacatacatgataatatgtcagatttctgtgaaagtgaccatggaaaatacctttgtgaattcattggcatcacagatcatcaaaacattgaccaagattccctctttgatcaaggatgggttaagttgcttgatagtgctcctgcagagacagaagccagagagccttgggaaaaagccattccctcacttatgtaatgttcctgatcttattacaatacttcatgggatttctgaaacttacgatgtcagtcctcttctgcrttacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattagrcttttagaaagcaaataccccagaacattagatgttgtattagaggaacacttaaaggaaattgcagatctgaaaaaacaagagcttttccatcagtttgtttctctttctacaagtggaggaaagtatcaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttrtggttatcaataatgatgatacrgaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtkcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcartgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcrttgtataccttaaagcttttatgcaagaattttggtgcagaaaatccagatscttttgtcccagtgctgarcactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgraccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgcacagttttcrgtggccatggcggatgactctctttggaaaccactgaactaccagattctgctaaagacgagagactcctygcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaaatccccacctggcttgtgctgccacataagcctctcctgcctatcgtatagagctgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttayatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcayacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataata

SEQ ID NO: 39 - DNA, 1848 bp, Homo sapiens
  misc_feature (1)...(1848): n = A,T,C or G, or insertion/deletion polymorphism (see Tables 1-2)
gtcttgactcatgggtgtattcacaaattctgttacttcaagtctttttcttttaacggattgatcttttgctagatagagacaaaatatcagtgtgaattacagcaaacccctattccatgctgttatgggtgaaactctgggagattctcctattgacscagaaagcgattccttcactgatacactgtctgcaaacatatcacaagaaatgaccatggttgacacagagatgccattctggsccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctcmaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccrtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagcctttwggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacaygtgcagctantgcaggtgatcaagaagacggagacagacatgagtcttcaccygctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgc

SEQ ID NO: 40 - DNA, 1397 bp, Homo sapiens
gtcttgactcatgggtgtattcacaaattctgttacttcaagtctttttcttttaacggattgatcttttgctagatagagacaaaatatcagtgtgaattacagcaaacccctattccatgctgttatgggtgaaactctgggagattctcctattgacscagaaagcgattccttcactgatacactgtctgcaaacatatcacaagaaatgaccatggttgacacagagatgccattctggsccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctcmaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccrtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagcctttwggtgactttatggagcccaagtttgagtttgctgtgaagttcaatgcactggaattagatgacagcgacttggcaatatttattgctgtcattattctcagtggag

SEQ ID NO: 41 - DNA, 1751 bp, Homo sapiens
  misc_feature (1)...(1751): n = A,T,C or G, or insertion/deletion polymorphism (see Tables 1-2)
caggcggggcccagcgcactcggagcccgagcccgagccgcagccgccgcctggggcgcttgggtcggcctcgaggacaccggagaggggcgccacgccgccgtggccgcagaaatgaccatggttgacacagagatgccattctggsccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctcmaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccrtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagcctttwggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacaygtgcagctantgcaggtgatcaagaagacggagacagacatgagtcttcaccygctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgc

SEQ ID NO: 42 - DNA, 1619 bp, Homo sapiens
  misc_feature (1)...(1619): n = A,T,C or G, or insertion/deletion polymorphism (see Tables 1-2)
ttggtggaaggtgggtgtgtagtcgtggtactttacgcctcggtgtttagggaggagcctaaggtaaggagtcagaaacggggagtaaccgagctgcggcttttatataaggtcagtggtaggtaaggaaggggccttwacctctgctggtgaccagaagcctgcatttctgcattctgcttaattccctttccttagatttgaaagaagccaacactaaaccacaaatatacaacaaggccattttctcaaacgagagtcagcctttaacgtctatttttcctttcagaaatgaccatggttgacacagagatgccattctggsccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctcmaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccrtggaggctaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacaygtgcagctantgcaggtgatcaagaagacggagacagacatgagtcttcaccygctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgct

SEQ ID NO: 43 - DNA, 1601 bp, Homo sapiens
tatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagaygtggaagatcttattcaacagcagatttccaacgacacagtcagcccccgagcctccgcatcgtactatgaacagtatcactcactaaatgaaatctattcttggatagaatttataactgagaggcatcctgayatgcttacaaaaatccacattggatcctcatttgagaagtwcccactstatgttttaaaggtttctggaaaagaacaarcagccaaaaatgccatatggattgactgtggaatccatgccagagaatggatctctcctgctttctgcttgtggttcataggccataatcgaatgtggagaaagaaccgttctttctatgcgaacaatcattgcatyggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaaytagtaaaaataccaggtatacacatggccatggctcagaaaccttatacctagctcctggaggtggggacgattggatctatgatttgggcatcaaatattccgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcarattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaastttcgacgtttgactagccatctcaagcaagtttavtcaawgatcatctcacgctgatcattggatcctactcaacaaaaggaagggtggtcagaagtacattaaagatttctgctccaaattttcaataaatttctkcttstgcctttaraaataca

SEQ ID NO: 44 - DNA, 1984 bp, Homo sapiens
tatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagaygtggaagatcttattcaacagcagatttccaacgacacagtcagcccccgagcctccgcatcgtactatgaacagtatcactcactaaatgaaatctattcttggatagaatttataactgagaggcatcctgayatgcttacaaaaatccacattggatcctcatttgagaagtwcccactstatgttttaaaggtttctggaaaagaacaarcagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccrgtggttaatgtggayggttatgactactcatggaaaaagaatcgaatgtggagaaagaaccgttctttctatgcgaacaatcattgcatyggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaaytagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcarattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaastttcgacgtttgactagccatctcaagcaagtttavtcaawgatcatctcacgctgatcattggatcctactcaacaaaaggaagggtggtcagaagtacattaaagatttctgctccaaattttcaataaatttctkcttstgcctttaraaatacaaccatgcattccgtttgctccacggtaattaggcgatggcccagaaaggggaggggtgtcaaaaacgacaaacatagcctctcattccagctcagctgctcaataaacactgttgaacgaatgaatgagtggctctaggtactgtcaacaaatgccgcattttgcgcatttacaacagctgtttatggtaaggaattatgtaataaaaagagaaaactca

SEQ ID NO: 45 - DNA, 2418 bp, Homo sapiens
atcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggcygcgtaggggcgctttgttttgttcggttttgtttttttgagagtgcgagagaggcggtcgtgcagacccgggagaaagatgtcaaacgtgcgagtgtctaacgggagccctagcctggagyggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgkcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcargtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttyttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttmaaggaaggttcatgtagagaaaagcacacttgtaggataagtgaaatggatactacatctttaaacagtatttcattgcctgtgtatkgaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagct

SEQ ID NO: 46 - DNA, 1617 bp, Homo sapiens
catataagacatgaattccatgagtaaaatcaaacttctgtggcaaggaaacctctctgagtctcgatttcctccgtggtaaaaaggagagggttaaaccacagggtcccgagggtcccttccagctgtcacattctggagcgtatgagatgagattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcargtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttyttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttmaaggaaggttcatgtagagaaaagcacacttgtaggataagtgaaatggatactacatctttaaacagtatttcattgcctgtgtatkgaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagct

SEQ ID NO: 47 - DNA, 2984 bp, Homo sapiens
gcgccccagtcgacgctgagctcctctgctactcagagttgcaacctcmgcctmgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccawgttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaasgagctgaaacgggagccagctgtgggggagcccgctgaggtcacgaccacggtgctggtgaggagagatcaccatggagccaatttctcgtgccgcactgaactggacctgcgsscccaagggctggagctgtttgagaacacctcggccccctaccagctccagacctttgtcctgccagcgactcccccacaacttgtcagcccccgggtcctagaggtggacacgcaggggacmgtggtctgttccctggacrgkctgttcccagtctcggaggcccaggtccacctggcactgggggaccagaggttgaaccccacagtcacctatggcaacgactccttctcggccaaggcctcagtcagtgtgaccgcagaggaygagggcacccagcggctgacgtgtgcagtaatactggggaaccagagccaggagacactgcagacagtgaccatctacagctttccggcgcccaacrtgattctgacgaagccagaggtctcagaagggaccgaggtgacagtgaagtgtgaggcccaccctagagccaaggtgacgctgaatggggttccagcccagccactgggccygagggcccagctcctgctgaaggccaccccagaggacaacgggcgcagcttctcctgctctgcaaccctggaggtggccggccagcttatacacaagaaycagacccgggagcttcgtgtcctgtatggcccccractggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcraggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccrggacagggcctcttcctcggccttcccatattggtggcagtggtgccacactgaacagagtggaagacatatgccatgcagctacacctacyggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggycccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctratcacattcaaggtcaccaggtacagttgtacaggttgtacactgcaggagagtgcctggcaaaaagatcaratggggctgggacttctcattggccaacctgcctttccccagaaggagtgatttttctaycggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcktgtgtgtgtgtgtgtatgtgtagacaagctctckctctgtcacccaggctggagtgcagtggtgcaatcatggttcactgcagtcttgaccttttgrgctcaagtgatcctcccacctcagcctcctgagtagctgggaccataggctcacaacaccacacctggcaaatttgattttttttttttttyyagagayggggtctygcaacattgcccagacttcctttgtgttagttaataaagctttctcaactgcc

SEQ ID NO: 48 - DNA, 1741 bp, Homo sapiens
crtgtttttccagatggcccccractggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcragccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccrggacagggcctcttcctcggccttcccatattggtggcagtggtgccacactgaacagagtggaagacatatgccatgcagctacacctacyggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggycccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctratcacattcaaggtcaccaggtacagttgtacaggttgtacactgcaggagagtgcctggcaaaaagatcaratggggctgggacttctcattggccaacctgcctttccccagaaggagtgatttttctaycggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcktgtgtgtgtgtgtgtatgtgtagacaagctctckctctgtcacccaggctggagtgcagtggtgcaatcatggttcactgcagtcttgaccttttgrgctcaagtgatcctcccacctcagcctcctgagtagctgggaccataggctcacaacaccacacctggcaaatttgattttttttttttttyyagagayggggtctygcaacattgcccagacttcctttgtgttagttaataaagctttctcaactgcc

SEQ ID NO: 49 - DNA, 2317 bp, Homo sapiens
gtgggaggggaggggtgggctgggccagctggagcctgggcagagagtgaggagcacccaagtggggccagaggaacgttgtgtgtggcagcaaggagcccgcagaggaacatggygctgctctgggggctcctggtgctcagctggtcctgcctgcaaggcccctgctccgtgttctcccctgtgagcgccatggagcccttgggcyggcagctaactagcgggccgaaccaggagcaggtgtccccacttaccctcctcaagttgggcaaccaggagcctggtggccagactgcyctgaagagtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcrtgaaccgccccttcctcttcttcatcttcgaggacaccacaggccttcccctcttcgtgggcagcgtgargaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaacckgctttgtggcactggggcaggggccgggggcagtctgagagaggccattctttcccaacacctcttggggagtttagggtggsggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 50 - DNA, 2389 bp, Homo sapiens
agcccgcagaggtatgaggggaggggctgctcggcctgctccttgggtaggagaggaggagggagctgcctccctggctgaggggtctgggatttattcaggaggcctgtcactccccagcctctyctgggacttgaaaaactggagcctgttcttggcaagaagattctaatgcccaggaacatggygctgctctgggggctcctggtgctcagctggtcctgcctgcaaggcccctgctccgtgttctcccctgtgagcgccatggagcccttgggcyggcagctaactagcgggccgaaccaggagcaggtgtccccacttaccctcctcaagttgggcaaccaggagcctggtggccagactgcyctgaagagtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcrtgaaccgccccttcctcttcttcatcttcgaggacaccacaggccttcccctcttcgtgggcagcgtgargaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaacckgctttgtggcactggggcaggggccgggggcagtctgagagaggccattctttcccaacacctcttggggagtttagggtggsggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 51 - DNA, 2487 bp, Homo sapiens
agaaatacagaattagccaggcgtggtggtgcatgcctgtaatcccagctattcgggaggctgaagcaggagaatcgcttgaacctgggaggtggaggttgcggtgagccgagatcctgccactgcactccagcctggtcaacgagagcgaaactccgtctcaaaaaataaacaacaaaaaatcccaaaaagacggtcttattttggtcctcaccatgcatgtgagaagagtgagggacttgtgccaccgtttkacaagctttctgtccctgccacaggaacatggygctgctctgggggctcctggtgctcagctggtcctgcctgcaaggcccctgctccgtgttctcccctgtgagcgccatggagcccttgggcygcagctaactagcgggccgaaccaggagcaggtgtccccacttaccctcctcaagttgggcaaccaggagcctggtggccagactgcyctgaagagtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcrtgaaccgccccttcctcttcttcatcttcgaggacaccacaggccttcccctcttcgtgggcagcgtgargaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaacckgctttgtggcactggggcaggggccgggggcagtctgagagaggccattctttcccaacacctcttggggagtttagggtggsggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 52 - DNA, 2210 bp, Homo sapiens
gaacatggygctgctctgggggctcctggtgctcagctggtcctgcctgcaaggcccctgctccgtgttctcccctgtgagcgccatggagcccttgggcyggcagctaactagcgggccgaaccaggagcaggtgtccccacttaccctcctcaagttgggcaaccaggagcctggtggccagactgcyctgaagagtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcrtgaaccgccccttcctcttcttcatcttcgaggacaccacaggccttcccctcttcgtgggcagcgtgargaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaacckgctttgtggcactggggcaggggccgggggcagtctgagagaggccattctttcccaacacctcttggggagtttagggtggsggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 53 - DNA, 1024 bp, Homo sapiens
atgcatgtgagaagagtgagggacttgtgccaccgtttkacaaggcacaggggctgtgacaaggccttcaacacagaacctggagctgaccccttgacctccctgacccctgatctgtccytgcaggagcctggtggccagactgcyctgaagagtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtttctggaggaacaagtttgacccgagccttacccagagagactccttccacctggacgagcagttcacggtgcccgtggaaatgatgcaggcccgcacgtacccgctgcgctggttcttgctggagcagcctgagatccagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgcagccggcaacagggcggctcagaacagcgccagcctcctggtttgggagaagaactggcaattagggagtttgtggagcttctaattacacaccagcccctctgccaggagctggtgcccgccagccgggggcaggctgcygggagtacccagctccagctggagacagtcagtgcctgaggatttgggggaagcaggtggggaaaccttggcacagggctgacaccttcctctgtgccagagcccaggagctggggcagcgtgggtga

SEQ ID NO: 54 - DNA, 2023 bp, Homo sapiens
caatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagasataaagctgttgcccaatgagccttctttctgccctccagayccacggtgctaattccccttccgatgacctaatgattctgagcttggcaaaggtcttatctcccagctckcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagagkcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaayggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccrggagcgggtctacttcttcaaggggaaacagtactgggagtaccagttccagcaccagcccagtcaggaggagtgtgaaggcagctcyctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaycagaactcccgccggccatcccgcgccaygtggctgtccttgttctccagtgaggagagcaacttgggagccaacaactatgatgactacaggatggactggcttgtgcctgccacctgtgaacccatccagagtgtcttcttcttctctggagacaagtactaccgagtcaaycttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagyccaataaaggtcccttagccccgagtttaaaa

SEQ ID NO: 55 - DNA, 4708 bp, Homo sapiens
gttccggaattgaggggtggttgtagtggtggcttaggaataccctcccggctatcgcttcagtgggtagaggggaccactgcccgagagctttaatggagctgggtcctgccttcgcgctgaggagcccycgttttcgagatcaggcctgaccgggataagctccagagattcaccaacaatagcaaattacasactggcttggaaagyactcccatgttccgtttgatcttggcartttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctcyagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctraaagagaggattttggtgctcaagatgcaacaaaactggatacgtgggtttttgataatgttaaggacttctttcatcatgccagaaacaaccagtctttgttttctaaaataaatgaagagaaaatagtttttttyttacatttattaggaatagatacaaacggacatgctcatcgaccatcctcgagagactacaagsacaatattaaaaaagttgatgatggagttaaagaaatcgtgtctatgtttaaccayttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaaytggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgaygaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttwtaaaaggtgttagtaaagaagtgaagaaaccaagccatctcctgccttgtagttttgtagctattggcattttagtagcrttttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctrtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctrttacaggtgctgagcacagtgctctccatgtatgttgtgtatagcactcagagtagtytrctcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatcttkttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctrtccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaag

SEQ ID NO: 56 - DNA, 4864 bp, Homo sapiens
agcagcagcggccgggcaggtrttgggggcgttccggaattgaggggtggttgtagtggtggcttaggaataccctcccggctatcgcttcagtgggtagaggggaccactgcccgagagctttaatggagctgggtcctgccttcgcgctgaggagcccycgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagagattcaccaacaatagcaaattacasactggcttggaaagyactcccatgttccgtttgatcttggcartttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctcyagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctraaagagaggattttggtgctcaagatgcaacaaaactggatacgtgggtttttgataatgttaaggacttctttcatcatgccagaaacaaccagtctttgttttctaaaataaatgaagagaaaatagtttttttyttacatttattaggaatagatacaaacggacatgctcatcgaccatcctcgagagactacaagsacaatattaaaaaagttgatgatggagttaaagaaatcgtgtctatgtttaaccayttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaaytggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgaygaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttwtaaaaggtgttagtaaagaagtgaagaaaccaagccatctcctgccttgtagttttgtagctattggcattttagtagcrttttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctrtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctrttacaggtgctgagcacagtgctctccatgtatgttgtgtatagcactcagagtagtytrctcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatcttkttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctrtccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaag

SEQ ID NO: 57 - DNA, 3692 bp, Homo sapiens
gttccggaattgaggggtggttgtagtggtggcttaggaataccctcccggctatcgcttcagtgggtagaggggaccactgcccgagagctttaatggagctgggtcctgccttcgcgctgaggagcccycgttttcgagatcaggcctgaccgggataagctccagagattcaccaacaatagcaaattacasactggcttggaaagyactcccatgttccgtttgatcttggcartttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctcyagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctraaagagaggattttggtgctcaagatgcaacaaaactggatacgtgggtttttgataatgttaaggacttctttcatcatgccagaaacaaccagtctttgttttctaaaataaatgaagagaaaatagtttttttyttacatttattaggaatagatacaaacggacatgctcatcgaccatcctcgagagactacaagsacaatattaaaaaagttgatgatggagttaaagaaatcgtgtctatgtttaaccayttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaaytggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgaygaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttwtaaaaggtgttagtaaagaagtgaagaaaccaagccatctcctgccttgtagttttgtagctattggcattttagtagcrttttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctrtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctrttacaggtgctgagcacagtgctctccatgtatgttgtgtatagcactcagagtagtytrctcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatcttkttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtcctttttagtgctatttctcaggttttctcagtcaaccagctagatgcatgtgatgcatgtctrtccttcactttttttttttcatttctggattttcctgggatttctgacaac

SEQ ID NO: 58 - DNA, 4787 bp, Homo sapiens
agcagcagcggccgggcaggtrttgggggcgttccggaattgaggggtggttgtagtggtggcttaggaataccctcccggctatcgcttcagtgggtagaggggaccactgcccgagagctttaatggagctgggtcctgccttcgcgctgaggagcccycgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagctgttcttgaagactaattagttacactggatatgctgctgttctttactttgggattgcttatacattttgtgttcttcgcctccatctttgacatttattttacatctcctttggttcatggaatgactcctcagtttacaccattgcctcctcyagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctraaagagaggattttggtgctcaagatgcaacaaaactggatacgtgggtttttgataatgttaaggacttctttcatcatgccagaaacaaccagtctttgttttctaaaataaatgaagagaaaatagtttttttyttacatttattaggaatagatacaaacggacatgctcatcgaccatcctcgagagactacaagsacaatattaaaaaagttgatgatggagttaaagaaatcgtgtctatgtttaaccayttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaaytggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgaygaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttwtaaaaggtgttagtaaagaagtgaagaaaccaagccatctcctgccttgtagttttgtagctattggcattttagtagcrttttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctrtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctrttacaggtgctgagcacagtgctctccatgtatgttgtgtatagcactcagagtagtytrctcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatcttkttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctrtccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaag

SEQ ID NO: 59 - DNA, 2177 bp, Homo sapiens
ggcccagcaggggcccttgggggtcaggcctgcaggcactcacacttggcacctgctccaaaaccctttcaggtctttgaggatctgrgccctgggcctgggtctcccgccggctcggaaaagctggcctgccgggccagagagagaaccacacgattcagaaaagcagtgcccttcagcagcctctccaccgtctgggctccccaaaggcagagcgggacgctggaaatgwgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggrgcgggcgackggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctaygaagaatagggtgaaaaacctcagaagggaaaactccaaaccagttgggagacttgtgcaaaggactttgcagattaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtrttgctccattcctagcttgggaagcttccgcttagaggtcctggcgcctcggcacagctgccacgggctctcctgggcttatggccggtcacagcctcagtgtgactccrcagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacakaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtaccaa

SEQ ID NO: 60 - DNA, 1936 bp, Homo sapiens
ggcccagcaggggcccttgggggtcaggcctgcaggcactcacacttggcacctgctccaaaaccctttcaggtctttgaggatctgrgccctgggcctgggtctcccgccggctcggaaaagctggcctgccgggccagagagagaaccacacgattcagaaaagcagtgcccttcagcagcctctccaccgtctgggctccccaaaggcagagcgggacgctggaaatgwgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggrgcgggcgackggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccacgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctaygaagaatagggtgaaaaacctcagaagggaaaactccaaaccagttgggagacttgtgcaaaggactttgcagattaaaaaaaaaaaaaaaaaaaatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtrttgctccattcctagcttgggaagcttccgcttagaggtcctggcgcctcggcacagctgccacgggctctcctgggcttatggccggtcacagcctcagtgtgactccrcagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacakaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgc

SEQ ID NO: 61 - DNA, 1289 bp, Homo sapiens
aacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcraccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggrgacagctggaagcctgtcaaagagagagagcaytttccgtgaagtttgaggtccaggctccacgctggsgcaaccsccgtgcgctcagcttcgtactgagttcgctccagctcggggagggggtggagttcgatgtgctgcctgcctttgatgccctgggtcagttgactggcrgctataaacctaacccccaaatctatgtcaagctcatcgaggagtgcacckacctgcagaaagasggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacrgtcttggaattagtcataaactaccagcaactctgcatctactggacaaagtattatgactttaaaamccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacycatgctttaagaattgggatgggtccccagtgagctcctggattctgrtgaaagcaacagtrcagacgatgagaccgacgatcccaggasgtatcagaaatatggttacattggaacacatgagtaccctcatttctctcatagacccagcacactccargcagcatccaccccacaggcagaagaggactggacctgcaccatcctc

SEQ ID NO: 62 - DNA, 1335 bp, Homo sapiens
aacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcraccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggrgacagctggaagcctgtcaaagagagagagcaytttccgtgaagtttgaggtccaggctccacgctggsgcaaccsccgtgcgctcagcttcgtactgagttcgctccagctcggggagggggtggagttcgatgtgctgcctgcctttgatgccctgggtcagttgactggcrgctataaacctaacccccaaatctatgtcaagctcatcgaggagtgcacckacctgcagaaagasggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacrgtcttggaattagtcataaactaccagcaactctgcatctactggacaaagtattatgactttaaaamccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacycatgctttaagaattgggatgggtccccagtgagctcctggattctgctgacccagcacactccargcagcatccaccccacaggcagaagaggactggacctgcaccatcctctgaatgccagtgcatcttgggggaaagggctccagtgttatctggaccagttccttcattttcaggtgggactcttgatccagagargacaaagctcctcagtgagctggtgtataatccaggacagaacccaggtctcc

SEQ ID NO: 63 - DNA, 1469 bp, Homo sapiens
aacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcraccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggrgacagctggaagcctgtcaaagagagagagcaytttccgtgaagtttgaggtccaggctccacgctggsgcaaccsccgtgcgctcagcttcgtactgagttcgctccagctcggggagggggtggagttcgatgtgctgcctgcctttgatgccctgggtcagttgactggcrgctataaacctaacccccaaatctatgtcaagctcatcgaggagtgcacckacctgcagaaagasggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacrgtcttggaattagtcataaactaccagcaactctgcatctactggacaaagtattatgactttaaaamccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacycatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacmccatttattgactgtctgcttcgggctcaggttctgtcctaagccctttaatatgcactctctcattaaatagtcacaacaatcccatgaggca

SEQ ID NO: 64 - DNA, 1649 bp, Homo sapiens
aacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcraccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggrgacagctggaagcctgtcaaagagagagagcaytttccgtgaagtttgaggtccaggctccacgctggsgcaaccsccgtgcgctcagcttcgtactgagttcgctccagctcggggagggggtggagttcgatgtgctgcctgcctttgatgccctgggtcagttgactggcrgctataaacctaacccccaaatctatgtcaagctcatcgaggagtgcacckacctgcagaaagasggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacrgtcttggaattagtcataaactaccagcaactctgcatctactggacaaagtattatgactttaaaamccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacycatgctttaagaattgggatgggtccccagtgagctcctggattctgctgrtgaaagcaacagtrcagacgatgagaccgacgatcccaggasgtatcagaaatatggttacattggaacacatgagtaccctcatttctctcatagacccagcacactccargcagcatccaccccacaggcagaagaggactggacctgcaccatcctctgaatgccagtgcatcttgggggaaagggctccagtgttatctggaccagttccttcattttcaggtgggactcttgatccagagargacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccattta

SEQ ID NO: 65 - DNA, 1525 bp, Homo sapiens
ctgggaggcagttctgttgccactctctctcctgtcaatgatggatctcagaaataccccagccaaatctctggacaagttcattgaagactatctcttgccagacacgtgtttccgcatgcaaatcraccatgccattgacatcatctgtgggttcctgaaggaaaggtgcttccgaggtagctcctaccctgtgtgtgtgtccaaggtggtaaagtcctctcaccacttttcaggatcagttaaatcgccggggagagttcatccaggaaattaggrgacagctggaagcctgtcaaagagagagagcaytttccgtgaagtttgaggtccaggctccacgctggsgcaaccsccgtgcgctcagcttcgtactgagttcgctccagctcggggagggggtggagttcgatgtgctgcctgcctttgatgccctgggtcagttgactggcrgctataaacctaacccccaaatctatgtcaagctcatcgaggagtgcacckacctgcagaaagasggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacrgtcttggaattagtcataaactaccagcaactctgcatctactggacaaagtattatgactttaaaamccccattattgaaaagtacctgagaaggcagctcacgaaacccaggcctgtgatcctggacccggcggaccctacaggaaacttgggtggtggagacccaaagggttggaggcagctggcacaagaggctgaggcctggctgaattacycatgctttaagaattgggatgggtccccagtgagctcctggattctgctgrtgaaagcaacagtrcagacgatgagaccgacgatcccaggasgtatcagaaatatggttacattggaacacatgagtaccctcatttctctcatagacccagcacactccargcagcatccaccccacaggcagaagaggactggacctgcaccatcctctgaatgccagtgcatcttgggggaaagggctccagtgttatctggaccagttccttcattttcaggtgggactcttgatccagagargacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccattta

SEQ ID NO: 66 - DNA, 2296 bp, Homo sapiens
atgggactgggccaagggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacayagctcagaacagctggatcttgctcacactctttcaagagaagcttccttggacaaaaggaccctgccttggtgtgagagtgagggcagagggagctggagcaagtagaatttctctaaataccagctggctggggcccaggagattaaaaaacaccgggctagggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattygtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcagctggggtagggctgggagcagcgtctgctrtgactgggatcaccaccagcatcgtggagcactcatayacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctgga

SEQ ID NO: 67 - DNA, 2183 bp, Homo sapiens
atgggactgggccaagggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacayagctcagaacagctggatcttgctcacactctttcaagagaagcttccttgggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattygtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcagctggggtagggctgggagcagcgtctgctrtgactgggatcaccaccagcatcgtggagcactcatayacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctgga

SEQ ID NO: 68 - DNA, 2086 bp, Homo sapiens
atgggactgggccaagggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacayagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattygtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcagctggggtagggctgggagcagcgtctgctrtgactgggatcaccaccagcatcgtggagcactcatayacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctgga

SEQ ID NO: 69 - DNA, 2412 bp, Homo sapiens
atgggactgggccaagggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacayagctcagaacagctggatcttgctcacactctttcaagagaagcttccttggacaaaaggaccctgccttggtgtgagagtgagggcagagggagctggagcaagtagaatttctctaaataccagctggctggggcccaggagattaaaaaacaccgggctaggttggtcttggcatttgctgacacgcaaagggattgcagagatccagcccctccaacctccctctgtccacaggtggctcacattcagtcccacaatttgctttctcctcctcaagggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattygtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcagctggggtagggctgggagcagcgtctgctrtgactgggatcaccaccagcatcgtggagcactcatayacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctgga

SEQ ID NO: 70 - DNA, 1815 bp, Homo sapiens
tacagcccygccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcrgccagcgcgggcgcggccggagaccgtggggmccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgrgatcgagatcgagaccgggaacgggacagggatcgggagcgggatcgagaccgagaccgagagggtcctttccgcaggtcggattcattccctgaacggcgagcccctaggaaagggaatactctctatgtatatgkagaagacatgacacccacccttctccgtggggccttctctccttttggaaacatcattgacctctccatggacccacccagaaactgtgccttcgtcacctatgaaaagatggagtcagcagatcaggccgttgctgaggttggaacttcccaaatctgttcttcccatcgcttctgctgttctcatgtgttctcctcaaaatactagatgccaggaagaagttggttcctcttgataaagaaagcctctccctattcacacagaaaaactcacattctcagattccttattcagtctcctcctaggatagcaactcctggaataacttctttggtttatctgtaatgttttcctccccatcctctgcctcccctcttctgcttcagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcascacttgggattggggttaarcctttaaaaacrgctgtcaggtttgatctcagtgtaacracatggccagtgcctgttccccactcccttgccccaaaaggatctggaacacagg

SEQ ID NO: 71 - DNA, 1566 bp, Homo sapiens
tacagcccygccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcrgccagcgcgggcgcggccggagaccgtggggmccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgrgatcgagatcgagaccgggaacgggacagggatcgggagcgggatcgagaccgagaccgagagggtcctttccgcaggtcggattcattccctgaacggcgagcccctaggaaagggaatactctctatgtatatgkagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcascacttgggattggggttaarcctttaaaaacrgctgtcaggtttgatctcagtgtaacracatggccagtgcctgttccccactcccttgccccaaaaggatctggaacacag

SEQ ID NO: 72 - DNA, 1434 bp, Homo sapiens
tacagcccygccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcrgccagcgcgggcgcggccggagaccgtggggmccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgaggatcgggagcgggatcgagaccgagaccgagagggtcctttccgcaggtcggattcattccctgaacggcgagcccctaggaaagggaatactctctatgtatatgkagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcascacttgggattggggttaarcctttaaaaacrgctgtcaggtttgatctcagtgtaacracatggccagtgcctgttccccactcccttgccccaaaaggatctggaacacag

SEQ ID NO: 73 - DNA, 4493 bp, Homo sapiens
cgtagcgcccgcagagcaaygcaaagaggaagaacagagaaacggctatgagaaaaagggccgaagagtgagaagcagagggccttacccgagggggcggcaaccggggkccccacggtctccggccgcgcccgcgctggcygctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcrgggctgtaccggaagttscctctacttccgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacrgttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggcyacaacctccttgtctcttcgccggcctccagggccagcctcccagtccttatggggaaatccaactcrgtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtmtgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaayggcatgactctgtctttgtcgcagctcacacatctgcaggaaaaacagttgtggctgaatatgccattgcyctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacrgagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccrtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacagracagggggccagccactgcagaggtgccctatccagatgacctcgtgggattcaagctgttcctgcctgaagggccttgtgaccacaccrtggtcaagctccagccaggagatatggctgccatcaccaccaaggtgctccgggtgaatggggagaagatcttggaggacttcagcaagaggcagcagccaaaattcaagtcagagatgctagggaggcccttctcctccagaggggcacgtagaggcagggaggggcagtggtctgsgagtttcctccagcctgagggagaccatgaagtggtggggttgtagtgagggggctcccccagcctaagggagactgtgaagtggaggttgtagtaagagggcttccacagcctgagggaggcttctgkgggagagaagatcttaccccagatcttaagatctgctccctcttcaggaaggatcctccccttgcagccgtgaccactgctgtccaggaactgctgcgtctggctcaggcccacccagccggacctcccaccctcgaccctgtcaatgacctgcagctcaaagatatgtcagttgtagagggygggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtsgsctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgkatttgcggccagcctctacacccagtgaatgccccatgtaaaaacaygatgataaaacagcaaagcactgttgtgtgcttgagttgctggacagggatgactcasctaagaagacagcgagagaacytyttagaaatatgcttttattatctgcacacagagatatgactgcctccctctaaagcattactatttgggagagggagtcttggggggtgatgggaggtcctgagtcatagcttccacataccatatgggcaggaaggcgtaaggtgcatcttggtgtacagacacggtgactgggccgccaggctcccaagagaagagatgaacgagcctggggggcagatggaggcatcagttg

SEQ ID NO: 74 - DNA, 4711 bp, Homo sapiens
cgtagcgcccgcagagcaaygcaaagaggaagaacagagaaacggctatgagaaaaagggccgaagagtgagaagcagagggccttacccgagggggcggcaaccggggkccccacggtctccggccgcgcccgcgctggcygctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcrgggctgtaccggaagttscctctacttccgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacrgttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggcyacaacctccttgtctcttcgccggcctccagggccagcctcccagtccttatggggaaatccaactcrgtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtmtgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaayggcatgactctgtctttgtcgcagctcacacatctgcaggaaaaacagttgtggctgaatatgccattgcyctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacrgagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccrtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacagracagggggccagccactgcagaggtgccctatccagatgacctcgtgggattcaagctgttcctgcctgaagggccttgtgaccacaccrtggtcaagctccagccaggagatatggctgccatcaccaccaaggtgctccgggtgaatggggagaagatcttggaggacttcagcaagaggcagcagccaaaattcaagtcagagatgctagggaggcccttctcctccagaggggcacgtagaggcagggaggggcagtggtctgsgagtttcctccagcctgagggagaccatgaagtggtggggttgtagtgagggggctcccccagcctaagggagactgtgaagtggaggttgtagtaagagggcttccacagcctgagggaggcttctgkgggagagaagatcttaccccagatcttaagatctgctccctcttcaggaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttaygtggaygaggygggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtsgsctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgkatttgcggccagcctctacacccagtgaatgccccatgtaaaaacaygatgataaaacagcaaagcactgttgtgtgcttgagttgctggacagggatgactcasctaagaagacagcgagagaacytyttagaaatatgcttttattatctgcacacagagatatgactgcctccctctaaagcattactatttgggagagggagtcttggggggtgatgggaggtcctgagtcatagcttccacataccatatgggcaggaaggcgtaaggtgcatcttggtgtacagacacggtgactgggccgccaggctcccaagagaagagatgaacgagcctggggggcagatggaggcatcagttg

SEQ ID NO: 75 - DNA, 4560 bp, Homo sapiens
cgtagcgcccgcagagcaaygcaaagaggaagaacagagaaacggctatgagaaaaagggccgaagagtgagaagcagagggccttacccgagggggcggcaaccggggkccccacggtctccggccgcgcccgcgctggcygctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcrgggctgtaccggaagttscctctacttccgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacrgttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggcyacaacctccttgtctcttcgccggcctccagggccagcctcccagtccttatggggaaatccaactcrgtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtmtgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaayggcatgactctgtctttgtcgcagctcacacatctgcaggaaaaacagttgtggctgaatatgccattgcyctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacrgagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccrtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacagracagggggccagccactgcagaggtgccctatccagatgacctcgtgggattcaagctgttcctgcctgaagggccttgtgaccacaccrtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttaygtggaygaggygggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtsgsctgaaccagacggtggaggaatttgtgggggagctgaattttgggctggttgaggttgtatatgagtgggcccggggcatggtgagtacctgaggtttgggattttgcagacggctggctggggagaacctgcccaggctgagtgcatccagtcctcaccctactttccccacagcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgkatttgcggccagcctctacacccagtgaatgccccatgtaaaaacaygatgataaaacagcaaagcactgttgtgtgcttgagttgctggacagggatgactcasctaagaagacagcgagagaacytyttagaaatatgcttttattatctgcacacagagatatgactgcctccctctaaagcattactatttgggagagggagtcttggggggtgatgggaggtcctgagtcatagcttccacataccatatgggcaggaaggcgtaaggtgcatcttggtgtacagacacggtgactgggccgccaggctcccaagagaagagatgaacgagcctggggggcagatggaggcatcagttg

SEQ ID NO: 76 - DNA, 4466 bp, Homo sapiens
cgtagcgcccgcagagcaaygcaaagaggaagaacagagaaacggctatgagaaaaagggccgaagagtgagaagcagagggccttacccgagggggcggcaaccggggkccccacggtctccggccgcgcccgcgctggcygctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcrgggctgtaccggaagttscctctacttccgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacrgttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggcyacaacctccttgtctcttcgccggcctccagggccagcctcccagtccttatggggaaatccaactcrgtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtmtgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaayggcatgactctgtctttgtcgcagctcacacatctgcaggaaaaacagttgtggctgaatatgccattgcyctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacrgagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccrtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacagracagggggccagccactgcagaggtgccctatccagatgacctcgtgggattcaagctgttcctgcctgaagggccttgtgaccacaccrtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttaygtggaygaggygggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtsgsctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgkatttgcggccagcctctacacccagtgaatgccccatgtaaaaacaygatgataaaacagcaaagcactgttgtgtgcttgagttgctggacagggatgactcasctaagaagacagcgagagaacytyttagaaatatgcttttattatctgcacacagagatatgactgcctccctctaaagcattactatttgggagagggagtcttggggggtgatgggaggtcctgagtcatagcttccacataccatatgggcaggaaggcgtaaggtgcatcttggtgtacagacacggtgactgggccgccaggctcccaagagaagagatgaacgagcctggggggcagatggaggcatcagttg

SEQ ID NO: 77 - DNA, 1827 bp, Homo sapiens
cgactccacaggccctcgcttccgccgcctcttaactccaaaggtctccgggatcaggtgatgcctcttccagctcatatcccgggattttatggtaccggggaaggggtaggaatggagggaagagaacctgaaaatagggtcttccggcgcagagcagtgacgtacggtctccccgggcgtccctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtgkccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcacctwctctgcccacagaccctgccctctaytctgggccctttcctttctaccggcgcccttcggaactgggctgcttctccctggatgctcaacgccagtaccatggagwwgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaycgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccracctgctatgtggagctcaagacctccaaggagatgcahagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaarargttctc

SEQ ID NO: 78 - DNA, 2074 bp, Homo sapiens
cgactccacaggccctcgcttccgccgcctcttaactccaaaggtctccgggatcaggtgatgcctcttccagctcatatcccgggattttatggtaccggggaaggggtaggaatggagggaagagaacctgaaaatagggtcttccggcgcagagcagtgacgtacggtctccccgggcgtccctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtgkccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggtaactggattcttgatctgagcgcagacgtccttcctaacctcactgcatttggaggacctggagggagggtgggtgaagggcaaggaaagaggcaggatgagagcttggccgcggtggcgtctgaggggcctgaatgtttcaaggccagagcctggcgatcaggtggctcgcttagtcckaaaccagtcatccttctccaggcctcctctgtagaatggaaactctgtacccctgcttgtcttaggacctcatggatcccagggggaccaagagaggagctgagaagacagaggtagctgagcctcggaacaaactacctcgtccagcacctwctctgcccacagaccctgccctctaytctgggccctttcctttctaccggcgcccttcggaactgggctgcttctccctggatgctcaacgccagtaccatggagwwgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaycgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccracctgctatgtggagctcaagacctccaaggagatgcahagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaarargttctc

SEQ ID NO: 79 - DNA, 2176 bp, Homo sapiens
cgactccacaggccctcgcttccgccgcctcttaactccaaaggtctccgggatcaggtgatgcctcttccagctcatatcccgggattttatggtaccggggaaggggtaggaatggagggaagagaacctgaaaatagggtcttccggcgcagagcagtgacgtacggtctccccgggcgtccctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtgkccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcacctwctctgcccacagaccctgccctctaytctgggccctttcctttctaccggcgcccttcggaactgggctgcttctccctggatgctcaacgccagtaccatggagwwgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaycgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcaggtgagttgcccctgcttcatagcccccttccccttcccagaggttgagagcccsccamkcctgctgctgcttctctccttgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccracctgctatgtggagctcaagacctccaaggagatgcahagccctggccaatggaggagtttctacaggttcaggatcggggtgggcagggcgagassttaggcttgaaggctgggaaagggacttggggaggagggtgaaggcagaatggagggtgcacgaggggtcccactgatcccttgcttttcctgtcagacacaagctcctgaaatggtgggctcagtcattcctcccaggggtcccgaatgttgttgctggcttccgtaacccagacggttttgtctcttccctcaagacctttcctaccatgaagatgtttgaatatgtcagggtaagggaacgaygttgcagctcccacccgtatccccaaacaccaasrccacaggtctagcatccagggcaacagcctgccttctctcctcccaccacccccactgcccatcttctgcctcctcctctgcctgctccagaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaarargtt

SEQ ID NO: 80 - DNA, 1861 bp, Homo sapiens
cgactccacaggccctcgcttccgccgcctcttaactccaaaggtctccgggatcaggtgatgcctcttccagctcatatcccgggattttatggtaccggggaaggggtaggaatggagggaagagaacctgaaaatagggtcttccggcgcagagcagtgacgtacggtctccccgggcgtccctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtgkccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggtaactggattcttgatctgagcgcagacgtccttcctaacctcactgcatttggaggacctggagggagggtgggtgaagggcaaggaaagaggcaggatgagagcttggccgcggtggcgtctgaggggcctgaatgtttcaaggccagagcctggcgatcaggtggctcgcttagtcckaaaccagtcatccttctccaggcctcctctgtagaatggaaactctgtacccctgcttgtcttaggacctcatggatcccagggggaccaagagaggagctgagaagacagaggtagctgagcctcggaacaaactacctcgtccagcacctwctctgcccacagaccctgccctctaytctgggccctttcctttctaccggcgcccttcggaactgggctgcttctccctggatgctcaacgccagtaccatggagwwgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaycgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaarargtt

SEQ ID NO: 81 - DNA, 1614 bp, Homo sapiens
cgactccacaggccctcgcttccgccgcctcttaactccaaaggtctccgggatcaggtgatgcctcttccagctcatatcccgggattttatggtaccggggaaggggtaggaatggagggaagagaacctgaaaatagggtcttccggcgcagagcagtgacgtacggtctccccgggcgtccctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtgkccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcacctwctctgcccacagaccctgccctctaytctgggccctttcctttctaccggcgcccttcggaactgggctgcttctccctggatgctcaacgccagtaccatggagwwgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaycgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaarargtt

SEQ ID NO: 82 - DNA, 2543 bp, Homo sapiens
tagtcatatcttacttggatgaagccaaggttggcctggggtgacctgagggactggggcctatgtgtccatctttctagaatcgcccggaactgaggactgagagggtagggtattgtggtctatgggaactacagaccatagcgcatggtccatcactgtccagagcccaagggacccatcgggaccattgttctattcccttgcggctgcggttttctctgccttggcccagcctgcctcgcgccagctctggcatgggaccacaatgcgctgccttgccctggaaaagggtccagctggcagcctcgctgctccccgccttgatataatgctgcgctctcaagtggcaggtcgagtctccccagaggacgcctgagagcgaccgcgctccgcccaggattctctacggcctcggggccgctaagccccgcccatagttccgcccatccgagaatttgtccaatccaggcgaagtattcacgctccgcccaargttttgtgttgtcacttccggcccgctccaggaagtcgtgctgcggagccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggttggcaaaagaaccattatcaataagctcttctttgatcttgcccaggaggaggagaatgtcttggatgcagaattcttaaagaatgaactggacaatgtcagagcccagctttcccagaaagacaaggagaaacgagacagccaggtcatcatcgacactctgcgggatacgctggaagaacgcaatgctactgtggtatctctgcagcaggccttgggcaaggccgagatgctgtgctccacactgaaaaagcagatgaagtacttagagcagcagcaggatgagaccaaacaagcacaagaggaggcccgccggctcaggagcaagatgaagaccatggagcagattgagcttctactccagagccagcgccctgaggtggaggagatgatccgagacatgggtgtgggacagtcagcggtggaacagctggctgtgtactgtgtgtctctcaagaaagagtacgagaatctaaaagaggcacggaaggcctcaggggaggtggctgacaagctgaggaaggatttgttttcctccagaagcaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctactgacacagtcatgatccgcccattgcctgttaagcccaagaccaaggttaagcagagggtgagggtgaagacmgtgccttctctcttccaggccaagctggacaccttcctgtggtcgtgagaacagtgagtctgaccaatggccagacacatgcctgcaacttgtaggtcaaggactgtccaggcaggggttttgtggacagagcccyactttcgggaccagcctgaggtgtaagggcagacaaacaggtgagggtgagtgtgrcacccagagactgctcttcctgccctcaccctgccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaa

SEQ ID NO: 83 - DNA, 1513 bp, Homo sapiens
atgaatcaggaagacccagggtggagaggaggagtagtcgcccaaggtccttggccattcctattgtgtgtccctgccttatgggagaccacgtggaggtcagctatgatgctttcctgctgcttattgtgggtattgcctttcagaatgaactggacaatgtcagagcccagctttcccagaaagacaaggagaaacgagacagccaggtcatcatcgacactctgcgggatacgctggaagaacgcaatgctactgtggtatctctgcagcaggccttgggcaaggccgagatgctgtgctccacactgaaattgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctactgacacagtcatgatccgcccattgcctgttaagcccaagaccaaggttaagcagagggtgagggtgaagacmgtgccttctctcttccaggccaagctggacaccttcctgtggtcgtgagaacagtgagtctgaccaatggccagacacatgcctgcaacttgtaggtcaaggactgtccaggcaggggttttgtggacagagcccyactttcgggaccagcctgaggtgtaagggcagacaaacaggtgagggtgagtgtgrcacccagagactgctcttcctgccctcaccctgccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaa

SEQ ID NO: 84 - protein, 485 aa, Homo sapiens
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLMGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 85 - protein, 485 aa, Homo sapiens; identical to SEQ ID NO: 84

SEQ ID NO: 86 - protein, 350 aa, Homo sapiens
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 87 - protein, 36 aa, Homo sapiens
MTAVGLECSPPCEIIVRATLICLRMLYSTTHNCSIF

SEQ ID NO: 88 - protein, 1367 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 89 - protein, 1368 aa, Homo sapiens [sequence omitted]

SEQ ID NO: 90 - protein, 260 aa, Homo sapiens
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 91 - protein, 260 aa, Homo sapiens; identical to SEQ ID NO: 90

SEQ ID NO: 92 - protein, 260 aa, Homo sapiens; identical to SEQ ID NO: 90

SEQ ID NO: 93 - protein, 295 aa, Homo sapiens [sequence omitted]

SEQ ID NO: 94 - protein, 258 aa, Homo sapiens
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 95 - protein, 305 aa, Homo sapiens [sequence omitted]

SEQ ID NO: 96 - protein, 149 aa, Homo sapiens
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRGWSAVAPSWLTAASTSWAQVILLPQPPM

SEQ ID NO: 97 - protein, 364 aa, Homo sapiens
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 98 - protein, 169 aa, Homo sapiens
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPEGASRAGGDQNRPAGLRLGCPWNYLH

SEQ ID NO: 99 - protein, 368 aa, Homo sapiens
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVCDCVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 100 - protein, 44 aa, Homo sapiens
MMPPPRYNPHPVTNKQGLQRHACLPQFGTTLPGQPSLKALHRNR

SEQ ID NO: 101 - protein, 55 aa, Homo sapiens
MTRVALQAEKLDHHPEWFNVYNKVHITLSTHECAGLSERDINLASFIEQVAVSMT

SEQ ID NO: 102 - protein, 104 aa, Homo sapiens
MAGKAHRLSAEERDQLLPNLRAVGWNELEGRDAIFKQFHFKDFNRAFGFMTRVALQAEKLDHHPEWFNVYNKVHITLSTHECAGLSERDINLASFIEQVAVSMT

SEQ ID NO: 103 - protein, 104 aa, Homo sapiens
MAGKAHRLSAEERDQLLPNLRAVGWNELEGRDAIFKQFHFKDFNRAFGFMTRVALQAEKLDHHPEWFNVYNKVSRLQASGVQQYHLLSWFSSLPTTDLGTCQPP

SEQ ID NO: 104 - protein, 216 aa, Homo sapiens
MLPCPIPFSPSRLLIPPFPSFPSNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 105 - protein, 262 aa, Homo sapiens
MWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 106 - protein, 250 aa, Homo sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 107 - protein, 282 aa, Homo sapiens
MQRLRWLRDWKSSGRGLTAAKEPGARSSPLQAMRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 108 - protein, 359 aa, Homo sapiens [sequence omitted]

SEQ ID NO: 109 - protein, 317 aa, Homo sapiens [sequence omitted]

SEQ ID NO: 110 - protein, 317 aa, Homo sapiens [sequence omitted]

SEQ ID NO: 111 - protein, 247 aa, Homo sapiens [sequence omitted]

SEQ ID NO: 112 - protein, 705 aa, Homo sapiens [sequence omitted]

SEQ ID NO: 113 - protein, 706 aa, Homo sapiens
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 114 - protein, 460 aa, Homo sapiens [sequence omitted]

SEQ ID NO: 115 - protein, 706 aa, Homo sapiens; identical to SEQ ID NO: 113

SEQ ID NO: 116 - protein, 2144 aa, Homo sapiens [sequence omitted]

SEQ ID NO: 117 - protein, 2036 aa, Homo sapiens [sequence omitted]

SEQ ID NO: 118 - protein, 2036 aa, Homo sapiens [sequence omitted]

SEQ ID NO: 119 - protein, 2036 aa, Homo sapiens [sequence omitted]

SEQ ID NO: 120 - protein, 408 aa, Homo sapiens
MPSLLTTMKNTSELVSSEVYLLSALAALQKVVETLPHFISPYLEGILSQVIHLEKITSEMGSASQANIRLTSLKKTLATTLAPRVLLPAIKKTYKQIEKNWKNHMGPFMSILQEHIGVMKKEELTSHQSQLTAFFLEALDFRAQHSENDLEEVGKTENCIIDCLVAMVVKLSEVTFRPLFFKLFDWAKTEDAPKDRLLTFYNLADCIAEKLKGLFTLFAGHLVKPFADTLNQVNISKTDEAFFDSENDPEKCCLLLQFILNCLYKIFLFDTQHFISKERAEALMMPLVDQLENRLGGEEKFQERVTKHLIPCIAQFSVAMADDSLWKPLNYQILLKTRDSSPKVRFAALITVLALAEKLKENYIVLLPESIPFLAELMEDECEEVEHQCQKTIQQLETVLGEPLQSYF

SEQ ID NO: 121 - protein, 2044 aa, Homo sapiens [sequence omitted]

SEQ ID NO: 122 - protein, 505 aa, Homo sapiens
MGETLGDSPIDPESDSFTDTLSANISQEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 123 - protein, 424 aa, Homo sapiens
  VARIANT (1)...(424): Xaa = Any Amino Acid
MGETLGDSPIDPESDSFTDTLSANISQEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGX

SEQ ID NO: 124 - protein, 477 aa, Homo sapiens
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 125 - protein, 297 aa, Homo sapiens [sequence omitted]

SEQ ID NO: 126 - protein, 360 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKTSKNTRYTHGHGSETLYLAPGGGDDWIYDLGIKYSVTSNPPVEKLLPLSLK

SEQ ID NO: 127 - protein, 423 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKTSKNTRYTHGHGSETLYLAPGGGDDWIYDLGIKYSFTIELRDTGTYGFLLPERYIKPTCREAFAAVSKIAWHVIRNV

SEQ ID NO: 128 - protein, 198 aa, Homo sapiens
MSNVRVSNGSPSLERMDARQAEHPKPSACRNLFGPVDHEELTRDLEKHCRDMEEASQRKWNFDFQNHKPLEGKYEWQEVEKGSLPEFYYRPPRPPKGACKVPAQESQDVSGSRPAAPLIGAPANSEDTHLVDPKTDPSDSQTGLAEQCAGIRKRPATDDSSTQNKRANRTEENVSDGSPNAGSVEQTPKKPGLRRRQT

SEQ ID NO: 129 - protein, 53 aa, Homo sapiens
MFPCLSDTSLLDEARKIYMKILKIHIADFMEWTSCISTEKQQHNNTKILGTLK

SEQ ID NO: 130 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 131 - protein, 63 aa, Homo sapiens
MCQAWGNPLPELKCLKDGTFPLPIGESVTVTRDLEGTYLCRARSTQGEVTRKPPGMRLSSSLW

SEQ ID NO: 132 - protein, 491 aa, Homo sapiens
MALLWGLLVLSWSCLQGPCSVFSPVSAMEPLGWQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 133 - protein, 495 aa, Homo sapiens [sequence omitted]

SEQ ID NO: 134 - protein, 513 aa, Homo sapiens
MHVRRVRDLCHRFTSFLSLPQEHGAALGAPGAQLVLPARPLLRVLPCERHGALGLQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 135 - protein, 491 aa, Homo sapiens; identical to SEQ ID NO: 132

SEQ ID NO: 136 - protein, 279 aa, Homo sapiens
MHVRRVRDLCHRFTRHRGCDKAFNTEPGADPLTSLTPDLSLQEPGGQTALKSPPGVCSRDPTPEQTHRLARAMMAFTADLFSLVAQTSTCPNLILSPLSVALALSHLALGFWRNKFDPSLTQRDSFHLDEQFTVPVEMMQARTYPLRWFLLEQPEIQNNMSFVVLVPTHFEWNVSQVLANLSWDTLHPPLVWERPTKVRLPKLYLKHQMDLVATLSQLGLQELFQAPDLRGISEQSLVVSGVQHQSTLELSAAGNRAAQNSASLLVWEKNWQLGSLWSF

SEQ ID NO: 137 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 138 - protein, 931 aa, Homo sapiens
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHHARNNQSLFSKINEEKIVFFLHLLGIDTNGHAHRPSSRDYKHNIKKVDDGVKEIVSMFNHFYGNDGKTTFIFTSDHGMTDWGSHGAGHPSETLTPLVTWGAGIKYPQRVSAQQFDDAFLKEWRLENWKRLDVNQADIAPLMTSLIGVPFPLNSVGILPVDYLNNTDLFKAESMFTNAVQILEQFKVKMTQKKEVTLPFLFTPFKLLSDSKQFNILRKARSYIKHRKFDEVVSLCKELIHLALKGLSYYHTYDRFFLGVNVVIGFVGWISYASLLIIKSHSNLIKGVSKEVKKPSHLLPCSFVAIGILVAFFLLIQACPWTYYVYGLLPLPIWYAVLREFQVIQDLVVSVLTYPLSHFVGYLLAFTLGIEVLVLSFFYRYMLTAGLTAFAAWPFLTRLWTRAKMTSLSWTFFSLLLAVFPLMPVVGRKPDISLVMGAGLLVLLLSLCVVTSLMKRKDSFIKEELLVHLLQVLSTVLSMYVVYSTQSSLLRKQGLPLMNQIISWATLASSLVVPLLSSPVLFQRLFSILLSLMSTYLLLSTGYEALFPLVLSCLMFVWINIEQETLQQSGVCCKQKLTSIQFSYNTDITQFRQLYLDDIRRAFFLVFFLVTAFFGTGNIASINSFDLASVYCFLTVFSPFMMGALMMWKILIPFVLVMCAFEAVQLTTQLSSKSLFLIVLVISDIMALHFFFLVKDYGSWLDIGTSISHYVIVMSMTIFLVFLNGLAQLLTTKKLRLCGKPKSHFM

SEQ ID NO: 139 - protein, 931 aa, Homo sapiens; identical to SEQ ID NO: 138

SEQ ID NO: 140 - protein, 931 aa, Homo sapiens; identical to SEQ ID NO: 138

SEQ ID NO: 141 - protein, 931 aa, Homo sapiens; identical to SEQ ID NO: 138

SEQ ID NO: 142 - protein, 181 aa, Homo sapiens
KRPGRAEGGCGESAETSAERSARPQTALGIHRRRSRSQQSRKARPGQRKPSRAGWRLRAAAPTGQRPPHVPAPTPRPSGQHEAPGGRAAPAAAGAVHRACGRVQMQVLPEGTQDPLQRREEAGNEAKVPALRGEDGYHHHQERVQVPRSGALPAPQAAEHQALHQVVQRLEREAQGLRRIG

SEQ ID NO: 143 - protein, 166 aa, Homo sapiens
MSSLAARAGADLKEARAGGGRLWRERGDKRRAQRTATDSPGHPPTAQPEPRPPHVPAPTPRPSGQHEAPGGRAAPAAAGAVHRACGRVQMQVLPEGTQDPLQRREEAGNEAKVPALRGEDGYHHHQERVQVPRSGALPAPQAAEHQALHQVVQRLEREAQGLRRIG

SEQ ID NO: 144 - protein, 399 aa, Homo sapiens
  VARIANT (1)...(399): Xaa = Any Amino Acid
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLKATVQTMRPTIPGRIRNMVTLEHMSTLISLIDPAHSRQHPPHRQKRTGPAPSX

SEQ ID NO: 145 - protein, 414 aa, Homo sapiens [sequence omitted]

SEQ ID NO: 146 - protein, 364 aa, Homo sapiens
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLVRPPASSLPFIPAPLHEA

SEQ ID NO: 147 - protein, 459 aa, Homo sapiens
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLLKATVQTMRPTIPGRIRNMVTLEHMSTLISLIDPAHSRQHPPHRQKRTGPAPSSECQCILGERAPVLSGPVPSFSGGTLDPEKTKLLSELVYNPGQNPGLLTPGLLCPLSYHR

SEQ ID NO: 148 - protein, 215 aa, Homo sapiens
MKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLLKATVQTMRPTIPGRIRNMVTLEHMSTLISLIDPAHSRQHPPHRQKRTGPAPSSECQCILGERAPVLSGPVPSFSGGTLDPEKTKLLSELVYNPGQNPGLLTPGLLCPLSYHR

SEQ ID NO: 149 - protein, 331 aa, Homo sapiens
MDSEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 150 - protein, 331 aa, Homo sapiens; identical to SEQ ID NO: 149

SEQ ID NO: 151 - protein, 402 aa, Homo sapiens [sequence omitted]

SEQ ID NO: 152 - protein, 331 aa, Homo sapiens; identical to SEQ ID NO: 149

SEQ ID NO: 153 - protein, 336 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAEVGTSQICSSHRFCCSHVFSSKY

SEQ ID NO: 154 - protein, 380 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 155 - protein, 336 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESDRLRELGPDGEEAEGPGAGDGPPRSFDWGYEERSGAHSSASPPRSRSRDRSHEDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 156 - protein, 990 aa, Homo sapiens
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTQYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKSEMLGRPFSSRGARRGREGQWSGSFLQPEGDHEVVGL

SEQ ID NO: 157 - protein, 990 aa, Homo sapiens; identical to SEQ ID NO: 156

SEQ ID NO: 158 - protein, 1183 aa, Homo sapiens [sequence omitted]

SEQ ID NO: 159 - protein, 1246 aa, Homo sapiens
MMETERLVLPPPDPLDLPLRAVELGCTGHWELLNLPGAPESSLPHGLPPCAPDLQQEAEQLFLSSPAWLPLHGVEHSARKWQRKTDPWSLLAVLGAPVPSDLQAQRHPTTGQILGYKEVLLENTNLSATTSLSLRRPPGPASQSLWGNPTQYPFWPGGMDEPTITDLNTREEAEEEIDFEKDLLTIPPGFKKGMDFAPKDCPTPAPGLLSLSCLLEPLDLGGGDEDENEAVGQPGGPRGDTVSASPCSAPLARASSLEDLVLKEASTAVSTPEAPEPPSQEQWAIPVDATSPVGDFYRLIPQPAFQWAFEPDVFQKQAILHLERHDSVFVAAHTSAGKTVVAEYAIALAQKHMTRTIYTSPIKALSNQKFRDFRNTFGDVGLLTGDVQLHPEASCLIMTTEILRSMLYSGSDVIRDLEWVIFDEVHYINDVERGVVWEEVLIMLPDHVSIILLSATVPNALEFADWIGRLKRRQIYVISTVTRPVPLEHYLFTGNSSKTQGELFLLLDSRGAFHTKGYYAAVEAKKERMSKHAQTFGAKQPTHQGGPAQDRGVYLSLLASLRTRAQLPVVVFTFSRGRCDEQASGLTSLDLTTSSEKSEIHLFLQRCLARLRGSDRQLPQVLHMSELLNRGLGVHHSGILPILKEIVEMLFSRGLVKVLFATETFAMGVNMPARTVVFDSMRKHDGSTFRDLLPGEYVQMAGRAGRRGLDPTGTVILLCKGRVPEMADLHRMMMGKPSQLQSQFRLTYTMILNLLRVDALRVEDMMKRSFSEFPSRKDSKAHEQALAELTKRLGALEEPDMTGQLVDLPEYYSWGEELTETQHMIQRRIMESVNGLKSLSAGRVVVVKNQEHHNALGVILQVSSNSTSRVFTTLVLCDKPLSQDPQDRGPATAEVPYPDDLVGFKLFLPEGPCDHTVVKLQPGDMAAITTKVLRVNGEKILEDFSKRQQPKFKKDPPLAAVTTAVQELLRLAQAHPAGPPTLDPVNDLQLKDMSVVEGGLRARKLEELIQGAQCVHSPRFPAQYLKLRERMQIQKEMERLRFLLSDQSLLLLPEYHQRVEVLRTLGYVDEAGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTPEGLVVRCIQRLAEMCRSLRGAARLVGEPVLGAKMETAATLLRRDIVFAASLYTQ

SEQ ID NO: 160 - protein, 396 aa, Homo sapiens
MDPRGTKRGAEKTEVAEPRNKLPRPAPSLPTDPALYSGPFPFYRRPSELGCFSLDAQRQYHGDARALRYYSPPPTNGPGPNFDLRDGYPDRYQPRDEEVQERLDHLLCWLLEHRGRLEGGPGWLAEAIVTWRGHLTKLLTTPYERQEGWQLAASRFQGTLYLSEVETPNARAQRLARPPLLRELMYMGYKFEQYMCADKPGSSPDPSGEVNTNVAFCSVLRSRLGSHPLLFSGEVDCTDPQAPSTQPPTCYVELKTSKEMHSPGQWRSFYRHKLLKWWAQSFLPGVPNVVAGFRNPDGFVSSLKTFPTMKMFEYVRNDRDGWNPSVCMNFCAAFLSFAQSTVVQDDPRLVHLFSWEPGGPVTVSVHQDAPYAFLPIWYVEAMTQDLPSPPKTPSPK

SEQ ID NO: 161 - protein, 396 aa, Homo sapiens; identical to SEQ ID NO: 160

SEQ ID NO: 162 - protein, 212 aa, Homo sapiens
MDPRGTKRGAEKTEVAEPRNKLPRPAPSLPTDPALYSGPFPFYRRPSELGCFSLDAQRQYHGDARALRYYSPPPTNGPGPNFDLRDGYPDRYQPRDEEVQERLDHLLCWLLEHRGRLEGGPGWLAEAIVTWRGHLTKLLTTPYERQEGWQLAASRFQGTLYLSEVETPNARAQRLARPPLLRELMYMGYKFEQYMCAGELPLLHSPLPLPRG

SEQ ID NO: 163 - protein, 326 aa, Homo sapiens
MDPRGTKRGAEKTEVAEPRNKLPRPAPSLPTDPALYSGPFPFYRRPSELGCFSLDAQRQYHGDARALRYYSPPPTNGPGPNFDLRDGYPDRYQPRDEEVQERLDHLLCWLLEHRGRLEGGPGWLAEAIVTWRGHLTKLLTTPYERQEGWQLAASRFQGTLYLSEVETPNARAQRLARPPLLRELMYMGYKFEQYMCADKPGSSPDPSGEVNTNVAFCSVLRSRLGSHPLLFSGETFPTMKMFEYVRNDRDGWNPSVCMNFCAAFLSFAQSTVVQDDPRLVHLFSWEPGGPVTVSVHQDAPYAFLPIWYVEAMTQDLPSPPKTPSPK

SEQ ID NO: 164 - protein, 326 aa, Homo sapiens; identical to SEQ ID NO: 163

SEQ ID NO: 165 - protein, 469 aa, Homo sapiens
MPIRALCTICSDFFDHSRDVAAIHCGHTFHLQCLIQWFETAPSRTCPQCRIQVGKRTIINKLFFDLAQEEENVLDAEFLKNELDNVRAQLSQKDKEKRDSQVIIDTLRDTLEERNATVVSLQQALGKAEMLCSTLKKQMKYLEQQQDETKQAQEEARRLRSKMKTMEQIELLLQSQRPEVEEMIRDMGVGQSAVEQLAVYCVSLKKEYENLKEARKASGEVADKLRKDLFSSRSKLQTVYSELDQAKLELKSAQKDLQSADKEIMSLKKKLTMLQETLNLPPVASETVDRLVLESPAPVEVNLKLRRPSFRDDIDLNATFDVDTPPARPSSSQHGYYEKLCLEKSHSPIQDVPKKICKGPRKESQLSLGGQSCAGEPDEELVGAFPIFVRNAILGQKQPKRPRSESSCSKDVVRTGFDGLGGRTKFIQPTDTVMIRPLPVKPKTKVKQRVRVKTVPSLFQAKLDTFLWS

SEQ ID NO: 166 - protein, 103 aa, Homo sapiens
MNQEDPGWRGGVVAQGPWPFLLCVPALWETTWRSAMMLSCCLLWVLPFRMNWTMSEPSFPRKTRRNETARSSSTLCGIRWKNAMLLWYLCSRPWARPRCCAPH

SEQ ID NO: 167 - DNA, 201 bp, Homo sapiens
cggctggatgcgcacaaggtcctgtctgccctgcaggctgtacagggcctgctagtggcccagggcagggctgatagccaggcccagctgctgctgtccayggtggtgggcgtgttcacagccccaggcctgcacctgaagcagccgtttgtgcagggcctggctctctatacccctgtggtcctcccacgctctctggac

SEQ ID NO: 168 - DNA, 201 bp, Homo sapiens
agcctgtggtctggccaagtgatgtaaccctcctctccagcctgtgcacaggcagcctgggaacagctccatccccacccctcagctataaatagggcatygtgacccggccaggggaagaagctgccgttgttctgggtactacagcagaagggtatgcggaagcgagcaccccagtctgagatggctcctgccggtgtg

SEQ ID NO: 169 - DNA, 201 bp, Homo sapiens
ggccaagtgatgtaaccctcctctccagcctgtgcacaggcagcctgggaacagctccatccccacccctcagctataaatagggcatcgtgacccggccrggggaagaagctgccgttgttctgggtactacagcagaagggtatgcggaagcgagcaccccagtctgagatggctcctgccggtgtgagcctgagggcc

SEQ ID NO: 170 - DNA, 201 bp, Homo sapiens
ctcccacgctctctggacttcacagaactggatgttgctgctgagaagattgacaggttcatgcaggctgtgacaggatggaagactggctgctccctgaygggagccagtgtggacagcaccctggctttcaacacctacgtccacttccaagggaagatgaagggcttctccctgctggccgagccccaggagttctgg

SEQ ID NO: 171 - DNA, 201 bp, Homo sapiens
gatggctcctgccggtgtgagcctgagggccaccatcctctgcctcctggcctgggctggcctggctgcaggtgaccgggtgtacatacaccccttccacytcgtcatccacaatgagagtacctgtgagcagctggcaaaggccaatgccgggaagcccaaagaccccaccttcatacctgctccaattcaggccaagac

SEQ ID NO: 172 - DNA, 201 bp, Homo sapiens
ccctcctctccagcctgtgcacaggcagcctgggaacagctccatccccacccctcagctataaatagggcatcgtgacccggccaggggaagaagctgcygttgttctgggtactacagcagaagggtatgcggaagcgagcaccccagtctgagatggctcctgccggtgtgagcctgagggccaccatcctctgcctc

SEQ ID NO: 173 - DNA, 201 bp, Homo sapiens
ccagcctgtggtctggccaagtgatgtaaccctcctctccagcctgtgcacaggcagcctgggaacagctccatccccacccctcagctataaatagggcmtcgtgacccggccaggggaagaagctgccgttgttctgggtactacagcagaagggtatgcggaagcgagcaccccagtctgagatggctcctgccggtg

SEQ ID NO: 174 - DNA, 201 bp, Homo sapiens
gacctggacaaggtggagggtctcactttccagcaaaactccctcaactggatgaagaaactgtctccccggaccatccacctgaccatgccccaactggygctgcaaggatcttatgacctgcaggacctgctcgcccaggctgagctgcccgccattctgcacaccgagctgaacctgcaaaaattgagcaatgaccgc

SEQ ID NO: 175 - DNA, 201 bp, Homo sapiens
tgaaaaggccctacaggaccagctggtgctagtcgctgcaaaacttgacaccgaagacaagttgagggccgcaatggtcgggatgctggccaacttcttgkgcttccgtatatatggcatgcacagtgagctatggggcgtggtccatggggccaccgtcctctccccaacggctgtctttggcaccctggcctctctcta

SEQ ID NO: 176 - DNA, 201 bp, Homo sapiens
gctgagaagattgacaggttcatgcaggctgtgacaggatggaagactggctgctccctgatgggagccagtgtggacagcaccctggctttcaacacctrcgtccacttccaagggaagatgaagggcttctccctgctggccgagccccaggagttctgggtggacaacagcacctcagtgtctgttcccatgctctct

SEQ ID NO: 177 - DNA, 201 bp, Homo sapiens
gtgttcacagccccaggcctgcacctgaagcagccgtttgtgcagggcctggctctctatacccctgtggtcctcccacgctctctggacttcacagaackggatgttgctgctgagaagattgacaggttcatgcaggctgtgacaggatggaagactggctgctccctgatgggagccagtgtggacagcaccctggct

SEQ ID NO: 178 - DNA, 201 bp, Homo sapiens
accccaccttcatacctgctccaattcaggccaagacatcccctgtggatgaaaaggccctacaggaccagctggtgctagtcgctgcaaaacttgacacygaagacaagttgagggccgcaatggtcgggatgctggccaacttcttgggcttccgtatatatggcatgcacagtgagctatggggcgtggtccatgggg

SEQ ID NO: 179 - DNA, 201 bp, Homo sapiens
gagggccaccatcctctgcctcctggcctgggctggcctggctgcaggtgaccgggtgtacatacaccccttccacctcgtcatccacaatgagagtaccygtgagcagctggcaaaggccaatgccgggaagcccaaagaccccaccttcatacctgctccaattcaggccaagacatcccctgtggatgaaaaggccct

SEQ ID NO: 180 - DNA, 201 bp, Homo sapiens
gaacagctccatccccacccctcagctataaatagggcatcgtgacccggccaggggaagaagctgccgttgttctgggtactacagcagaagggtatgcrgaagcgagcaccccagtctgagatggctcctgccggtgtgagcctgagggccaccatcctctgcctcctggcctgggctggcctggctgcaggtgaccgg

SEQ ID NO: 181 - DNA, 201 bp, Homo sapiens
gcaatggtcgggatgctggccaacttcttgggcttccgtatatatggcatgcacagtgagctatggggcgtggtccatggggccaccgtcctctccccaayggctgtctttggcaccctggcctctctctatctgggagccttggaccacacagctgacaggctacaggcaatcctgggtgttccttggaaggacaagaac

SEQ ID NO: 182 - DNA, 201 bp, Homo sapiens
tgtagtgtctgtaataccttagttttttccacagatgcttgtgatttttgaacaatacgtgaaagatgcaagcacctgaatttctgtttgaatgcggaacmatagctggttatttctcccttgtgttagtaataaacgtcttgccacaataagcctccaaaaattttatctttcatttagcagccaaacagatgtatacaa

SEQ ID NO: 183 - DNA, 201 bp, Homo sapiens
tcaaagcgccactgccctgcacttcctgggccgcgtggccaacccgctgagcacagcatgaggccagggccccagaacacagtgcctggcaaggcctctgyccctggcctttgaggcaaaggccagcagcagataacaaccccggacaaatcagcgatgtgtcacccccagtctcccaccttttcttctaatgagtcgact

SEQ ID NO: 184 - DNA, 201 bp, Homo sapiens
aaggccagcagcagataacaaccccggacaaatcagcgatgtgtcacccccagtctcccaccttttcttctaatgagtcgactttgagctggaaagcagcsgtttctccttggtctaagtgtgctgcatggagtgagcagtagaagcctgcagcggcacaaatgcacctcccagtttgctgggtttattttagagaatggg

SEQ ID NO: 185 - DNA, 201 bp, Homo sapiens
caccatcctctgcctcctggcctgggctggcctggctgcaggtgaccgggtgtacatacaccccttccacctcgtcatccacaatgagagtacctgtgagyagctggcaaaggccaatgccgggaagcccaaagaccccaccttcatacctgctccaattcaggccaagacatcccctgtggatgaaaaggccctacagga

SEQ ID NO: 186 - DNA, 201 bp, Homo sapiens
agcttgtttgtgaaacaaaaaagtgttcccttttcaagttgagaacaaaaattgggttttaaaattaaagtatacatttttgcattgccttcggtttgtakttagtgtcttgaatgtaagaacatgacctccgtgtagtgtctgtaataccttagttttttccacagatgcttgtgatttttgaacaatacgtgaaagatg

SEQ ID NO: 187 - DNA, 201 bp, Homo sapiens
gtgggcgtgttcacagccccaggcctgcacctgaagcagccgtttgtgcagggcctggctctctatacccctgtggtcctcccacgctctctggacttcayagaactggatgttgctgctgagaagattgacaggttcatgcaggctgtgacaggatggaagactggctgctccctgatgggagccagtgtggacagcacc

SEQ ID NO: 188 - DNA, 201 bp, Homo sapiens
agcagataacaaccccggacaaatcagcgatgtgtcacccccagtctcccaccttttcttctaatgagtcgactttgagctggaaagcagccgtttctccytggtctaagtgtgctgcatggagtgagcagtagaagcctgcagcggcacaaatgcacctcccagtttgctgggtttattttagagaatgggggtggggag

SEQ ID NO: 189 - DNA, 201 bp, Homo sapiens
cccctgtggatgaaaaggccctacaggaccagctggtgctagtcgctgcaaaacttgacaccgaagacaagttgagggccgcaatggtcgggatgctggcyaacttcttgggcttccgtatatatggcatgcacagtgagctatggggcgtggtccatggggccaccgtcctctccccaacggctgtctttggcaccctgg

SEQ ID NO: 190 - DNA, 201 bp, Homo sapiens
gacaaatcagcgatgtgtcacccccagtctcccaccttttcttctaatgagtcgactttgagctggaaagcagccgtttctccttggtctaagtgtgctgyatggagtgagcagtagaagcctgcagcggcacaaatgcacctcccagtttgctgggtttattttagagaatgggggtggggaggcaagaaccagtgttta

SEQ ID NO: 191 - DNA, 201 bp, Homo sapiens
ctccatccccacccctcagctataaatagggcatcgtgacccggccaggggaagaagctgccgttgttctgggtactacagcagaagggtatgcggaagcsagcaccccagtctgagatggctcctgccggtgtgagcctgagggccaccatcctctgcctcctggcctgggctggcctggctgcaggtgaccgggtgtac

SEQ ID NO: 192 - DNA, 201 bp, Homo sapiens
acctgaatttctgtttgaatgcggaaccatagctggttatttctcccttgtgttagtaataaacgtcttgccacaataagcctccaaaaattttatctttyatttagcagccaaacagatgtatacaattcagcagatagactgtgcaaacgaaagtgctttcctggactttggatggaatttccatgggaggtctgagcc

SEQ ID NO: 193 - DNA, 201 bp, Homo sapiens
tctcactttccagcaaaactccctcaactggatgaagaaactgtctccccggaccatccacctgaccatgccccaactggtgctgcaaggatcttatgacmtgcaggacctgctcgcccaggctgagctgcccgccattctgcacaccgagctgaacctgcaaaaattgagcaatgaccgcatcagggtgggggaggtgct

SEQ ID NO: 194 - DNA, 201 bp, Homo sapiens
aatcagcgatgtgtcacccccagtctcccaccttttcttctaatgagtcgactttgagctggaaagcagccgtttctccttggtctaagtgtgctgcatgkagtgagcagtagaagcctgcagcggcacaaatgcacctcccagtttgctgggtttattttagagaatgggggtggggaggcaagaaccagtgtttagcgc

SEQ ID NO: 195 - DNA, 201 bp, Homo sapiens
gcgcctgcctgctgctgatccagcctcactatgcctctgacctggacaaggtggagggtctcactttccagcaaaactccctcaactggatgaagaaactrtctccccggaccatccacctgaccatgccccaactggtgctgcaaggatcttatgacctgcaggacctgctcgcccaggctgagctgcccgccattctgc

SEQ ID NO: 196 - DNA, 201 bp, Homo sapiens
aaatcagcgatgtgtcacccccagtctcccaccttttcttctaatgagtcgactttgagctggaaagcagccgtttctccttggtctaagtgtgctgcatkgagtgagcagtagaagcctgcagcggcacaaatgcacctcccagtttgctgggtttattttagagaatgggggtggggaggcaagaaccagtgtttagcg

SEQ ID NO: 197 - DNA, 201 bp, Homo sapiens
caaatgcacctcccagtttgctgggtttattttagagaatgggggtggggaggcaagaaccagtgtttagcgcgggactactgttccaaaaagaattccarccgaccagcttgtttgtgaaacaaaaaagtgttcccttttcaagttgagaacaaaaattgggttttaaaattaaagtatacatttttgcattgccttcgg

SEQ ID NO: 198 - DNA, 201 bp, Homo sapiens
gggtttattttagagaatgggggtggggaggcaagaaccagtgtttagcgcgggactactgttccaaaaagaattccaaccgaccagcttgtttgtgaaamaaaaaagtgttcccttttcaagttgagaacaaaaattgggttttaaaattaaagtatacatttttgcattgccttcggtttgtatttagtgtcttgaatg

SEQ ID NO: 199 - DNA, 201 bp, Homo sapiens; identical to SEQ ID NO: 167

SEQ ID NO: 200 - DNA, 201 bp, Homo sapiens; identical to SEQ ID NO: 170

SEQ ID NO: 201 - DNA, 201 bp, Homo sapiens; identical to SEQ ID NO: 171

SEQ ID NO: 202 - DNA, 201 bp, Homo sapiens; identical to SEQ ID NO: 175

SEQ ID NO: 203 - DNA, 201 bp, Homo sapiens; identical to SEQ ID NO: 174

SEQ ID NO: 204 - DNA, 201 bp, Homo sapiens; identical to SEQ ID NO: 176

SEQ ID NO: 205 - DNA, 201 bp, Homo sapiens; identical to SEQ ID NO: 177

SEQ ID NO: 206 - DNA, 201 bp, Homo sapiens; identical to SEQ ID NO: 178

SEQ ID NO: 207 - DNA, 201 bp, Homo sapiens; identical to SEQ ID NO: 179

SEQ ID NO: 208 - DNA, 201 bp, Homo sapiens
ctgagcacaatcagctgcaggaggtggctgctcagctgaaagcctgtggggacaaaggaggagacccaggactcgctgtatccgagccccgagggtatgcrgaagcgagcaccccagtctgagatggctcctgccggtgtgagcctgagggccaccatcctctgcctcctggcctgggctggcctggctgcaggtgaccgg

SEQ ID NO: 209 - DNA, 201 bp, Homo sapiens; identical to SEQ ID NO: 181

SEQ ID NO: 210 - DNA, 201 bp, Homo sapiens; identical to SEQ ID NO: 183

SEQ ID NO: 211 - DNA, 124 bp, Homo sapiens
aaagaaaggcgatgctaagaaacrtgctgcaggggaggctggcacattctgctccttagctaaccgcacaggcccatgggtccacacacatcagaccatggctctctgtggtctatctttgcca

SEQ ID NO: 212 - DNA, 201 bp, Homo sapiens; identical to SEQ ID NO: 184

SEQ ID NO: 213 - DNA, 201 bp, Homo sapiens; identical to SEQ ID NO: 187

SEQ ID NO: 214 - DNA, 201 bp, Homo sapiens; identical to SEQ ID NO: 185

SEQ ID NO: 215 - DNA, 201 bp, Homo sapiens; identical to SEQ ID NO: 188

SEQ ID NO: 216 - DNA, 201 bp, Homo sapiens; identical to SEQ ID NO: 189

SEQ ID NO: 217 - DNA, 201 bp, Homo sapiens
acaatcagctgcaggaggtggctgctcagctgaaagcctgtggggacaaaggaggagacccaggactcgctgtatccgagccccgagggtatgcggaagcsagcaccccagtctgagatggctcctgccggtgtgagcctgagggccaccatcctctgcctcctggcctgggctggcctggctgcaggtgaccgggtgtac

SEQ ID NO: 218 - DNA, 201 bp, Homo sapiens; identical to SEQ ID NO: 193

SEQ ID NO: 219 - DNA, 201 bp, Homo sapiens; identical to SEQ ID NO: 190

SEQ ID NO: 220 - DNA, 201 bp, Homo sapiens; identical to SEQ ID NO: 195

SEQ ID NO: 221 - DNA, 201 bp, Homo sapiens; identical to SEQ ID NO: 194

SEQ ID NO: 222 - DNA, 201 bp, Homo sapiens; identical to SEQ ID NO: 196

SEQ ID NO: 223 - DNA, 201 bp, Homo sapiens
caaatgcacctcccagtttgctgggtttattttagagaatgggggtggggaggcaagaaccagtgtttagcgcgggactactgttccaaaaagaattccarccgaccagcttgtttgtgaaacaaaaaagtgttcccttttcaagttgagaacaaaaattgggttttaaaaacatgacctccgtgtagtgtctgtaatacc

SEQ ID NO: 224 - DNA, 201 bp, Homo sapiens
gggtttattttagagaatgggggtggggaggcaagaaccagtgtttagcgcgggactactgttccaaaaagaattccaaccgaccagcttgtttgtgaaamaaaaaagtgttcccttttcaagttgagaacaaaaattgggttttaaaaacatgacctccgtgtagtgtctgtaataccttagttttttccacagatgctt

SEQ ID NO: 225 - DNA, 201 bp, Homo sapiens
taaatttcactggcatgccacctgcagatgaagattacagcccctgtatgctagaaactgagacactcaacaagtatgttgtgatcatcgcctatgccctrgtgttcctgctgagcctgctgggaaactccctggtgatgctggtcatcttatacagcagggtcggccgctccgtcactgatgtctacctgctgaacctgg

SEQ ID NO: 226 - DNA, 125 bp, Homo sapiens
tttccctccttggagacagggccctgtcggtttattcactgtatgtccttggtgcctggagcctactaaatgctcaataaataatgatcacaggaatgaaygcatgctgaaaagaccactctttt

SEQ ID NO: 227 - DNA, 201 bp, Homo sapiens
gtcatctttgctgtcgtcctcatcttcctgctttgctggctgccctacaacctggtcctgctggcagacaccctcatgaggacccaggtgatccaggagasctgtgagcgccgcaacaacatcggccgggccctggatgccactgagattctgggatttctccatagctgcctcaaccccatcatctacgccttcatcggc

SEQ ID NO: 228 - DNA, 201 bp, Homo sapiens
atttcactggcatgccacctgcagatgaagattacagcccctgtatgctagaaactgagacactcaacaagtatgttgtgatcatcgcctatgccctagtrttcctgctgagcctgctgggaaactccctggtgatgctggtcatcttatacagcagggtcggccgctccgtcactgatgtctacctgctgaacctggcct

SEQ ID NO: 229 - DNA, 201 bp, Homo sapiens
tgaccaacatcgcagacacatgtgctggccacctgctgagccccaagtggaacgagacaagcagcccttagcccttcccctctgcagcttccaggctggcrtgcagcatcagcatccctagaaagccatgtgcagccaccagtccattgggcaggcagatgttcctaataaagcttctgttccgtgcttgtccctgtggaa

SEQ ID NO: 230 - DNA, 201 bp, Homo sapiens
tctgggccgcctccaaggtgaatggctggatttttggcacattcctgtgcaaggtggtctcactcctgaaggaagtcaacttctacagtggcatcctgctrttggcctgcatcagtgtggaccgttacctggccattgtccatgccacacgcacactgacccagaagcgtcacttggtcaagtttgtttgtcttggctgct

SEQ ID NO: 231 - DNA, 201 bp, Homo sapiens
ggggcagaagcaccgagccatgagggtcatctttgctgtcgtcctcatcttcctgctttgctggctgccctacaacctggtcctgctggcagacaccctcmtgaggacccaggtgatccaggagagctgtgagcgccgcaacaacatcggccgggccctggatgccactgagattctgggatttctccatagctgcctcaa

SEQ ID NO: 232 - DNA, 201 bp, Homo sapiens
ccctgaccttgcccatctgggccgcctccaaggtgaatggctggatttttggcacattcctgtgcaaggtggtctcactcctgaaggaagtcaacttctayagtggcatcctgctgttggcctgcatcagtgtggaccgttacctggccattgtccatgccacacgcacactgacccagaagcgtcacttggtcaagtttg

SEQ ID NO: 233 - DNA, 201 bp, Homo sapiens
attacagcccctgtatgctagaaactgagacactcaacaagtatgttgtgatcatcgcctatgccctagtgttcctgctgagcctgctgggaaactccctsgtgatgctggtcatcttatacagcagggtcggccgctccgtcactgatgtctacctgctgaacctggccttggccgacctactctttgccctgaccttgc

SEQ ID NO: 234 - DNA, 201 bp, Homo sapiens
tcatcttatacagcagggtcggccgctccgtcactgatgtctacctgctgaacctggccttggccgacctactctttgccctgaccttgcccatctgggcygcctccaaggtgaatggctggatttttggcacattcctgtgcaaggtggtctcactcctgaaggaagtcaacttctacagtggcatcctgctgttggcct

SEQ ID NO: 235 - DNA, 201 bp, Homo sapiens
gaagaggacatgtcaaatattacagatccacagatgtgggattttgatgatctaaatttcactggcatgccacctgcagatgaagattacagcccctgtakgctagaaactgagacactcaacaagtatgttgtgatcatcgcctatgccctagtgttcctgctgagcctgctgggaaactccctggtgatgctggtcatc

SEQ ID NO: 236 - DNA, 201 bp, Homo sapiens
cttgaggcacagaaactcctgttcatgcccatacccctggccaaggaagatccctttgtccacaagtaaaaggaaatgctcctccagggagtctcagcttmaccctgaggtgagcatcatcttctgggttaggccttgcctaggcatagccctgcctcaagctatgtgagctcaccagtccctccccaaatgctttccatg

SEQ ID NO: 237 - DNA, 201 bp, Homo sapiens
ctgggccgcctccaaggtgaatggctggatttttggcacattcctgtgcaaggtggtctcactcctgaaggaagtcaacttctacagtggcatcctgctgytggcctgcatcagtgtggaccgttacctggccattgtccatgccacacgcacactgacccagaagcgtcacttggtcaagtttgtttgtcttggctgctg

SEQ ID NO: 238 - DNA, 201 bp, Homo sapiens
tttaactcctgctagaacagtctcttgaggcacagaaactcctgttcatgcccatacccctggccaaggaagatccctttgtccacaagtaaaaggaaatsctcctccagggagtctcagcttcaccctgaggtgagcatcatcttctgggttaggccttgcctaggcatagccctgcctcaagctatgtgagctcaccag

SEQ ID NO: 239 - DNA, 192 bp, Homo sapiens
aagctatgtgagctcaccagtccctccccaaatgctttccatgagttgcagttttttcctagtctgttttccctccttggagacagggccctgtcggtttrttcactgtatgtccttggtgcctggagcctactaaatgctcaataaataatgatcacaggaatgaatgcatgctgaaaagaccactctttt

SEQ ID NO: 240 - DNA, 201 bp, Homo sapiens
gggagcatctcagggggcacctgccgttgaattgttctcacttgtgtttgtaagaatccaagtatgtcacccttacaccaagtgagcacacagtgacacartcccctttcaatgtagataacattgcttcagagctggagaacttcatggggctcatcgaggtggtgacgggctacgtgaagatccgccattctcatgcct

SEQ ID NO: 241 - DNA, 201 bp, Homo sapiens
cctgtgaaatcattgttcgcgcgaccctcatctgcctcaggatgctgtactctactacgcacaactgctccatcttttaagatattggaagtgagagcacrggaggagcatgggcggttcgttttgttagaaagaaacccggattcacgagatggtttttattgattagtttacaggatttgcactattgatagagttttt

SEQ ID NO: 242 - DNA, 201 bp, Homo sapiens
ggatgctgtactctactacgcacaactgctccatcttttaagatattggaagtgagagcacgggaggagcatgggcggttcgttttgttagaaagaaaccyggattcacgagatggtttttattgattagtttacaggatttgcactattgatagagtttttgccttggcacaggcctgctttgtgataggggttttaaaa

SEQ ID NO: 243 - DNA, 201 bp, Homo sapiens
tgtttggaaaacagagatgttatcacccttactggattttgcctcatcagtcaagggttgcgtgtctgactgtgaccagtgagacggcagacgggggtgcrcttagggcttttctgccaagaatgacagcagttggtctggagtgctcacctccctgtgaaatcattgttcgcgcgaccctcatctgcctcaggatgctgt

SEQ ID NO: 244 - DNA, 201 bp, Homo sapiens
tcacccttactggattttgcctcatcagtcaagggttgcgtgtctgactgtgaccagtgagacggcagacgggggtgcgcttagggcttttctgccaagartgacagcagttggtctggagtgctcacctccctgtgaaatcattgttcgcgcgaccctcatctgcctcaggatgctgtactctactacgcacaactgctc

SEQ ID NO: 245 - DNA, 201 bp, Homo sapiens
gcttcccctgcctgggaggcctcgttccaggagtcgttgttgagagtcaagccagggaagtgtgtttttgtcagggagcagccagtcctgtgctgggagcrtctcagggggcacctgccgttgaattgttctcacttgtgtttgtaagaatccaagtatgtcacccttacaccaagtgagcacacagtgacacaatcccct

SEQ ID NO: 246 - DNA, 201 bp, Homo sapiens
ttgggatggtctatgaaggagttgccaagggtgtggtgaaagatgaacctgaaaccagagtggccattaaaacagtgaacgaggccgcaagcatgcgtgaraggattgagtttctcaacgaagcttctgtgatgaaggagttcaattgtcaccatgtggtgcgattgctgggtgtggtgtcccaaggccagccaacactgg

SEQ ID NO: 247 - DNA, 201 bp, Homo sapiens
gcaccaatgcttcagttccttccattcccttggacgttctttcagcatcgaactcctcttctcagttaatcgtgaagtggaaccctccctctctgcccaayggcaacctgagttactacattgtgcgctggcagcggcagcctcaggacggctacctttaccggcacaattactgctccaaagacaaaatccccatcagga

SEQ ID NO: 248 - DNA, 201 bp, Homo sapiens
ccagacctgaaaggaagcggagagatgtcatgcaagtggccaacaccaccatgtccagccgaagcaggaacaccacggccgcagacacctacaacatcacygacccggaagagctggagacagagtaccctttctttgagagcagagtggataacaaggagagaactgtcatttctaaccttcggcctttcacattgtacc

SEQ ID NO: 249 - DNA, 201 bp, Homo sapiens
caagaacgagcgggccttgccgctgccccagtcttcgacctgctgatccttggatcctgaatctgtgcaaacagtaacgtgtgcgcacgcgcagcggggtsgggggggagagagagttttaacaatccattcacaagcctcctgtacctcagtggatcttcagaactgcccttgctgcccgcgggagacagcttctctgca

SEQ ID NO: 250 - DNA, 201 bp, Homo sapiens
gtgcaaacagtaacgtgtgcgcacgcgcagcggggtggggggggagagagagttttaacaatccattcacaagcctcctgtacctcagtggatcttcagawctgcccttgctgcccgcgggagacagcttctctgcagtaaaacacatttgggatgttccttttttcaatatgcaagcagctttttattccctgcccaaac

SEQ ID NO: 251 - DNA, 201 bp, Homo sapiens
tgtgcgcacgcgcagcggggtggggggggagagagagttttaacaatccattcacaagcctcctgtacctcagtggatcttcagaactgcccttgctgccygcgggagacagcttctctgcagtaaaacacatttgggatgttccttttttcaatatgcaagcagctttttattccctgcccaaacccttaactgacatgg

SEQ ID NO: 252 - DNA, 201 bp, Homo sapiens
ctcagtgaaggtggggagaagctgaaccggcttccctgccctgcctccccagccccctgcccaacccccaagaatctggtggccatgggccccgaagcagyctggcggacaggcttggagtcaaggggccccatgcctgcttctctcccagccccagctcccccgcccgcccccaaggacacagatgggaaggggtttcca

SEQ ID NO: 253 - DNA, 201 bp, Homo sapiens
ctaccagggcttgtccaacgagcaagtccttcgcttcgtcatggagggcggccttctggacaagccagacaactgtcctgacatgctgtttgaactgatgygcatgtgctggcagtataaccccaagatgaggccttccttcctggagatcatcagcagcatcaaagaggagatggagcctggcttccgggaggtctcctt

SEQ ID NO: 254 - DNA, 201 bp, Homo sapiens
aacgagcgggccttgccgctgccccagtcttcgacctgctgatccttggatcctgaatctgtgcaaacagtaacgtgtgcgcacgcgcagcggggtggggkgggagagagagttttaacaatccattcacaagcctcctgtacctcagtggatcttcagaactgcccttgctgcccgcgggagacagcttctctgcagtaa

SEQ ID NO: 255 - DNA, 201 bp, Homo sapiens
gaacgggggccgcaagaacgagcgggccttgccgctgccccagtcttcgacctgctgatccttggatcctgaatctgtgcaaacagtaacgtgtgcgcacrcgcagcggggtggggggggagagagagttttaacaatccattcacaagcctcctgtacctcagtggatcttcagaactgcccttgctgcccgcgggagac

SEQ ID NO: 256 - DNA, 201 bp, Homo sapiens
ccctgccactgcccgacagacactcaggacacaaggccgagaacggccccggccctggggtgctggtcctccgcgccagcttcgacgagagacagccttaygcccacatgaacgggggccgcaagaacgagcgggccttgccgctgccccagtcttcgacctgctgatccttggatcctgaatctgtgcaaacagtaacgt

SEQ ID NO: 257 - DNA, 201 bp, Homo sapiens
ccaacctcacggtcatccgcggctggaaactcttctacaactacgccctggtcatcttcgagatgaccaatctcaaggatattgggctttacaacctgagraacattactcggggggccatcaggattgagaaaaatgctgacctctgttacctctccactgtggactggtccctgatcctggatgcggtgtccaataact

SEQ ID NO: 258 - DNA, 201 bp, Homo sapiens
ctgcctgcccgcccaacacctacaggtttgagggctggcgctgtgtggaccgtgacttctgcgccaacatcctcagcgccgagagcagcgactccgagggrtttgtgatccacgacggcgagtgcatgcaggagtgcccctcgggcttcatccgcaacggcagccagagcatgtactgcatcccttgtgaaggtccttgcc

SEQ ID NO: 259 - DNA, 201 bp, Homo sapiens
tgaagcgcctggagaactgcacggtgatcgagggctacctccacatcctgctcatctccaaggccgaggactaccgcagctaccgcttccccaagctcackgtcattaccgagtacttgctgctgttccgagtggctggcctcgagagcctcggagacctcttccccaacctcacggtcatccgcggctggaaactcttct

SEQ ID NO: 260 - DNA, 201 bp, Homo sapiens
aatttaccgcatggaggaagtgacggggactaaagggcgccaaagcaaaggggacataaacaccaggaacaacggggagagagcctcctgtgaaagtgacrtcctgcatttcacctccaccaccacgtcgaagaatcgcatcatcataacctggcaccggtaccggccccctgactacagggatctcatcagcttcaccgt

SEQ ID NO: 261 - DNA, 201 bp, Homo sapiens
aacaccaggaacaacggggagagagcctcctgtgaaagtgacgtcctgcatttcacctccaccaccacgtcgaagaatcgcatcatcataacctggcaccrgtaccggccccctgactacagggatctcatcagcttcaccgtttactacaaggaagcaccctttaagaatgtcacagagtatgatgggcaggatgcctgc

SEQ ID NO: 262 - DNA, 201 bp, Homo sapiens
gttctttcagcatcgaactcctcttctcagttaatcgtgaagtggaaccctccctctctgcccaacggcaacctgagttactacattgtgcgctggcagcrgcagcctcaggacggctacctttaccggcacaattactgctccaaagacaaaatccccatcaggaagtatgccgacggcaccatcgacattgaggaggtc

SEQ ID NO: 263 - DNA, 201 bp, Homo sapiens
tgtgcaaacagtaacgtgtgcgcacgcgcagcggggtggggggggagagagagttttaacaatccattcacaagcctcctgtacctcagtggatcttcagwactgcccttgctgcccgcgggagacagcttctctgcagtaaaacacatttgggatgttccttttttcaatatgcaagcagctttttattccctgcccaaa

SEQ ID NO: 264 - DNA, 201 bp, Homo sapiens; identical to SEQ ID NO: 246

SEQ ID NO: 265 - DNA, 201 bp, Homo sapiens
gcaccaatgcttcagttccttccattcccttggacgttctttcagcatcgaactcctcttctcagttaatcgtgaagtggaaccctccctctctgcccaayggcaacctgagttactacattgtgcgctggcagcggcagcctcaggacggctacctttaccggcacaattactgctccaaagaagacaaaatccccatca

SEQ ID NO: 266 - DNA, 201 bp, Homo sapiens; identical to SEQ ID NO: 248

SEQ ID NO: 267 - DNA, 201 bp, Homo sapiens; identical to SEQ ID NO: 249

SEQ ID NO: 268 - DNA, 201 bp, Homo sapiens; identical to SEQ ID NO: 250

SEQ ID NO: 269 - DNA, 201 bp, Homo sapiens; identical to SEQ ID NO: 251

SEQ ID NO: 270 - DNA, 201 bp, Homo sapiens; identical to SEQ ID NO: 252

SEQ ID NO: 271 - DNA, 201 bp, Homo sapiens; identical to SEQ ID NO: 253

SEQ ID NO: 272 - DNA, 201 bp, Homo sapiens; identical to SEQ ID NO: 254

SEQ ID NO: 273 - DNA, 201 bp, Homo sapiens; identical to SEQ ID NO: 255

SEQ ID NO: 274 - DNA, 201 bp, Homo sapiens; identical to SEQ ID NO: 256

SEQ ID NO: 275 - DNA, 201 bp, Homo sapiens; identical to SEQ ID NO: 257

SEQ ID NO: 276 - DNA, 201 bp, Homo sapiens; identical to SEQ ID NO: 258

SEQ ID NO: 277 - DNA, 201 bp, Homo sapiens; identical to SEQ ID NO: 259

SEQ ID NO: 278 - DNA, 201 bp, Homo sapiens; identical to SEQ ID NO: 260

SEQ ID NO: 279 - DNA, 201 bp, Homo sapiens; identical to SEQ ID NO: 261

SEQ ID NO: 280 - DNA, 201 bp, Homo sapiens
gttctttcagcatcgaactcctcttctcagttaatcgtgaagtggaaccctccctctctgcccaacggcaacctgagttactacattgtgcgctggcagcrgcagcctcaggacggctacctttaccggcacaattactgctccaaagaagacaaaatccccatcaggaagtatgccgacggcaccatcgacattgaggag

SEQ ID NO: 281 - DNA, 201 bp, Homo sapiens; identical to SEQ ID NO: 263

SEQ ID NO: 282 - DNA, 201 bp, Homo sapiens
gcagaggacttctatgactgcagggtggagcactggggcttggaccagccgctcctcaagcactgggaggcccaagagccaatccagatgcctgagacaayggagactgtgctctgtgccctgggcctggtgctgggcctagtcggcatcatcgtgggcaccgtcctcatcataaagtctctgcgttctggccatgacccc

SEQ ID NO: 283 - DNA, 201 bp, Homo sapiens
tgactgaattgctgacccttcaagctctgtccttatccattacctcaaagcagtcattccttagtaaagtttccaacaaatagaaattaatgacactttgrtagcactaatatggagattatcctttcattgagccttttatcctctgttctcctttgaagaacccctcactgtcaccttcccgagaataccctaagacca

SEQ ID NO: 284 - DNA, 201 bp, Homo sapiens
tgaacagaagaggacttaggagagatctgaactccagctgccctacaaactccatctcagcttttcttctcacttcatgtgaaaactactccagtggctgrctgaattgctgacccttcaagctctgtccttatccattacctcaaagcagtcattccttagtaaagtttccaacaaatagaaattaatgacactttggta

SEQ ID NO: 285 - DNA, 201 bp, Homo sapiens
gaccctgtgaaatactgtaaaggtgacaaaatatctgaacagaagaggacttaggagagatctgaactccagctgccctacaaactccatctcagcttttrttctcacttcatgtgaaaactactccagtggctgactgaattgctgacccttcaagctctgtccttatccattacctcaaagcagtcattccttagtaaa

SEQ ID NO: 286 - DNA, 201 bp, Homo sapiens
gccttttcctttgaggctcagggcgggctggctaacattgctatattgaacaacaacttgaataccttgatccagcgttccaaccacactcaggccaccaycgatccccctgaggtgaccgtgtttcccaaggagcctgtggagctgggccagcccaacaccctcatctgccacattgacaagttcttcccaccagtgctc

SEQ ID NO: 287 - DNA, 201 bp, Homo sapiens
catctggaggagtttggccaagccttttcctttgaggctcagggcgggctggctaacattgctatattgaacaacaacttgaataccttgatccagcgttycaaccacactcaggccaccaacgatccccctgaggtgaccgtgtttcccaaggagcctgtggagctgggccagcccaacaccctcatctgccacattgac

SEQ ID NO: 288 - DNA, 201 bp, Homo sapiens
ggcatctggaggagtttggccaagccttttcctttgaggctcagggcgggctggctaacattgctatattgaacaacaacttgaataccttgatccagcgytccaaccacactcaggccaccaacgatccccctgaggtgaccgtgtttcccaaggagcctgtggagctgggccagcccaacaccctcatctgccacattg

SEQ ID NO: 289 - DNA, 201 bp, Homo sapiens
acaagttccattacctgacctttgtgccctcagcagaggacttctatgactgcagggtggagcactggggcttggaccagccgctcctcaagcactgggaygcccaagagccaatccagatgcctgagacaacggagactgtgctctgtgccctgggcctggtgctgggcctagtcggcatcatcgtgggcaccgtcctca

SEQ ID NO: 290 - DNA, 201 bp, Homo sapiens
tgactgcagggtggagcactggggcttggaccagccgctcctcaagcactgggaggcccaagagccaatccagatgcctgagacaacggagactgtgctcwgtgccctgggcctggtgctgggcctagtcggcatcatcgtgggcaccgtcctcatcataaagtctctgcgttctggccatgacccccgggcccaggggac

SEQ ID NO: 291 - DNA, 201 bp, Homo sapiens
aggacttctatgactgcagggtggagcactggggcttggaccagccgctcctcaagcactgggaggcccaagagccaatccagatgcctgagacaacggaractgtgctctgtgccctgggcctggtgctgggcctagtcggcatcatcgtgggcaccgtcctcatcataaagtctctgcgttctggccatgacccccggg

SEQ ID NO: 292 - DNA, 94 bp, Homo sapiens
gccttttatcctctgttctcctttgaagaacccctcactgtcaccttcccgagaataccctaagaccaataaatacttcagtatttcagagcgy

SEQ ID NO: 293 - DNA, 93 bp, Homo sapiens
ccttttatcctctgttctcctttgaagaacccctcactgtcaccttcccgagaataccctaagaccaataaatacttcagtatttcagagcgr

SEQ ID NO: 294 - DNA, 12 bp, Homo sapiens
atttcagagcgr

SEQ ID NO: 295 - DNA, 201 bp, Homo sapiens
actccatctcagcttttcttctcacttcatgtgaaaactactccagtggctgactgaattgctgacccttcaagctctgtccttatccattacctcaaagyagtcattccttagtaaagtttccaacaaatagaaattaatgacactttggtagcactaatatggagattatcctttcattgagccttttatcctctgttc

SEQ ID NO: 296 - DNA, 201 bp, Homo sapiens
atcgtgggcaccgtcctcatcataaagtctctgcgttctggccatgacccccgggcccaggggaccctgtgaaatactgtaaaggtgacaaaatatctgamcagaagaggacttaggagagatctgaactccagctgccctacaaactccatctcagcttttcttctcacttcatgtgaaaactactccagtggctgactg

SEQ ID NO: 297 - DNA, 201 bp, Homo sapiens
ttgagagccctctccttggctttcctgctgagtctccgaggagctggggccatcaaggcggaccatgtgtcaacttatgccgcgtttgtacagacgcatawaccaacaggggagtttatgtttgaatttgatgaagatgagatgttctatgtggatctggacaagaaggagaccgtctggcatctggaggagtttggccaa

SEQ ID NO: 298 - DNA, 201 bp, Homo sapiens
tgctgggcctagtcggcatcatcgtgggcaccgtcctcatcataaagtctctgcgttctggccatgacccccgggcccaggggaccctgtgaaatactgtyaaggtgacaaaatatctgaacagaagaggacttaggagagatctgaactccagctgccctacaaactccatctcagcttttcttctcacttcatgtgaaa

SEQ ID NO: 299 - DNA, 201 bp, Homo sapiens
cctgaggtgaccgtgtttcccaaggagcctgtggagctgggccagcccaacaccctcatctgccacattgacaagttcttcccaccagtgctcaacgtcasgtggctgtgcaacggggagctggtcactgagggtgtcgctgagagcctcttcctgcccagaacagattacagcttccacaagttccattacctgaccttt

SEQ ID NO: 300 - DNA, 201 bp, Homo sapiens
ggggaccctgtgaaatactgtaaaggtgacaaaatatctgaacagaagaggacttaggagagatctgaactccagctgccctacaaactccatctcagctyttcttctcacttcatgtgaaaactactccagtggctgactgaattgctgacccttcaagctctgtccttatccattacctcaaagcagtcattccttagt

SEQ ID NO: 301 - DNA, 201 bp, Homo sapiens
tcatcataaagtctctgcgttctggccatgacccccgggcccaggggaccctgtgaaatactgtaaaggtgacaaaatatctgaacagaagaggacttagkagagatctgaactccagctgccctacaaactccatctcagcttttcttctcacttcatgtgaaaactactccagtggctgactgaattgctgacccttca

SEQ ID NO: 302 - DNA, 201 bp, Homo sapiens
caccgtcctcatcataaagtctctgcgttctggccatgacccccgggcccaggggaccctgtgaaatactgtaaaggtgacaaaatatctgaacagaagargacttaggagagatctgaactccagctgccctacaaactccatctcagcttttcttctcacttcatgtgaaaactactccagtggctgactgaattgctg

SEQ ID NO: 303 - DNA, 201 bp, Homo sapiens
tctccaggaagcgctgtgtcccattaaacgcgtagcattcctgccgtccctggaaaaggtgaatcccagccatgctgattcctctccacccatttccagtyctagaggcccacagtttcagtctcatctgcctccactcggcctcagttcctcatcactgttcctgtgctcacagtcatcaattatagaccccacaacatg

SEQ ID NO: 304 - DNA, 201 bp, Homo sapiens
  misc_feature (1)...(201): n = A,T,C or G, or insertion/deletion polymorphism (see Tables 1-2)
tatgtttgaatttgatgaagatgagatgttctatgtggatctggacaagaaggagaccgtctggcatctggaggagtttggccaagccttttcctttgagnctcagggcgggctggctaacattgctatattgaacaacaacttgaataccttgatccagcgttccaaccacactcaggccaccaacgatccccctgaggt

SEQ ID NO: 305 - DNA, 201 bp, Homo sapiens
agacagaatgttccatatcagagctgtgatcttgagagccctctccttggctttcctgctgagtctccgaggagctggggccatcaaggcggaccatgtgycaacttatgccgcgtttgtacagacgcatagaccaacaggggagtttatgtttgaatttgatgaagatgagatgttctatgtggatctggacaagaagga

SEQ ID NO: 306 - DNA, 201 bp, Homo sapiens
cgccctgaagacagaatgttccatatcagagctgtgatcttgagagccctctccttggctttcctgctgagtctccgaggagctggggccatcaaggcggyccatgtgtcaacttatgccgcgtttgtacagacgcatagaccaacaggggagtttatgtttgaatttgatgaagatgagatgttctatgtggatctggac

SEQ ID NO: 307 - DNA, 201 bp, Homo sapiens
agtcatcaattatagaccccacaacatgcgccctgaagacagaatgttccatatcagagctgtgatcttgagagccctctccttggctttcctgctgagtytccgaggagctggggccatcaaggcggaccatgtgtcaacttatgccgcgtttgtacagacgcatagaccaacaggggagtttatgtttgaatttgatga

SEQ ID NO: 308 - DNA, 201 bp, Homo sapiens
gatccccctgaggtgaccgtgtttcccaaggagcctgtggagctgggccagcccaacaccctcatctgccacattgacaagttcttcccaccagtgctcarcgtcacgtggctgtgcaacggggagctggtcactgagggtgtcgctgagagcctcttcctgcccagaacagattacagcttccacaagttccattacctg

SEQ ID NO: 309 - DNA, 201 bp, Homo sapiens
cggcatcatcgtgggcaccgtcctcatcataaagtctctgcgttctggccatgacccccgggcccaggggaccctgtgaaatactgtaaaggtgacaaaasatctgaacagaagaggacttaggagagatctgaactccagctgccctacaaactccatctcagcttttcttctcacttcatgtgaaaactactccagtgg

SEQ ID NO: 310 - DNA, 201 bp, Homo sapiens
aaagtctctgcgttctggccatgacccccgggcccaggggaccctgtgaaatactgtaaaggtgacaaaatatctgaacagaagaggacttaggagagatrtgaactccagctgccctacaaactccatctcagcttttcttctcacttcatgtgaaaactactccagtggctgactgaattgctgacccttcaagctctg

SEQ ID NO: 311 - DNA, 201 bp, Homo sapiens
gcgttctggccatgacccccgggcccaggggaccctgtgaaatactgtaaaggtgacaaaatatctgaacagaagaggacttaggagagatctgaactcchgctgccctacaaactccatctcagcttttcttctcacttcatgtgaaaactactccagtggctgactgaattgctgacccttcaagctctgtccttatcc

SEQ ID NO: 312 - DNA, 201 bp, Homo sapiens
tcaattatagaccccacaacatgcgccctgaagacagaatgttccatatcagagctgtgatcttgagagccctctccttggctttcctgctgagtctccgmggagctggggccatcaaggcggaccatgtgtcaacttatgccgcgtttgtacagacgcatagaccaacaggggagtttatgtttgaatttgatgaagatg

SEQ ID NO: 313 - DNA, 201 bp, Homo sapiens
ttcttcccaccagtgctcaacgtcacgtggctgtgcaacggggagctggtcactgagggtgtcgctgagagcctcttcctgcccagaacagattacagctsccacaagttccattacctgacctttgtgccctcagcagaggacttctatgactgcagggtggagcactggggcttggaccagccgctcctcaagcactgg

SEQ ID NO: 314 - DNA, 201 bp, Homo sapiens
tggatctggacaagaaggagaccgtctggcatctggaggagtttggccaagccttttcctttgaggctcagggcgggctggctaacattgctatattgaayaacaacttgaataccttgatccagcgttccaaccacactcaggccaccaacgatccccctgaggtgaccgtgtttcccaaggagcctgtggagctgggcc

SEQ ID NO: 315 - DNA, 201 bp, Homo sapiens
agttcttcccaccagtgctcaacgtcacgtggctgtgcaacggggagctggtcactgagggtgtcgctgagagcctcttcctgcccagaacagattacagmttccacaagttccattacctgacctttgtgccctcagcagaggacttctatgactgcagggtggagcactggggcttggaccagccgctcctcaagcact

SEQ ID NO: 316 - DNA, 201 bp, Homo sapiens
caagttcttcccaccagtgctcaacgtcacgtggctgtgcaacggggagctggtcactgagggtgtcgctgagagcctcttcctgcccagaacagattacwgcttccacaagttccattacctgacctttgtgccctcagcagaggacttctatgactgcagggtggagcactggggcttggaccagccgctcctcaagca

SEQ ID NO: 317 - DNA, 201 bp, Homo sapiens
  misc_feature (1)...(201): n = A,T,C or G, or insertion/deletion polymorphism (see Tables 1-2)
attgacaagttcttcccaccagtgctcaacgtcacgtggctgtgcaacggggagctggtcactgagggtgtcgctgagagcctcttcctgcccagaacagnttacagcttccacaagttccattacctgacctttgtgccctcagcagaggacttctatgactgcagggtggagcactggggcttggaccagccgctcctc

SEQ ID NO: 318 - DNA, 201 bp, Homo sapiens
gtagatgtatctctccaggaagcgctgtgtcccattaaacgcgtagcattcctgccgtccctggaaaaggtgaatcccagccatgctgattcctctccacwcatttccagtgctagaggcccacagtttcagtctcatctgcctccactcggcctcagttcctcatcactgttcctgtgctcacagtcatcaattatagac

SEQ ID NO: 319 - DNA, 201 bp, Homo sapiens
ggaagcgctgtgtcccattaaacgcgtagcattcctgccgtccctggaaaaggtgaatcccagccatgctgattcctctccacccatttccagtgctagasgcccacagtttcagtctcatctgcctccactcggcctcagttcctcatcactgttcctgtgctcacagtcatcaattatagaccccacaacatgcgccct

SEQ ID NO: 320 - DNA, 201 bp, Homo sapiens
gtttgtacagacgcatagaccaacaggggagtttatgtttgaatttgatgaagatgagatgttctatgtggatctggacaagaaggagaccgtctggcatstggaggagtttggccaagccttttcctttgaggctcagggcgggctggctaacattgctatattgaacaacaacttgaataccttgatccagcgttccaa

SEQ ID NO: 321 - DNA, 201 bp, Homo sapiens
ggccatgacccccgggcccaggggaccctgtgaaatactgtaaaggtgacaaaatatctgaacagaagaggacttaggagagatctgaactccagctgccmtacaaactccatctcagcttttcttctcacttcatgtgaaaactactccagtggctgactgaattgctgacccttcaagctctgtccttatccattacct

SEQ ID NO: 322 - DNA, 201 bp, Homo sapiens
gttccaaccacactcaggccaccaacgatccccctgaggtgaccgtgtttcccaaggagcctgtggagctgggccagcccaacaccctcatctgccacatygacaagttcttcccaccagtgctcaacgtcacgtggctgtgcaacggggagctggtcactgagggtgtcgctgagagcctcttcctgcccagaacagatt

SEQ ID NO: 323 - DNA, 201 bp, Homo sapiens
agccttttcctttgaggctcagggcgggctggctaacattgctatattgaacaacaacttgaataccttgatccagcgttccaaccacactcaggccaccyacgatccccctgaggtgaccgtgtttcccaaggagcctgtggagctgggccagcccaacaccctcatctgccacattgacaagttcttcccaccagtgct

SEQ ID NO: 324 - DNA, 201 bp, Homo sapiens
ggccgccccagctccgtcaccgcccggaactcccccacgtcgctgtcgaagcgcgcgaactcctcccggttgtagatgtatctctccaggaagcgctgtgkcccattaaacgcgtagcattcctgccgtccctggaaaaggtgaatcccagccatgctgattcctctccacccatttccagtgctagaggcccacagtttc

SEQ ID NO: 325 - DNA, 201 bp, Homo sapiens
cgctgtcgaagcgcgcgaactcctcccggttgtagatgtatctctccaggaagcgctgtgtcccattaaacgcgtagcattcctgccgtccctggaaaagytgaatcccagccatgctgattcctctccacccatttccagtgctagaggcccacagtttcagtctcatctgcctccactcggcctcagttcctcatcact

SEQ ID NO: 326 - DNA, 201 bp, Homo sapiens
aggccgccccagctccgtcaccgcccggaactcccccacgtcgctgtcgaagcgcgcgaactcctcccggttgtagatgtatctctccaggaagcgctgtwtcccattaaacgcgtagcattcctgccgtccctggaaaaggtgaatcccagccatgctgattcctctccacccatttccagtgctagaggcccacagttt

SEQ ID NO: 327 - DNA, 201 bp, Homo sapiens
cacgtcgctgtcgaagcgcgcgaactcctcccggttgtagatgtatctctccaggaagcgctgtgtcccattaaacgcgtagcattcctgccgtccctggraaaggtgaatcccagccatgctgattcctctccacccatttccagtgctagaggcccacagtttcagtctcatctgcctccactcggcctcagttcctca

SEQ ID NO: 328 - DNA, 196 bp, Homo sapiens
tccaggatgtccttctggctgttccagtactccgcagcaggccgccccagctccgtcaccgcccggaactcccccacgtcgctgtcgaagcgcgcraactcctcccggttgtagatgtatctctccaggaagcgctgtgtcccattaaacgcgtagcattcctgccgtccctggaaaaggtgaatcccagccatgc

SEQ ID NO: 329 - DNA, 68 bp, Homo sapiens
agaacccctcactgtcaccttcccgagaataccctaagaccaataaatacttcagtatttcagagcgy

SEQ ID NO: 330 - DNA, 103 bp, Homo sapiens
tcraggatgtccttctggctgttccagtactccgcagcaggccgccccagctccgtcaccgcccggaactcccccacgtcgctgtcgaagcgcgcgaactcct

SEQ ID NO: 331 - DNA, 201 bp, Homo sapiens
tatattgaacaacaacttgaataccttgatccagcgttccaaccacactcaggccaccaacgatccccctgaggtgaccgtgtttcccaaggagcctgtgkagctgggccagcccaacaccctcatctgccacattgacaagttcttcccaccagtgctcaacgtcacgtggctgtgcaacggggagctggtcactgaggg

SEQ ID NO: 332 - DNA, 98 bp, Homo sapiens
ttgagccttttatcctctgttctcctttgaagaacccctcactgtcaccttcccgagaataccctaagaccaataaatacttcagtatttcagagcgr

SEQ ID NO: 333 - DNA, 101 bp, Homo sapiens
sccaggatgtccttctggctgttccagtactccgcagcaggccgccccagctccgtcaccgcccggaactcccccacgtcgctgtcgaagcgcgcgaactc

SEQ ID NO: 334 - DNA, 201 bp, Homo sapiens
ccccacgtcgctgtcgaagcgcgcgaactcctcccggttgtagatgtatctctccaggaagcgctgtgtcccattaaacgcgtagcattcctgccgtcccyggaaaaggtgaatcccagccatgctgattcctctccacccatttccagtgctagaggcccacagtttcagtctcatctgcctccactcggcctcagttcc

SEQ ID NO: 335 - DNA, 201 bp, Homo sapiens
aactcccccacgtcgctgtcgaagcgcgcgaactcctcccggttgtagatgtatctctccaggaagcgctgtgtcccattaaacgcgtagcattcctgccytccctggaaaaggtgaatcccagccatgctgattcctctccacccatttccagtgctagaggcccacagtttcagtctcatctgcctccactcggcctca

SEQ ID NO: 336 - DNA, 201 bp, Homo sapiens
ccgtcaccgcccggaactcccccacgtcgctgtcgaagcgcgcgaactcctcccggttgtagatgtatctctccaggaagcgctgtgtcccattaaacgcytagcattcctgccgtccctggaaaaggtgaatcccagccatgctgattcctctccacccatttccagtgctagaggcccacagtttcagtctcatctgcc

SEQ ID NO: 337 - DNA, 201 bp, Homo sapiens
  misc_feature (1)...(201): n = A,T,C or G, or insertion/deletion polymorphism (see Tables 1-2)
cattgacaagttcttcccaccagtgctcaacgtcacgtggctgtgcaacggggagctggtcactgagggtgtcgctgagagcctcttcctgcccagaacanattacagcttccacaagttccattacctgacctttgtgccctcagcagaggacttctatgactgcagggtggagcactggggcttggaccagccgctcct

SEQ ID NO: 338 - DNA, 141 bp, Homo sapiens
attaatgacactttggtagcactaatatggagattatcctttcattgagccttttatcctctgttctcctttgaagaacccctcactgtcaccttcccgaraataccctaagaccaataaatacttcagtatttcagagcg

SEQ ID NO: 339 - DNA, 201 bp, Homo sapiens
cggggagctggtcactgagggtgtcgctgagagcctcttcctgcccagaacagattacagcttccacaagttccattacctgacctttgtgccctcagcasaggacttctatgactgcagggtggagcactggggcttggaccagccgctcctcaagcactgggaggcccaagagccaatccagatgcctgagacaacgga

SEQ ID NO: 340 - DNA, 201 bp, Homo sapiens
cgatccccctgaggtgaccgtgtttcccaaggagcctgtggagctgggccagcccaacaccctcatctgccacattgacaagttcttcccaccagtgctcwacgtcacgtggctgtgcaacggggagctggtcactgagggtgtcgctgagagcctcttcctgcccagaacagattacagcttccacaagttccattacct

SEQ ID NO: 341 - DNA, 201 bp, Homo sapiens
caacgatccccctgaggtgaccgtgtttcccaaggagcctgtggagctgggccagcccaacaccctcatctgccacattgacaagttcttcccaccagtgrtcaacgtcacgtggctgtgcaacggggagctggtcactgagggtgtcgctgagagcctcttcctgcccagaacagattacagcttccacaagttccatta

SEQ ID NO: 342 - DNA, 201 bp, Homo sapiens
tgctatattgaacaacaacttgaataccttgatccagcgttccaaccacactcaggccaccaacgatccccctgaggtgaccgtgtttcccaaggagcctktggagctgggccagcccaacaccctcatctgccacattgacaagttcttcccaccagtgctcaacgtcacgtggctgtgcaacggggagctggtcactga

SEQ ID NO: 343 - DNA, 201 bp, Homo sapiens
acattgctatattgaacaacaacttgaataccttgatccagcgttccaaccacactcaggccaccaacgatccccctgaggtgaccgtgtttcccaaggascctgtggagctgggccagcccaacaccctcatctgccacattgacaagttcttcccaccagtgctcaacgtcacgtggctgtgcaacggggagctggtca

SEQ ID NO: 344 - DNA, 201 bp, Homo sapiens
ttccacaagttccattacctgacctttgtgccctcagcagaggacttctatgactgcagggtggagcactggggcttggaccagccgctcctcaagcactrggaggcccaagagccaatccagatgcctgagacaacggagactgtgctctgtgccctgggcctggtgctgggcctagtcggcatcatcgtgggcaccgtc

SEQ ID NO: 345 - DNA, 201 bp, Homo sapiens
gaggctcagggcgggctggctaacattgctatattgaacaacaacttgaataccttgatccagcgttccaaccacactcaggccaccaacgatccccctgkggtgaccgtgtttcccaaggagcctgtggagctgggccagcccaacaccctcatctgccacattgacaagttcttcccaccagtgctcaacgtcacgtgg

SEQ ID NO: 346 - DNA, 119 bp, Homo sapiens
taatatggagattatcctttcattgagccttttatcctctgttctcctttgaagaacccctcactgtcaccttcccgagaataccctaagaccaataaatycttcagtatttcagagcg

SEQ ID NO: 347 - DNA, 113 bp, Homo sapiens
ggagattatcctttcattgagccttttatcctctgttctcctttgaagaacccctcactgtcaccttcccgagaataccctaagaccaataaatacttcartatttcagagcg

SEQ ID NO: 348 - DNA, 101 bp, Homo sapiens
ttcattgagccttttatcctctgttctcctttgaagaacccctcactgtcaccttcccgagaataccctaagaccaataaatacttcagtatttcagagcy

SEQ ID NO: 349 - DNA, 201 bp, Homo sapiens
ccaacaggggagtttatgtttgaatttgatgaagatgagatgttctatgtggatctggacaagaaggagaccgtctggcatctggaggagtttggccaagycttttcctttgaggctcagggcgggctggctaacattgctatattgaacaacaacttgaataccttgatccagcgttccaaccacactcaggccaccaac

SEQ ID NO: 350 - DNA, 201 bp, Homo sapiens
gccatgacccccgggcccaggggaccctgtgaaatactgtaaaggtgacaaaatatctgaacagaagaggacttaggagagatctgaactccagctgcccwacaaactccatctcagcttttcttctcacttcatgtgaaaactactccagtggctgactgaattgctgacccttcaagctctgtccttatccattacctc

SEQ ID NO: 351 - DNA, 201 bp, Homo sapiens
tttgatgaagatgagatgttctatgtggatctggacaagaaggagaccgtctggcatctggaggagtttggccaagccttttcctttgaggctcagggcgygctggctaacattgctatattgaacaacaacttgaataccttgatccagcgttccaaccacactcaggccaccaacgatccccctgaggtgaccgtgttt

SEQ ID NO: 352 - DNA, 201 bp, Homo sapiens
aacagaagaggacttaggagagatctgaactccagctgccctacaaactccatctcagcttttcttctcacttcatgtgaaaactactccagtggctgacrgaattgctgacccttcaagctctgtccttatccattacctcaaagcagtcattccttagtaaagtttccaacaaatagaaattaatgacactttggtagc

SEQ ID NO: 353 - DNA, 201 bp, Homo sapiens
ctggacaagaaggagaccgtctggcatctggaggagtttggccaagccttttcctttgaggctcagggcgggctggctaacattgctatattgaacaacaycttgaataccttgatccagcgttccaaccacactcaggccaccaacgatccccctgaggtgaccgtgtttcccaaggagcctgtggagctgggccagccc

SEQ ID NO: 354 - DNA, 201 bp, Homo sapiens
gtgctgggcctagtcggcatcatcgtgggcaccgtcctcatcataaagtctctgcgttctggccatgacccccgggcccaggggaccctgtgaaatactgraaaggtgacaaaatatctgaacagaagaggacttaggagagatctgaactccagctgccctacaaactccatctcagcttttcttctcacttcatgtgaa

SEQ ID NO: 355 - DNA, 201 bp, Homo sapiens
agctccgtcaccgcccggaactcccccacgtcgctgtcgaagcgcgcgaactcctcccggttgtagatgtatctctccaggaagcgctgtgtcccattaarcgcgtagcattcctgccgtccctggaaaaggtgaatcccagccatgctgattcctctccacccatttccagtgctagaggcccacagtttcagtctcatc

SEQ ID NO: 356 - DNA, 201 bp, Homo sapiens
cgccccagctccgtcaccgcccggaactcccccacgtcgctgtcgaagcgcgcgaactcctcccggttgtagatgtatctctccaggaagcgctgtgtccmattaaacgcgtagcattcctgccgtccctggaaaaggtgaatcccagccatgctgattcctctccacccatttccagtgctagaggcccacagtttcagt

SEQ ID NO: 357 - DNA, 201 bp, Homo sapiens
gaattgctgacccttcaagctctgtccttatccattacctcaaagcagtcattccttagtaaagtttccaacaaatagaaattaatgacactttggtagcyctaatatggagattatcctttcattgagccttttatcctctgttctcctttgaagaacccctcactgtcaccttcccgagaataccctaagaccaataaa

SEQ ID NO: 358 - DNA, 201 bp, Homo sapiens
cagcttccacaagttccattacctgacctttgtgccctcagcagaggacttctatgactgcagggtggagcactggggcttggaccagccgctcctcaagyactgggaggcccaagagccaatccagatgcctgagacaacggagactgtgctctgtgccctgggcctggtgctgggcctagtcggcatcatcgtgggcac

SEQ ID NO: 359 - DNA, 201 bp, Homo sapiens
aggagtttggccaagccttttcctttgaggctcagggcgggctggctaacattgctatattgaacaacaacttgaataccttgatccagcgttccaaccakactcaggccaccaacgatccccctgaggtgaccgtgtttcccaaggagcctgtggagctgggccagcccaacaccctcatctgccacattgacaagttct

SEQ ID NO: 360 - DNA, 201 bp, Homo sapiens
cagcaggccgccccagctccgtcaccgcccggaactcccccacgtcgctgtcgaagcgcgcgaactcctcccggttgtagatgtatctctccaggaagcgytgtgtcccattaaacgcgtagcattcctgccgtccctggaaaagcaccttccagcgtcctctttacccagcaacagagaatgtcagctctatgatttctc

SEQ ID NO: 361 - DNA, 201 bp, Homo sapiens
acatgcgccctgaagacagaatgttccatatcagagctgtgatcttgagagccctctccttggctttcctgctgagtctccgaggagctggggccatcaargcggaccatgtgtcaacttatgccgcgtttgtacagacgcatagaccaacaggggagtttatgtttgaatttgatgaagatgagatgttctatgtggatc

SEQ ID NO: 362 - DNA, 201 bp, Homo sapiens
gtgctagaggcccacagtttcagtctcatctgcctccactcggcctcagttcctcatcactgttcctgtgctcacagtcatcaattatagaccccacaacrtgcgccctgaagacagaatgttccatatcagagctgtgatcttgagagccctctccttggctttcctgctgagtctccgaggagctggggccatcaaggc

SEQ ID NO: 363 - DNA, 201 bp, Homo sapiens
tcccagccatgctgattcctctccacccatttccagtgctagaggcccacagtttcagtctcatctgcctccactcggcctcagttcctcatcactgttcrtgtgctcacagtcatcaattatagaccccacaacatgcgccctgaagacagaatgttccatatcagagctgtgatcttgagagccctctccttggctttc

SEQ ID NO: 364 - DNA, 201 bp, Homo sapiens
cgctcctcaagcactgggaggcccaagagccaatccagatgcctgagacaacggagactgtgctctgtgccctgggcctggtgctgggcctagtcggcathatcgtgggcaccgtcctcatcataaagtctctgcgttctggccatgacccccgggcccaggggaccctgtgaaatactgtaaaggtgacaaaatatctga

SEQ ID NO: 365 - DNA, 201 bp, Homo sapiens
tgccctgggcctggtgctgggcctagtcggcatcatcgtgggcaccgtcctcatcataaagtctctgcgttctggccatgacccccgggcccaggggaccytgtgaaatactgtaaaggtgacaaaatatctgaacagaagaggacttaggagagatctgaactccagctgccctacaaactccatctcagcttttcttct

SEQ ID NO: 366 - DNA, 201 bp, Homo sapiens
caggatgtccttctggctgttccagtactccgcagcaggccgccccagctccgtcaccgcccggaactcccccacgtcgctgtcgaagcgcgcgaactccycccggttgtagatgtatctctccaggaagcgctgtgtcccattaaacgcgtagcattcctgccgtccctggaaaagcaccttccagcgtcctctttaccc

SEQ ID NO: 367 - DNA, 201 bp, Homo sapiens
agctccgtcaccgcccggaactcccccacgtcgctgtcgaagcgcgcgaactcctcccggttgtagatgtatctctccaggaagcgctgtgtcccattaawcgcgtagcattcctgccgtccctggaaaagcaccttccagcgtcctctttacccagcaacagagaatgtcagctctatgatttctctgataggtgaatcc

SEQ ID NO: 368 - DNA, 201 bp, Homo sapiens
aggccgccccagctccgtcaccgcccggaactcccccacgtcgctgtcgaagcgcgcgaactcctcccggttgtagatgtatctctccaggaagcgctgtrtcccattaaacgcgtagcattcctgccgtccctggaaaagcaccttccagcgtcctctttacccagcaacagagaatgtcagctctatgatttctctgat

SEQ ID NO: 369 - DNA, 201 bp, Homo sapiens
acagacgcatagaccaacaggggagtttatgtttgaatttgatgaagatgagatgttctatgtggatctggacaagaaggagaccgtctggcatctggagyagtttggccaagccttttcctttgaggctcagggcgggctggctaacattgctatattgaacaacaacttgaataccttgatccagcgttccaaccacac

SEQ ID NO: 370 - DNA, 201 bp, Homo sapiens
ctatgatttctctgataggtgaatcccagccatgctgattcctctccacccatttccagtgctagaggcccacagtttcagtctcatctgcctccactcgmcctcagttcctcatcactgttcctgtgctcacagtcatcaattatagaccccacaacatgcgccctgaagacagaatgttccatatcagagctgtgatct

SEQ ID NO: 371 - DNA, 201 bp, Homo sapiens
cagacgcatagaccaacaggggagtttatgtttgaatttgatgaagatgagatgttctatgtggatctggacaagaaggagaccgtctggcatctggaggrgtttggccaagccttttcctttgaggctcagggcgggctggctaacattgctatattgaacaacaacttgaataccttgatccagcgttccaaccacact

SEQ ID NO: 372 - DNA, 201 bp, Homo sapiens
accgtctggcatctggaggagtttggccaagccttttcctttgaggctcagggcgggctggctaacattgctatattgaacaacaacttgaataccttgarccagcgttccaaccacactcaggccaccaacgatccccctgaggtgaccgtgtttcccaaggagcctgtggagctgggccagcccaacaccctcatctgc

SEQ ID NO: 373 - DNA, 201 bp, Homo sapiens
gttcctcatcactgttcctgtgctcacagtcatcaattatagaccccacaacatgcgccctgaagacagaatgttccatatcagagctgtgatcttgagayccctctccttggctttcctgctgagtctccgaggagctggggccatcaaggcggaccatgtgtcaacttatgccgcgtttgtacagacgcatagaccaac

SEQ ID NO: 374 - DNA, 201 bp, Homo sapiens
tccagcgtcctctttacccagcaacagagaatgtcagctctatgatttctctgataggtgaatcccagccatgctgattcctctccacccatttccagtgmtagaggcccacagtttcagtctcatctgcctccactcggcctcagttcctcatcactgttcctgtgctcacagtcatcaattatagaccccacaacatgc

SEQ ID NO: 375 - DNA, 201 bp, Homo sapiens
ttatgtttgaatttgatgaagatgagatgttctatgtggatctggacaagaaggagaccgtctggcatctggaggagtttggccaagccttttcctttgaygctcagggcgggctggctaacattgctatattgaacaacaacttgaataccttgatccagcgttccaaccacactcaggccaccaacgatccccctgagg

SEQ ID NO: 376 - DNA, 201 bp, Homo sapiens
ccgtccctggaaaagcaccttccagcgtcctctttacccagcaacagagaatgtcagctctatgatttctctgataggtgaatcccagccatgctgattcytctccacccatttccagtgctagaggcccacagtttcagtctcatctgcctccactcggcctcagttcctcatcactgttcctgtgctcacagtcatcaa

SEQ ID NO: 377 - DNA, 201 bp, Homo sapiens
cctcagcagaggacttctatgactgcagggtggagcactggggcttggaccagccgctcctcaagcactgggaggcccaagagccaatccagatgcctgayacaacggagactgtgctctgtgccctgggcctggtgctgggcctagtcggcatcatcgtgggcaccgtcctcatcataaagtctctgcgttctggccatg

SEQ ID NO: 378 - DNA, 201 bp, Homo sapiens
ttgtacagacgcatagaccaacaggggagtttatgtttgaatttgatgaagatgagatgttctatgtggatctggacaagaaggagaccgtctggcatctrgaggagtttggccaagccttttcctttgaggctcagggcgggctggctaacattgctatattgaacaacaacttgaataccttgatccagcgttccaacc

SEQ ID NO: 379 - DNA, 201 bp, Homo sapiens
gaccagccgctcctcaagcactgggaggcccaagagccaatccagatgcctgagacaacggagactgtgctctgtgccctgggcctggtgctgggcctagrcggcatcatcgtgggcaccgtcctcatcataaagtctctgcgttctggccatgacccccgggcccaggggaccctgtgaaatactgtaaaggtgacaaaa

SEQ ID NO: 380 - DNA, 201 bp, Homo sapiens
tcatcataaagtctctgcgttctggccatgacccccgggcccaggggaccctgtgaaatactgtaaaggtgacaaaatatctgaacagaagaggacttagragagatctgaactccagctgccctacaaactccatctcagcttttcttctcacttcatgtgaaaactactccagtggctgactgaattgctgacccttca

SEQ ID NO: 381 - DNA, 201 bp, Homo sapiens
acagcttccacaagttccattacctgacctttgtgccctcagcagaggacttctatgactgcagggtggagcactggggcttggaccagccgctcctcaarcactgggaggcccaagagccaatccagatgcctgagacaacggagactgtgctctgtgccctgggcctggtgctgggcctagtcggcatcatcgtgggca

SEQ ID NO: 382 - DNA, 201 bp, Homo sapiens
tctggccatgacccccgggcccaggggaccctgtgaaatactgtaaaggtgacaaaatatctgaacagaagaggacttaggagagatctgaactccagctyccctacaaactccatctcagcttttcttctcacttcatgtgaaaactactccagtggctgactgaattgctgacccttcaagctctgtccttatccatta

SEQ ID NO: 383 - DNA, 201 bp, Homo sapiens
gacccccgggcccaggggaccctgtgaaatactgtaaaggtgacaaaatatctgaacagaagaggacttaggagagatctgaactccagctgccctacaayctccatctcagcttttcttctcacttcatgtgaaaactactccagtggctgactgaattgctgacccttcaagctctgtccttatccattacctcaaagc

SEQ ID NO: 384 - DNA, 201 bp, Homo sapiens
gaatcccagccatgctgattcctctccacccatttccagtgctagaggcccacagtttcagtctcatctgcctccactcggcctcagttcctcatcactgytcctgtgctcacagtcatcaattatagaccccacaacatgcgccctgaagacagaatgttccatatcagagctgtgatcttgagagccctctccttggct

SEQ ID NO: 385 - DNA, 201 bp, Homo sapiens
gactgtgctctgtgccctgggcctggtgctgggcctagtcggcatcatcgtgggcaccgtcctcatcataaagtctctgcgttctggccatgacccccggrcccaggggaccctgtgaaatactgtaaaggtgacaaaatatctgaacagaagaggacttaggagagatctgaactccagctgccctacaaactccatctc

SEQ ID NO: 386 - DNA, 201 bp, Homo sapiens
cccagcaacagagaatgtcagctctatgatttctctgataggtgaatcccagccatgctgattcctctccacccatttccagtgctagaggcccacagttkcagtctcatctgcctccactcggcctcagttcctcatcactgttcctgtgctcacagtcatcaattatagaccccacaacatgcgccctgaagacagaat

SEQ ID NO: 387 - DNA, 201 bp, Homo sapiens
tctgtgccctgggcctggtgctgggcctagtcggcatcatcgtgggcaccgtcctcatcataaagtctctgcgttctggccatgacccccgggcccagggraccctgtgaaatactgtaaaggtgacaaaatatctgaacagaagaggacttaggagagatctgaactccagctgccctacaaactccatctcagcttttc

SEQ ID NO: 388 - DNA, 201 bp, Homo sapiens
cctctttacccagcaacagagaatgtcagctctatgatttctctgataggtgaatcccagccatgctgattcctctccacccatttccagtgctagaggcrcacagtttcagtctcatctgcctccactcggcctcagttcctcatcactgttcctgtgctcacagtcatcaattatagaccccacaacatgcgccctgaa

SEQ ID NO: 389 - DNA, 201 bp, Homo sapiens
agctggggccatcaaggcggaccatgtgtcaacttatgccgcgtttgtacagacgcatagaccaacaggggagtttatgtttgaatttgatgaagatgagrtgttctatgtggatctggacaagaaggagaccgtctggcatctggaggagtttggccaagccttttcctttgaggctcagggcgggctggctaacattgc

SEQ ID NO: 390 - DNA, 138 bp, Homo sapiens
tccaggatgtccttctggctgttccagtactccgcagsaggccgccccagctccgtcaccgcccggaactcccccacgtcgctgtcgaagcgcgcgaactcctcccggttgtagatgtatctctccaggaagcgctgt

SEQ ID NO: 391 - DNA, 199 bp, Homo sapiens
tccaggatgtccttctggctgttccagtactccgcagcaggccgccccagctccgtcaccgcccggaactcccccacgtcgctgtcgaagcgcgcgaartcctcccggttgtagatgtatctctccaggaagcgctgtgtcccattaaacgcgtagcattcctgccgtccctggaaaagcaccttccagcgtcctcttt

SEQ ID NO: 392 - DNA, 201 bp, Homo sapiens
catgtgtcaacttatgccgcgtttgtacagacgcatagaccaacaggggagtttatgtttgaatttgatgaagatgagatgttctatgtggatctggacaygaaggagaccgtctggcatctggaggagtttggccaagccttttcctttgaggctcagggcgggctggctaacattgctatattgaacaacaacttgaat

SEQ ID NO: 393 - DNA, 201 bp, Homo sapiens
tcaacttatgccgcgtttgtacagacgcatagaccaacaggggagtttatgtttgaatttgatgaagatgagatgttctatgtggatctggacaagaaggrgaccgtctggcatctggaggagtttggccaagccttttcctttgaggctcagggcgggctggctaacattgctatattgaacaacaacttgaataccttg

SEQ ID NO: 394 - DNA, 201 bp, Homo sapiens
gcgtttgtacagacgcatagaccaacaggggagtttatgtttgaatttgatgaagatgagatgttctatgtggatctggacaagaaggagaccgtctggcytctggaggagtttggccaagccttttcctttgaggctcagggcgggctggctaacattgctatattgaacaacaacttgaataccttgatccagcgttcc

SEQ ID NO: 395 - DNA, 201 bp, Homo sapiens
taaaggtgacaaaatatctgaacagaagaggacttaggagagatctgaactccagctgccctacaaactccatctcagcttttcttctcacttcatgtgaraactactccagtggctgactgaattgctgacccttcaagctctgtccttatccattacctcaaagcagtcattccttagtaaagtttccaacaaatagaa

SEQ ID NO: 396 - DNA, 201 bp, Homo sapiens
tatgatttctctgataggtgaatcccagccatgctgattcctctccacccatttccagtgctagaggcccacagtttcagtctcatctgcctccactcggwctcagttcctcatcactgttcctgtgctcacagtcatcaattatagaccccacaacatgcgccctgaagacagaatgttccatatcagagctgtgatctt

SEQ ID NO: 397 - DNA, 201 bp, Homo sapiens
gctagaggcccacagtttcagtctcatctgcctccactcggcctcagttcctcatcactgttcctgtgctcacagtcatcaattatagaccccacaacatrcgccctgaagacagaatgttccatatcagagctgtgatcttgagagccctctccttggctttcctgctgagtctccgaggagctggggccatcaaggcgg

SEQ ID NO: 398 - DNA, 201 bp, Homo sapiens
acagagaatgtcagctctatgatttctctgataggtgaatcccagccatgctgattcctctccacccatttccagtgctagaggcccacagtttcagtctratctgcctccactcggcctcagttcctcatcactgttcctgtgctcacagtcatcaattatagaccccacaacatgcgccctgaagacagaatgttccat

SEQ ID NO: 399 - DNA, 201 bp, Homo sapiens
agcaccttccagcgtcctctttacccagcaacagagaatgtcagctctatgatttctctgataggtgaatcccagccatgctgattcctctccacccattsccagtgctagaggcccacagtttcagtctcatctgcctccactcggcctcagttcctcatcactgttcctgtgctcacagtcatcaattatagaccccac

SEQ ID NO: 400 - DNA, 201 bp, Homo sapiens
gccgtccctggaaaagcaccttccagcgtcctctttacccagcaacagagaatgtcagctctatgatttctctgataggtgaatcccagccatgctgattrctctccacccatttccagtgctagaggcccacagtttcagtctcatctgcctccactcggcctcagttcctcatcactgttcctgtgctcacagtcatca

SEQ ID NO: 401 - DNA, 201 bp, Homo sapiens
gtcagctctatgatttctctgataggtgaatcccagccatgctgattcctctccacccatttccagtgctagaggcccacagtttcagtctcatctgccthcactcggcctcagttcctcatcactgttcctgtgctcacagtcatcaattatagaccccacaacatgcgccctgaagacagaatgttccatatcagagct

SEQ ID NO: 402 - DNA, 201 bp, Homo sapiens
gtgtttcccaaggagcctgtggagctgggccagcccaacaccctcatctgccacattgacaagttcttcccaccagtgctcaacgtcacgtggctgtgcascggggagctggtcactgagggtgtcgctgagagcctcttcctgcccagaacagattacagcttccacaagttccattacctgacctttgtgccctcagca

SEQ ID NO: 403 - DNA, 201 bp, Homo sapiens; identical to SEQ ID NO: 306

SEQ ID NO: 404 - DNA, 195 bp, Homo sapiens
tccaggatgtccttctggctgttccagtactccgcagcaggccgccccagctccgtcaccgcccggaactcccccacgtcgctgtcgaagcgcgygaactcctcccggttgtagatgtatctctccaggaagcgctgtgtcccattaaacgcgtagcattcctgccgtccctggaaaagcaccttccagcgtcct

SEQ ID NO: 405 - DNA, 201 bp, Homo sapiens
cgtgggcaccgtcctcatcataaagtctctgcgttctggccatgacccccgggcccaggggaccctgtgaaatactgtaaaggtgacaaaatatctgaackgaagaggacttaggagagatctgaactccagctgccctacaaactccatctcagcttttcttctcacttcatgtgaaaactactccagtggctgactgaa

SEQ ID NO: 406 - DNA, 201 bp, Homo sapiens
tgggcaccgtcctcatcataaagtctctgcgttctggccatgacccccgggcccaggggaccctgtgaaatactgtaaaggtgacaaaatatctgaacagyagaggacttaggagagatctgaactccagctgccctacaaactccatctcagcttttcttctcacttcatgtgaaaactactccagtggctgactgaatt

SEQ ID NO: 407 - DNA, 201 bp, Homo sapiens
ggcaccgtcctcatcataaagtctctgcgttctggccatgacccccgggcccaggggaccctgtgaaatactgtaaaggtgacaaaatatctgaacagaayaggacttaggagagatctgaactccagctgccctacaaactccatctcagcttttcttctcacttcatgtgaaaactactccagtggctgactgaattgc

SEQ ID NO: 408 - DNA, 201 bp, Homo sapiens
cctcatcataaagtctctgcgttctggccatgacccccgggcccaggggaccctgtgaaatactgtaaaggtgacaaaatatctgaacagaagaggacttrggagagatctgaactccagctgccctacaaactccatctcagcttttcttctcacttcatgtgaaaactactccagtggctgactgaattgctgaccctt

SEQ ID NO: 409 - DNA, 201 bp, Homo sapiens
agagcctcttcctgcccagaacagattacagcttccacaagttccattacctgacctttgtgccctcagcagaggacttctatgactgcagggtggagcaytggggcttggaccagccgctcctcaagcactgggaggcccaagagccaatccagatgcctgagacaacggagactgtgctctgtgccctgggcctggtgc

SEQ ID NO: 410 - DNA, 201 bp, Homo sapiens
gcttccacaagttccattacctgacctttgtgccctcagcagaggacttctatgactgcagggtggagcactggggcttggaccagccgctcctcaagcawtgggaggcccaagagccaatccagatgcctgagacaacggagactgtgctctgtgccctgggcctggtgctgggcctagtcggcatcatcgtgggcaccg

SEQ ID NO: 411 - DNA, 201 bp, Homo sapiens
tgtcgctgagagcctcttcctgcccagaacagattacagcttccacaagttccattacctgacctttgtgccctcagcagaggacttctatgactgcaggytggagcactggggcttggaccagccgctcctcaagcactgggaggcccaagagccaatccagatgcctgagacaacggagactgtgctctgtgccctggg

SEQ ID NO: 412 - DNA, 201 bp, Homo sapiens
agatctgaactccagctgccctacaaactccatctcagcttttcttctcacttcatgtgaaaactactccagtggctgactgaattgctgacccttcaagrtctgtccttatccattacctcaaagcagtcattccttagtaaagtttccaacaaatagaaattaatgacactttggtagcactaatatggagattatcct

SEQ ID NO: 413 - DNA, 201 bp, Homo sapiens
ataaagtctctgcgttctggccatgacccccgggcccaggggaccctgtgaaatactgtaaaggtgacaaaatatctgaacagaagaggacttaggagagrtctgaactccagctgccctacaaactccatctcagcttttcttctcacttcatgtgaaaactactccagtggctgactgaattgctgacccttcaagctc

SEQ ID NO: 414 - DNA, 201 bp, Homo sapiens
gcctagtcggcatcatcgtgggcaccgtcctcatcataaagtctctgcgttctggccatgacccccgggcccaggggaccctgtgaaatactgtaaaggtracaaaatatctgaacagaagaggacttaggagagatctgaactccagctgccctacaaactccatctcagcttttcttctcacttcatgtgaaaactact

SEQ ID NO: 415 - DNA, 201 bp, Homo sapiens
tatattgaacaacaacttgaataccttgatccagcgttccaaccacactcaggccaccaacgatccccctgaggtgaccgtgtttcccaaggagcctgtgyagctgggccagcccaacaccctcatctgccacattgacaagttcttcccaccagtgctcaacgtcacgtggctgtgcaacggggagctggtcactgaggg

SEQ ID NO: 416 - DNA, 201 bp, Homo sapiens
gggcgggctggctaacattgctatattgaacaacaacttgaataccttgatccagcgttccaaccacactcaggccaccaacgatccccctgaggtgaccytgtttcccaaggagcctgtggagctgggccagcccaacaccctcatctgccacattgacaagttcttcccaccagtgctcaacgtcacgtggctgtgcaa

SEQ ID NO: 417 - DNA, 201 bp, Homo sapiens
cagggcgggctggctaacattgctatattgaacaacaacttgaataccttgatccagcgttccaaccacactcaggccaccaacgatccccctgaggtgaycgtgtttcccaaggagcctgtggagctgggccagcccaacaccctcatctgccacattgacaagttcttcccaccagtgctcaacgtcacgtggctgtgc

SEQ ID NO: 418 - DNA, 201 bp, Homo sapiens
tcttcctgcccagaacagattacagcttccacaagttccattacctgacctttgtgccctcagcagaggacttctatgactgcagggtggagcactggggwttggaccagccgctcctcaagcactgggaggcccaagagccaatccagatgcctgagacaacggagactgtgctctgtgccctgggcctggtgctgggcc

SEQ ID NO: 419 - DNA, 201 bp, Homo sapiens
gctgagagcctcttcctgcccagaacagattacagcttccacaagttccattacctgacctttgtgccctcagcagaggacttctatgactgcagggtggrgcactggggcttggaccagccgctcctcaagcactgggaggcccaagagccaatccagatgcctgagacaacggagactgtgctctgtgccctgggcctg

SEQ ID NO: 420 - DNA, 169 bp, Homo sapiens
tccttagtaaagtttccaacaaatagaaattaatgacactttggtagcactaatatggagattatcctttcattgagccttttatcctctgttctcctttyaagaacccctcactgtcaccttcccgagaataccctaagaccaataaatacttcagtatttcagagcg

SEQ ID NO: 421 - DNA, 168 bp, Homo sapiens
ccttagtaaagtttccaacaaatagaaattaatgacactttggtagcactaatatggagattatcctttcattgagccttttatcctctgttctcctttgragaacccctcactgtcaccttcccgagaataccctaagaccaataaatacttcagtatttcagagcg

SEQ ID NO: 422 - DNA, 88 bp, Homo sapiens
tatcctctgttctcctttgaagaacccctcactgtcaccttcccgagaataccctaagaccaataaatacttcagtatttcagagcgr

SEQ ID NO: 423 - DNA, 201 bp, Homo sapiens
tgaaatactgtaaaggtgacaaaatatctgaacagaagaggacttaggagagatctgaactccagctgccctacaaactccatctcagcttttcttctcayttcatgtgaaaactactccagtggctgactgaattgctgacccttcaagctctgtccttatccattacctcaaagcagtcattccttagtaaagtttcca

SEQ ID NO: 424 - DNA, 201 bp, Homo sapiens
agagccaatccagatgcctgagacaacggagactgtgctctgtgccctgggcctggtgctgggcctagtcggcatcatcgtgggcaccgtcctcatcatamagtctctgcgttctggccatgacccccgggcccaggggaccctgtgaaatactgtaaaggtgacaaaatatctgaacagaagaggacttaggagagatct

SEQ ID NO: 425 - DNA, 201 bp, Homo sapiens
agctggggccatcaaggcggaccatgtgtcaacttatgccgcgtttgtacagacgcatagaccaacaggggagtttatgtttgaatttgatgaagatgagwtgttctatgtggatctggacaagaaggagaccgtctggcatctggaggagtttggccaagccttttcctttgaggctcagggcgggctggctaacattgc

SEQ ID NO: 426 - DNA, 201 bp, Homo sapiens
ctcaagcactgggaggcccaagagccaatccagatgcctgagacaacggagactgtgctctgtgccctgggcctggtgctgggcctagtcggcatcatcgygggcaccgtcctcatcataaagtctctgcgttctggccatgacccccgggcccaggggaccctgtgaaatactgtaaaggtgacaaaatatctgaacaga

SEQ ID NO: 427 - DNA, 201 bp, Homo sapiens
ccagcccaacaccctcatctgccacattgacaagttcttcccaccagtgctcaacgtcacgtggctgtgcaacggggagctggtcactgagggtgtcgctsagagcctcttcctgcccagaacagattacagcttccacaagttccattacctgacctttgtgccctcagcagaggacttctatgactgcagggtggagca

SEQ ID NO: 428 - DNA, 201 bp, Homo sapiens
tgggcctagtcggcatcatcgtgggcaccgtcctcatcataaagtctctgcgttctggccatgacccccgggcccaggggaccctgtgaaatactgtaaaygtgacaaaatatctgaacagaagaggacttaggagagatctgaactccagctgccctacaaactccatctcagcttttcttctcacttcatgtgaaaact

SEQ ID NO: 429 - DNA, 201 bp, Homo sapiens
cctgagacaacggagactgtgctctgtgccctgggcctggtgctgggcctagtcggcatcatcgtgggcaccgtcctcatcataaagtctctgcgttctgkccatgacccccgggcccaggggaccctgtgaaatactgtaaaggtgacaaaatatctgaacagaagaggacttaggagagatctgaactccagctgccct

SEQ ID NO: 430 - DNA, 201 bp, Homo sapiens
tccagatgcctgagacaacggagactgtgctctgtgccctgggcctggtgctgggcctagtcggcatcatcgtgggcaccgtcctcatcataaagtctctrcgttctggccatgacccccgggcccaggggaccctgtgaaatactgtaaaggtgacaaaatatctgaacagaagaggacttaggagagatctgaactcca

SEQ ID NO: 431 - DNA, 201 bp, Homo sapiens
tctccaggaagcgctgtgtcccattaaacgcgtagcattcctgccgtccctggaaaagtgctagaggcccacagtttcagtctcatctgcctccactcggyctcagttcctcatcactgttcctgtgctcacagtcatcaattatagaccccacaacatgcgccctgaagacagaatgttccatatcagagctgtgatctt

SEQ ID NO: 432 - DNA, 201 bp, Homo sapiens
  misc_feature (1)...(201): n = A,T,C or G, or insertion/deletion polymorphism (see Tables 1-2)
tggacaagaaggagaccgtctggcatctggaggagtttggccaagccttttcctttgaggctcagggcgggctggctaacattgctatattgaacaacaanttgaataccttgatccagcgttccaaccacactcaggccaccaacgatccccctgaggtgaccgtgtttcccaaggagcctgtggagctgggccagccca

SEQ ID NO: 433 - DNA, 201 bp, Homo sapiens
tctccttggctttcctgctgagtctccgaggagctggggccatcaaggcggaccatgtgtcaacttatgccgcgtttgtacagacgcatagaccaacaggygagtttatgtttgaatttgatgaagatgagatgttctatgtggatctggacaagaaggagaccgtctggcatctggaggagtttggccaagccttttcct

SEQ ID NO: 434 - DNA, 201 bp, Homo sapiens
gagagccctctccttggctttcctgctgagtctccgaggagctggggccatcaaggcggaccatgtgtcaacttatgccgcgtttgtacagacgcatagaycaacaggggagtttatgtttgaatttgatgaagatgagatgttctatgtggatctggacaagaaggagaccgtctggcatctggaggagtttggccaagc

SEQ ID NO: 435 - DNA, 201 bp, Homo sapiens
gaatgttccatatcagagctgtgatcttgagagccctctccttggctttcctgctgagtctccgaggagctggggccatcaaggcggaccatgtgtcaacytatgccgcgtttgtacagacgcatagaccaacaggggagtttatgtttgaatttgatgaagatgagatgttctatgtggatctggacaagaaggagaccg

SEQ ID NO: 436 - DNA, 201 bp, Homo sapiens
gctgggccagcccaacaccctcatctgccacattgacaagttcttcccaccagtgctcaacgtcacgtggctgtgcaacggggagctggtcactgagggtrtcgctgagagcctcttcctgcccagaacagattacagcttccacaagttccattacctgacctttgtgccctcagcagaggacttctatgactgcagggt

SEQ ID NO: 437 - DNA, 201 bp, Homo sapiens
aggcccaagagccaatccagatgcctgagacaacggagactgtgctctgtgccctgggcctggtgctgggcctagtcggcatcatcgtgggcaccgtcctsatcataaagtctctgcgttctggccatgacccccgggcccaggggaccctgtgaaatactgtaaaggtgacaaaatatctgaacagaagaggacttagga

SEQ ID NO: 438 - DNA, 201 bp, Homo sapiens
caacggagactgtgctctgtgccctgggcctggtgctgggcctagtcggcatcatcgtgggcaccgtcctcatcataaagtctctgcgttctggccatgarccccgggcccaggggaccctgtgaaatactgtaaaggtgacaaaatatctgaacagaagaggacttaggagagatctgaactccagctgccctacaaact

SEQ ID NO: 439 - DNA, 201 bp, Homo sapiens
ctgtgctctgtgccctgggcctggtgctgggcctagtcggcatcatcgtgggcaccgtcctcatcataaagtctctgcgttctggccatgacccccgggchcaggggaccctgtgaaatactgtaaaggtgacaaaatatctgaacagaagaggacttaggagagatctgaactccagctgccctacaaactccatctcag

SEQ ID NO: 440 - DNA, 72 bp, Homo sapiens
ttgaagaacccctcactgtcaccttcccgagaataccctaagaccaataaatacttcagtatttcagagcgk

SEQ ID NO: 441 - DNA, 201 bp, Homo sapiens
ttccatatcagagctgtgatcttgagagccctctccttggctttcctgctgagtctccgaggagctggggccatcaaggcggaccatgtgtcaacttatgmcgcgtttgtacagacgcatagaccaacaggggagtttatgtttgaatttgatgaagatgagatgttctatgtggatctggacaagaaggagaccgtctgg

SEQ ID NO: 442 - DNA, 201 bp, Homo sapiens
tttggccaagccttttcctttgaggctcagggcgggctggctaacattgctatattgaacaacaacttgaataccttgatccagcgttccaaccacactcyggccaccaacgatccccctgaggtgaccgtgtttcccaaggagcctgtggagctgggccagcccaacaccctcatctgccacattgacaagttcttccca

SEQ ID NO: 443 - DNA, 201 bp, Homo sapiens
ggagctggtcactgagggtgtcgctgagagcctcttcctgcccagaacagattacagcttccacaagttccattacctgacctttgtgccctcagcagagsacttctatgactgcagggtggagcactggggcttggaccagccgctcctcaagcactgggaggcccaagagccaatccagatgcctgagacaacggagac

SEQ ID NO: 444 - DNA, 201 bp, Homo sapiens
ggggagctggtcactgagggtgtcgctgagagcctcttcctgcccagaacagattacagcttccacaagttccattacctgacctttgtgccctcagcagmggacttctatgactgcagggtggagcactggggcttggaccagccgctcctcaagcactgggaggcccaagagccaatccagatgcctgagacaacggag

SEQ ID NO: 445 - DNA, 201 bp, Homo sapiens
acggggagctggtcactgagggtgtcgctgagagcctcttcctgcccagaacagattacagcttccacaagttccattacctgacctttgtgccctcagcwgaggacttctatgactgcagggtggagcactggggcttggaccagccgctcctcaagcactgggaggcccaagagccaatccagatgcctgagacaacgg

SEQ ID NO: 446 - DNA, 201 bp, Homo sapiens
  misc_feature (1)...(201): n = A,T,C or G, or insertion/deletion polymorphism (see Tables 1-2)
gtgcaacggggagctggtcactgagggtgtcgctgagagcctcttcctgcccagaacagattacagcttccacaagttccattacctgacctttgtgcccncagcagaggacttctatgactgcagggtggagcactggggcttggaccagccgctcctcaagcactgggaggcccaagagccaatccagatgcctgagac

SEQ ID NO: 447 - DNA, 201 bp, Homo sapiens
gtagatgtatctctccaggaagcgctgtgtcccattaaacgcgtagcattcctgccgtccctggaaaagtgctagaggcccacagtttcagtctcatctgwctccactcggcctcagttcctcatcactgttcctgtgctcacagtcatcaattatagaccccacaacatgcgccctgaagacagaatgttccatatcaga

SEQ ID NO: 448 - DNA, 201 bp, Homo sapiens
ggaagcgctgtgtcccattaaacgcgtagcattcctgccgtccctggaaaagtgctagaggcccacagtttcagtctcatctgcctccactcggcctcagstcctcatcactgttcctgtgctcacagtcatcaattatagaccccacaacatgcgccctgaagacagaatgttccatatcagagctgtgatcttgagagc

SEQ ID NO: 449 - DNA, 201 bp, Homo sapiens
aatttgatgaagatgagatgttctatgtggatctggacaagaaggagaccgtctggcatctggaggagtttggccaagccttttcctttgaggctcagggsgggctggctaacattgctatattgaacaacaacttgaataccttgatccagcgttccaaccacactcaggccaccaacgatccccctgaggtgaccgtgt

SEQ ID NO: 450 - DNA, 201 bp, Homo sapiens
ctgtgccctgggcctggtgctgggcctagtcggcatcatcgtgggcaccgtcctcatcataaagtctctgcgttctggccatgacccccgggcccaggggmccctgtgaaatactgtaaaggtgacaaaatatctgaacagaagaggacttaggagagatctgaactccagctgccctacaaactccatctcagcttttct

SEQ ID NO: 451 - DNA, 201 bp, Homo sapiens
accgtgtttcccaaggagcctgtggagctgggccagcccaacaccctcatctgccacattgacaagttcttcccaccagtgctcaacgtcacgtggctgtycaacggggagctggtcactgagggtgtcgctgagagcctcttcctgcccagaacagattacagcttccacaagttccattacctgacctttgtgccctca

SEQ ID NO: 452 - DNA, 201 bp, Homo sapiens
ctatattgaacaacaacttgaataccttgatccagcgttccaaccacactcaggccaccaacgatccccctgaggtgaccgtgtttcccaaggagcctgtygagctgggccagcccaacaccctcatctgccacattgacaagttcttcccaccagtgctcaacgtcacgtggctgtgcaacggggagctggtcactgagg

SEQ ID NO: 453 - DNA, 201 bp, Homo sapiens
ggccgccccagctccgtcaccgcccggaactcccccacgtcgctgtcgaagcgcgcgaactcctcccggttgtagatgtatctctccaggaagcgctgtgkcccattaaacgcgtagcattcctgccgtccctggaaaagtgctagaggcccacagtttcagtctcatctgcctccactcggcctcagttcctcatcactg

SEQ ID NO: 454 - DNA, 201 bp, Homo sapiens
cgctgtcgaagcgcgcgaactcctcccggttgtagatgtatctctccaggaagcgctgtgtcccattaaacgcgtagcattcctgccgtccctggaaaagygctagaggcccacagtttcagtctcatctgcctccactcggcctcagttcctcatcactgttcctgtgctcacagtcatcaattatagaccccacaacat

SEQ ID NO: 455 - DNA, 201 bp, Homo sapiens
aggccgccccagctccgtcaccgcccggaactcccccacgtcgctgtcgaagcgcgcgaactcctcccggttgtagatgtatctctccaggaagcgctgtwtcccattaaacgcgtagcattcctgccgtccctggaaaagtgctagaggcccacagtttcagtctcatctgcctccactcggcctcagttcctcatcact

SEQ ID NO: 456 - DNA, 201 bp, Homo sapiens
cacgtcgctgtcgaagcgcgcgaactcctcccggttgtagatgtatctctccaggaagcgctgtgtcccattaaacgcgtagcattcctgccgtccctggraaagtgctagaggcccacagtttcagtctcatctgcctccactcggcctcagttcctcatcactgttcctgtgctcacagtcatcaattatagaccccac

SEQ ID NO: 457 - DNA, 196 bp, Homo sapiens
tccaggatgtccttctggctgttccagtactccgcagcaggccgccccagctccgtcaccgcccggaactcccccacgtcgctgtcgaagcgcgcraactcctcccggttgtagatgtatctctccaggaagcgctgtgtcccattaaacgcgtagcattcctgccgtccctggaaaagtgctagaggcccacagt

SEQ ID NO: 458 - DNA, 143 bp, Homo sapiens
aaattaatgacactttggtagcactaatatggagattatcctttcattgagccttttatcctctgttctcctttgaagaacccctcactgtcaccttcccyagaataccctaagaccaataaatacttcagtatttcagagcg

SEQ ID NO: 459 - DNA, 103 bp, Homo sapiens; identical to SEQ ID NO: 330

SEQ ID NO: 460 - DNA, 201 bp, Homo sapiens
accacactcaggccaccaacgatccccctgaggtgaccgtgtttcccaaggagcctgtggagctgggccagcccaacaccctcatctgccacattgacaakttcttcccaccagtgctcaacgtcacgtggctgtgcaacggggagctggtcactgagggtgtcgctgagagcctcttcctgcccagaacagattacagct

SEQ ID NO: 461 - DNA, 173 bp, Homo sapiens
tcattccttagtaaagtttccaacaaatagaaattaatgacactttggtagcactaatatggagattatcctttcattgagccttttatcctctgttctcrtttgaagaacccctcactgtcaccttcccgagaataccctaagaccaataaatacttcagtatttcagagcg

SEQ ID NO: 462 - DNA, 101 bp, Homo sapiens; identical to SEQ ID NO: 333

SEQ ID NO: 463 - DNA, 201 bp, Homo sapiens
ccccacgtcgctgtcgaagcgcgcgaactcctcccggttgtagatgtatctctccaggaagcgctgtgtcccattaaacgcgtagcattcctgccgtcccyggaaaagtgctagaggcccacagtttcagtctcatctgcctccactcggcctcagttcctcatcactgttcctgtgctcacagtcatcaattatagaccc

SEQ ID NO: 464 - DNA, 201 bp, Homo sapiens
aactcccccacgtcgctgtcgaagcgcgcgaactcctcccggttgtagatgtatctctccaggaagcgctgtgtcccattaaacgcgtagcattcctgccytccctggaaaagtgctagaggcccacagtttcagtctcatctgcctccactcggcctcagttcctcatcactgttcctgtgctcacagtcatcaattata

SEQ ID NO: 465 - DNA, 201 bp, Homo sapiens
ccgtcaccgcccggaactcccccacgtcgctgtcgaagcgcgcgaactcctcccggttgtagatgtatctctccaggaagcgctgtgtcccattaaacgcytagcattcctgccgtccctggaaaagtgctagaggcccacagtttcagtctcatctgcctccactcggcctcagttcctcatcactgttcctgtgctcac

SEQ ID NO: 466 - DNA, 201 bp, Homo sapiens
tgctgacccttcaagctctgtccttatccattacctcaaagcagtcattccttagtaaagtttccaacaaatagaaattaatgacactttggtagcactartatggagattatcctttcattgagccttttatcctctgttctcctttgaagaacccctcactgtcaccttcccgagaataccctaagaccaataaatact

SEQ ID NO: 467 - DNA, 201 bp, Homo sapiens
  misc_feature (1)...(201): n = A,T,C or G, or insertion/deletion polymorphism (see Tables 1-2)
tgtgcaacggggagctggtcactgagggtgtcgctgagagcctcttcctgcccagaacagattacagcttccacaagttccattacctgacctttgtgccntcagcagaggacttctatgactgcagggtggagcactggggcttggaccagccgctcctcaagcactgggaggcccaagagccaatccagatgcctgaga

SEQ ID NO: 468 - DNA, 201 bp, Homo sapiens
agctgggccagcccaacaccctcatctgccacattgacaagttcttcccaccagtgctcaacgtcacgtggctgtgcaacggggagctggtcactgagggwgtcgctgagagcctcttcctgcccagaacagattacagcttccacaagttccattacctgacctttgtgccctcagcagaggacttctatgactgcaggg

SEQ ID NO: 469 - DNA, 201 bp, Homo sapiens
tggagctgggccagcccaacaccctcatctgccacattgacaagttcttcccaccagtgctcaacgtcacgtggctgtgcaacggggagctggtcactgarggtgtcgctgagagcctcttcctgcccagaacagattacagcttccacaagttccattacctgacctttgtgccctcagcagaggacttctatgactgca

SEQ ID NO: 470 - DNA, 201 bp, Homo sapiens
ccaaccacactcaggccaccaacgatccccctgaggtgaccgtgtttcccaaggagcctgtggagctgggccagcccaacaccctcatctgccacattgakaagttcttcccaccagtgctcaacgtcacgtggctgtgcaacggggagctggtcactgagggtgtcgctgagagcctcttcctgcccagaacagattaca

SEQ ID NO: 471 - DNA, 201 bp, Homo sapiens
cgttccaaccacactcaggccaccaacgatccccctgaggtgaccgtgtttcccaaggagcctgtggagctgggccagcccaacaccctcatctgccacastgacaagttcttcccaccagtgctcaacgtcacgtggctgtgcaacggggagctggtcactgagggtgtcgctgagagcctcttcctgcccagaacagat

SEQ ID NO: 472 - DNA, 201 bp, Homo sapiens
caacttgaataccttgatccagcgttccaaccacactcaggccaccaacgatccccctgaggtgaccgtgtttcccaaggagcctgtggagctgggccagkccaacaccctcatctgccacattgacaagttcttcccaccagtgctcaacgtcacgtggctgtgcaacggggagctggtcactgagggtgtcgctgagag

SEQ ID NO: 473 - DNA, 195 bp, Homo sapiens
cttatccattacctcaaagcagtcattccttagtaaagtttccaacaaatagaaattaatgacactttggtagcactaatatggagattatcctttcattyagccttttatcctctgttctcctttgaagaacccctcactgtcaccttcccgagaataccctaagaccaataaatacttcagtatttcagagcg

SEQ ID NO: 474 - DNA, 189 bp, Homo sapiens
cattacctcaaagcagtcattccttagtaaagtttccaacaaatagaaattaatgacactttggtagcactaatatggagattatcctttcattgagcctrttatcctctgttctcctttgaagaacccctcactgtcaccttcccgagaataccctaagaccaataaatacttcagtatttcagagcg

SEQ ID NO: 475 - DNA, 177 bp, Homo sapiens
gcagtcattccttagtaaagtttccaacaaatagaaattaatgacactttggtagcactaatatggagattatcctttcattgagccttttatcctctgtyctcctttgaagaacccctcactgtcaccttcccgagaataccctaagaccaataaatacttcagtatttcagagcg

SEQ ID NO: 476 - DNA, 201 bp, Homo sapiens
gttctatgtggatctggacaagaaggagaccgtctggcatctggaggagtttggccaagccttttcctttgaggctcagggcgggctggctaacattgctytattgaacaacaacttgaataccttgatccagcgttccaaccacactcaggccaccaacgatccccctgaggtgaccgtgtttcccaaggagcctgtgga

SEQ ID NO: 477 - DNA, 201 bp, Homo sapiens
tgtgccctgggcctggtgctgggcctagtcggcatcatcgtgggcaccgtcctcatcataaagtctctgcgttctggccatgacccccgggcccaggggawcctgtgaaatactgtaaaggtgacaaaatatctgaacagaagaggacttaggagagatctgaactccagctgccctacaaactccatctcagcttttctt

SEQ ID NO: 478 - DNA, 201 bp, Homo sapiens
ggagaccgtctggcatctggaggagtttggccaagccttttcctttgaggctcagggcgggctggctaacattgctatattgaacaacaacttgaataccytgatccagcgttccaaccacactcaggccaccaacgatccccctgaggtgaccgtgtttcccaaggagcctgtggagctgggccagcccaacaccctcat

SEQ ID NO: 479 - DNA, 201 bp, Homo sapiens; identical to SEQ ID NO: 310

SEQ ID NO: 480 - DNA, 201 bp, Homo sapiens
ccaagccttttcctttgaggctcagggcgggctggctaacattgctatattgaacaacaacttgaataccttgatccagcgttccaaccacactcaggccyccaacgatccccctgaggtgaccgtgtttcccaaggagcctgtggagctgggccagcccaacaccctcatctgccacattgacaagttcttcccaccagt

SEQ ID NO: 481 - DNA, 201 bp, Homo sapiens
cctcaagcactgggaggcccaagagccaatccagatgcctgagacaacggagactgtgctctgtgccctgggcctggtgctgggcctagtcggcatcatcrtgggcaccgtcctcatcataaagtctctgcgttctggccatgacccccgggcccaggggaccctgtgaaatactgtaaaggtgacaaaatatctgaacag

SEQ ID NO: 482 - DNA, 201 bp, Homo sapiens
agctccgtcaccgcccggaactcccccacgtcgctgtcgaagcgcgcgaactcctcccggttgtagatgtatctctccaggaagcgctgtgtcccattaarcgcgtagcattcctgccgtccctggaaaagtgctagaggcccacagtttcagtctcatctgcctccactcggcctcagttcctcatcactgttcctgtgc

SEQ ID NO: 483 - DNA, 201 bp, Homo sapiens
cgccccagctccgtcaccgcccggaactcccccacgtcgctgtcgaagcgcgcgaactcctcccggttgtagatgtatctctccaggaagcgctgtgtccmattaaacgcgtagcattcctgccgtccctggaaaagtgctagaggcccacagtttcagtctcatctgcctccactcggcctcagttcctcatcactgttc

SEQ ID NO: 484 - DNA, 201 bp, Homo sapiens
tgaactccagctgccctacaaactccatctcagcttttcttctcacttcatgtgaaaactactccagtggctgactgaattgctgacccttcaagctctgyccttatccattacctcaaagcagtcattccttagtaaagtttccaacaaatagaaattaatgacactttggtagcactaatatggagattatcctttcat

SEQ ID NO: 485 - DNA, 168 bp, Homo sapiens
caggagctccctttagcgagtccttcttttcctgactgcagctcttttcattttgccatccttttccwgctccatgatggttctgcaggtttctgcggccccccggacagtggctctgacggcgttactgatggtgctgctcacatctgtggtccagggcagggccac

SEQ ID NO: 486 - DNA, 201 bp, Homo sapiens
cggatttctacccaggcagcattcaagtccgatggttcctgaatggacaggaggaaacagctggggtcgtgtccaccaacctgatccgtaatggagactgmaccttccagatcctggtgatgctggaaatgaccccccagcagggagatgtctacacctgccaagtggagcacaccagcctggatagtcctgtcaccgtgg

SEQ ID NO: 487 - DNA, 201 bp, Homo sapiens
tccagggacggcaggaatgctacgcgtttaatgggacacagcgcttcctggagagatacatctacaaccgggaggagttcgcgcgcttcgacagcgacgtrggggagttccgggcggtgacggagctggggcggcctgctgcggagtactggaacagccagaaggacatcctggaggagaagcgggcagtgccggacagga

SEQ ID NO: 488 - DNA, 201 bp, Homo sapiens
cggtgacggagctggggcggcctgctgcggagtactggaacagccagaaggacatcctggaggagaagcgggcagtgccggacaggatgtgcagacacaaytacgagctgggcgggcccatgaccctgcagcgccgagtccagcctagggtgaatgtttccccctccaagaaggggcccttgcagcaccacaacctgcttg

SEQ ID NO: 489 - DNA, 201 bp, Homo sapiens
ggagctccctttagcgagtccttcttttcctgactgcagctcttttcattttgccatccttttccagctccatgatggttctgcaggtttctgcggccccscggacagtggctctgacggcgttactgatggtgctgctcacatctgtggtccagggcagggccactccagagaattaccttttccagggacggcaggaat

SEQ ID NO: 490 - DNA, 201 bp, Homo sapiens
agctccctttagcgagtccttcttttcctgactgcagctcttttcattttgccatccttttccagctccatgatggttctgcaggtttctgcggcccccckgacagtggctctgacggcgttactgatggtgctgctcacatctgtggtccagggcagggccactccagagaattaccttttccagggacggcaggaatgc

SEQ ID NO: 491 - DNA, 201 bp, Homo sapiens
acgcgtttaatgggacacagcgcttcctggagagatacatctacaaccgggaggagttcgcgcgcttcgacagcgacgtgggggagttccgggcggtgacrgagctggggcggcctgctgcggagtactggaacagccagaaggacatcctggaggagaagcgggcagtgccggacaggatgtgcagacacaactacgagc

SEQ ID NO: 492 - DNA, 201 bp, Homo sapiens
ctccctttagcgagtccttcttttcctgactgcagctcttttcattttgccatccttttccagctccatgatggttctgcaggtttctgcggccccccggwcagtggctctgacggcgttactgatggtgctgctcacatctgtggtccagggcagggccactccagagaattaccttttccagggacggcaggaatgcta

SEQ ID NO: 493 - DNA, 201 bp, Homo sapiens
  misc_feature (1)...(201): n = A,T,C or G, or insertion/deletion polymorphism (see Tables 1-2)
tttagcgagtccttcttttcctgactgcagctcttttcattttgccatccttttccagctccatgatggttctgcaggtttctgcggccccccggacagtngctctgacggcgttactgatggtgctgctcacatctgtggtccagggcagggccactccagagaattaccttttccagggacggcaggaatgctacgcgt

SEQ ID NO: 494 - DNA, 201 bp, Homo sapiens
gcgtttaatgggacacagcgcttcctggagagatacatctacaaccgggaggagttcgcgcgcttcgacagcgacgtgggggagttccgggcggtgacggrgctggggcggcctgctgcggagtactggaacagccagaaggacatcctggaggagaagcgggcagtgccggacaggatgtgcagacacaactacgagctg

SEQ ID NO: 495 - DNA, 201 bp, Homo sapiens
taaagaagttcattttggtttaaacataggaaagaagagaaccatgaaaatggggatatgttaactattgtataatggggcctgttacacatgacactctkctgaattgactgtatttcagtgagctgcccccaaatcaagtttagtgccctcatccatttatgtctcagaccactattcttaactattcaatggtgagca

SEQ ID NO: 496 - DNA, 201 bp, Homo sapiens
ctgtcaccgtggagtggaaggcacagtctgattctgcccggagtaagacattgacgggagctgggggcttcgtgctggggctcatcatctgtggagtgggwatcttcatgcacaggaggagcaagaaagaggcacagtctgattctgcccggagtaagacattgacgggagctgggggcttcgtgctggggctcatcatct

SEQ ID NO: 497 - DNA, 201 bp, Homo sapiens
caccagcctggatagtcctgtcaccgtggagtggaaggcacagtctgattctgcccggagtaagacattgacgggagctgggggcttcgtgctggggctcstcatctgtggagtgggcatcttcatgcacaggaggagcaagaaagaggcacagtctgattctgcccggagtaagacattgacgggagctgggggcttcgt

SEQ ID NO: 498 - DNA, 201 bp, Homo sapiens
cgggcagtgccggacaggatgtgcagacacaactacgagctgggcgggcccatgaccctgcagcgccgagtccagcctagggtgaatgtttccccctccasgaaggggcccttgcagcaccacaacctgcttgtctgccacgtgacggatttctacccaggcagcattcaagtccgatggttcctgaatggacaggaggaa

SEQ ID NO: 499 - DNA, 201 bp, Homo sapiens
cctggagagatacatctacaaccgggaggagttcgcgcgcttcgacagcgacgtgggggagttccgggcggtgacggagctggggcggcctgctgcggagdactggaacagccagaaggacatcctggaggagaagcgggcagtgccggacaggatgtgcagacacaactacgagctgggcgggcccatgaccctgcagcg

SEQ ID NO: 500 - DNA, 201 bp, Homo sapiens
gtggctctgacggcgttactgatggtgctgctcacatctgtggtccagggcagggccactccagagaattaccttttccagggacggcaggaatgctacgrgtttaatgggacacagcgcttcctggagagatacatctacaaccgggaggagttcgcgcgcttcgacagcgacgtgggggagttccgggcggtgacggag

SEQ ID NO: 501 - DNA, 201 bp, Homo sapiens
ccagggacggcaggaatgctacgcgtttaatgggacacagcgcttcctggagagatacatctacaaccgggaggagttcgcgcgcttcgacagcgacgtgrgggagttccgggcggtgacggagctggggcggcctgctgcggagtactggaacagccagaaggacatcctggaggagaagcgggcagtgccggacaggat

SEQ ID NO: 502 - DNA, 201 bp, Homo sapiens
ggagagatacatctacaaccgggaggagttcgcgcgcttcgacagcgacgtgggggagttccgggcggtgacggagctggggcggcctgctgcggagtacrggaacagccagaaggacatcctggaggagaagcgggcagtgccggacaggatgtgcagacacaactacgagctgggcgggcccatgaccctgcagcgccg

SEQ ID NO: 503 - DNA, 201 bp, Homo sapiens
gtgctggggctcatcatctgtggagtgggcatcttcatgcacaggaggagcaagaaagaggcacagtctgattctgcccggagtaagacattgacgggagktgggggcttcgtgctggggctcatcatctgtggagtgggcatcttcatgcacaggaggagcaagaaagttcaacgaggatctgcataaacagggttcctg

SEQ ID NO: 504 - DNA, 201 bp, Homo sapiens
gaatgtttccccctccaagaaggggcccttgcagcaccacaacctgcttgtctgccacgtgacggatttctacccaggcagcattcaagtccgatggttcwtgaatggacaggaggaaacagctggggtcgtgtccaccaacctgatccgtaatggagactggaccttccagatcctggtgatgctggaaatgacccccca

SEQ ID NO: 505 - DNA, 201 bp, Homo sapiens
ttctgcccggagtaagacattgacgggagctgggggcttcgtgctggggctcatcatctgtggagtgggcatcttcatgcacaggaggagcaagaaagagycacagtctgattctgcccggagtaagacattgacgggagctgggggcttcgtgctggggctcatcatctgtggagtgggcatcttcatgcacaggaggag

SEQ ID NO: 506 - DNA, 201 bp, Homo sapiens
tgctggggctcatcatctgtggagtgggcatcttcatgcacaggaggagcaagaaagaggcacagtctgattctgcccggagtaagacattgacgggagcwgggggcttcgtgctggggctcatcatctgtggagtgggcatcttcatgcacaggaggagcaagaaagttcaacgaggatctgcataaacagggttcctga

SEQ ID NO: 507 - DNA, 201 bp, Homo sapiens
cccggagtaagacattgacgggagctgggggcttcgtgctggggctcatcatctgtggagtgggcatcttcatgcacaggaggagcaagaaagaggcacartctgattctgcccggagtaagacattgacgggagctgggggcttcgtgctggggctcatcatctgtggagtgggcatcttcatgcacaggaggagcaaga

SEQ ID NO: 508 - DNA, 201 bp, Homo sapiens
gaggagcaagaaagaggcacagtctgattctgcccggagtaagacattgacgggagctgggggcttcgtgctggggctcatcatctgtggagtgggcatcrtcatgcacaggaggagcaagaaagttcaacgaggatctgcataaacagggttcctgagctcactgaaaagactattgtgccttaggaaaagcatttgctg

SEQ ID NO: 509 - DNA, 201 bp, Homo sapiens
atctgtggtccagggcagggccactccagagaattaccttttccagggacggcaggaatgctacgcgtttaatgggacacagcgcttcctggagagatacmtctacaaccgggaggagttcgcgcgcttcgacagcgacgtgggggagttccgggcggtgacggagctggggcggcctgctgcggagtactggaacagcca

SEQ ID NO: 510 - DNA, 201 bp, Homo sapiens
tggttctgcaggtttctgcggccccccggacagtggctctgacggcgttactgatggtgctgctcacatctgtggtccagggcagggccactccagagaastaccttttccagggacggcaggaatgctacgcgtttaatgggacacagcgcttcctggagagatacatctacaaccgggaggagttcgcgcgcttcgaca

SEQ ID NO: 511 - DNA, 201 bp, Homo sapiens
gggcatcttcatgcacaggaggagcaagaaagttcaacgaggatctgcataaacagggttcctgagctcactgaaaagactattgtgccttaggaaaagcrtttgctgtgtttcgttagcatctggctccaggacagaccttcaacttccaaattggatactgctgccaagaagttgctctgaagtcagtttctatcattc

SEQ ID NO: 512 - DNA, 201 bp, Homo sapiens
gcatcttcatgcacaggaggagcaagaaagttcaacgaggatctgcataaacagggttcctgagctcactgaaaagactattgtgccttaggaaaagcatstgctgtgtttcgttagcatctggctccaggacagaccttcaacttccaaattggatactgctgccaagaagttgctctgaagtcagtttctatcattctg

SEQ ID NO: 513 - DNA, 201 bp, Homo sapiens
catgcacaggaggagcaagaaagttcaacgaggatctgcataaacagggttcctgagctcactgaaaagactattgtgccttaggaaaagcatttgctgtytttcgttagcatctggctccaggacagaccttcaacttccaaattggatactgctgccaagaagttgctctgaagtcagtttctatcattctgctctttg

SEQ ID NO: 514 - DNA, 201 bp, Homo sapiens
ggagtaagacattgacgggagctgggggcttcgtgctggggctcatcatctgtggagtgggcatcttcatgcacaggaggagcaagaaagaggcacagtcygattctgcccggagtaagacattgacgggagctgggggcttcgtgctggggctcatcatctgtggagtgggcatcttcatgcacaggaggagcaagaaag

SEQ ID NO: 515 - DNA, 201 bp, Homo sapiens
aagttcaacgaggatctgcataaacagggttcctgagctcactgaaaagactattgtgccttaggaaaagcatttgctgtgtttcgttagcatctggctcyaggacagaccttcaacttccaaattggatactgctgccaagaagttgctctgaagtcagtttctatcattctgctctttgattcaaagcactgtttctct

SEQ ID NO: 516 - DNA, 201 bp, Homo sapiens
aagacattgacgggagctgggggcttcgtgctggggctcatcatctgtggagtgggcatcttcatgcacaggaggagcaagaaagaggcacagtctgattytgcccggagtaagacattgacgggagctgggggcttcgtgctggggctcatcatctgtggagtgggcatcttcatgcacaggaggagcaagaaagttcaa

SEQ ID NO: 517 - DNA, 201 bp, Homo sapiens
acgaggatctgcataaacagggttcctgagctcactgaaaagactattgtgccttaggaaaagcatttgctgtgtttcgttagcatctggctccaggacaraccttcaacttccaaattggatactgctgccaagaagttgctctgaagtcagtttctatcattctgctctttgattcaaagcactgtttctctcactggg

SEQ ID NO: 518 - DNA, 201 bp, Homo sapiens
agctgggggcttcgtgctggggctcatcatctgtggagtgggcatcttcatgcacaggaggagcaagaaagaggcacagtctgattctgcccggagtaagycattgacgggagctgggggcttcgtgctggggctcatcatctgtggagtgggcatcttcatgcacaggaggagcaagaaagttcaacgaggatctgcata

SEQ ID NO: 519 - DNA, 201 bp, Homo sapiens
tgcataaacagggttcctgagctcactgaaaagactattgtgccttaggaaaagcatttgctgtgtttcgttagcatctggctccaggacagaccttcaayttccaaattggatactgctgccaagaagttgctctgaagtcagtttctatcattctgctctttgattcaaagcactgtttctctcactgggcctccaacc

SEQ ID NO: 520 - DNA, 201 bp, Homo sapiens
  misc_feature (1)...(201): n = A,T,C or G, or insertion/deletion polymorphism (see Tables 1-2)
ttagcgagtccttcttttcctgactgcagctcttttcattttgccatccttttccagctccatgatggttctgcaggtttctgcggccccccggacagtgnctctgacggcgttactgatggtgctgctcacatctgtggtccagggcagggccactccagagaattaccttttccagggacggcaggaatgctacgcgtt

SEQ ID NO: 521 - DNA, 201 bp, Homo sapiens
gcaggtttctgcggccccccggacagtggctctgacggcgttactgatggtgctgctcacatctgtggtccagggcagggccactccagagaattaccttwtccagggacggcaggaatgctacgcgtttaatgggacacagcgcttcctggagagatacatctacaaccgggaggagttcgcgcgcttcgacagcgacgt

SEQ ID NO: 522 - DNA, 201 bp, Homo sapiens
ggtttctgcggccccccggacagtggctctgacggcgttactgatggtgctgctcacatctgtggtccagggcagggccactccagagaattaccttttcyagggacggcaggaatgctacgcgtttaatgggacacagcgcttcctggagagatacatctacaaccgggaggagttcgcgcgcttcgacagcgacgtggg

SEQ ID NO: 523 - DNA, 201 bp, Homo sapiens
cctggatagtcctgtcaccgtggagtggaaggcacagtctgattctgcccggagtaagacattgacgggagctgggggcttcgtgctggggctcatcatcygtggagtgggcatcttcatgcacaggaggagcaagaaagaggcacagtctgattctgcccggagtaagacattgacgggagctgggggcttcgtgctggg

SEQ ID NO: 524 - DNA, 201 bp, Homo sapiens
tgtggtccagggcagggccactccagagaattaccttttccagggacggcaggaatgctacgcgtttaatgggacacagcgcttcctggagagatacatcmacaaccgggaggagttcgcgcgcttcgacagcgacgtgggggagttccgggcggtgacggagctggggcggcctgctgcggagtactggaacagccagaa

SEQ ID NO: 525 - DNA, 201 bp, Homo sapiens
tggaacagccagaaggacatcctggaggagaagcgggcagtgccggacaggatgtgcagacacaactacgagctgggcgggcccatgaccctgcagcgccragtccagcctagggtgaatgtttccccctccaagaaggggcccttgcagcaccacaacctgcttgtctgccacgtgacggatttctacccaggcagcatt

SEQ ID NO: 526 - DNA, 201 bp, Homo sapiens
cagcaccacaacctgcttgtctgccacgtgacggatttctacccaggcagcattcaagtccgatggttcctgaatggacaggaggaaacagctggggtcgygtccaccaacctgatccgtaatggagactggaccttccagatcctggtgatgctggaaatgaccccccagcagggagatgtctacacctgccaagtggag

SEQ ID NO: 527 - DNA, 201 bp, Homo sapiens
gtccagggcagggccactccagagaattaccttttccagggacggcaggaatgctacgcgtttaatgggacacagcgcttcctggagagatacatctacasccgggaggagttcgcgcgcttcgacagcgacgtgggggagttccgggcggtgacggagctggggcggcctgctgcggagtactggaacagccagaaggac

SEQ ID NO: 528 - DNA, 201 bp, Homo sapiens
caacctgcttgtctgccacgtgacggatttctacccaggcagcattcaagtccgatggttcctgaatggacaggaggaaacagctggggtcgtgtccaccyacctgatccgtaatggagactggaccttccagatcctggtgatgctggaaatgaccccccagcagggagatgtctacacctgccaagtggagcacaccag

SEQ ID NO: 529 - DNA, 201 bp, Homo sapiens
agaattaccttttccagggacggcaggaatgctacgcgtttaatgggacacagcgcttcctggagagatacatctacaaccgggaggagttcgcgcgcttmgacagcgacgtgggggagttccgggcggtgacggagctggggcggcctgctgcggagtactggaacagccagaaggacatcctggaggagaagcgggcag

SEQ ID NO: 530 - DNA, 201 bp, Homo sapiens
ttctacccaggcagcattcaagtccgatggttcctgaatggacaggaggaaacagctggggtcgtgtccaccaacctgatccgtaatggagactggacctyccagatcctggtgatgctggaaatgaccccccagcagggagatgtctacacctgccaagtggagcacaccagcctggatagtcctgtcaccgtggagtgg

SEQ ID NO: 531 - DNA, 201 bp, Homo sapiens
gcgcttcgacagcgacgtgggggagttccgggcggtgacggagctggggcggcctgctgcggagtactggaacagccagaaggacatcctggaggagaagrgggcagtgccggacaggatgtgcagacacaactacgagctgggcgggcccatgaccctgcagcgccgagtccagcctagggtgaatgtttccccctccaa

SEQ ID NO: 532 - DNA, 201 bp, Homo sapiens
ggacatcctggaggagaagcgggcagtgccggacaggatgtgcagacacaactacgagctgggcgggcccatgaccctgcagcgccgagtccagcctaggrtgaatgtttccccctccaagaaggggcccttgcagcaccacaacctgcttgtctgccacgtgacggatttctacccaggcagcattcaagtccgatggtt

SEQ ID NO: 533 - DNA, 201 bp, Homo sapiens
agatacatctacaaccgggaggagttcgcgcgcttcgacagcgacgtgggggagttccgggcggtgacggagctggggcggcctgctgcggagtactggascagccagaaggacatcctggaggagaagcgggcagtgccggacaggatgtgcagacacaactacgagctgggcgggcccatgaccctgcagcgccgagtc

SEQ ID NO: 534 - DNA, 201 bp, Homo sapiens
tgcggagtactggaacagccagaaggacatcctggaggagaagcgggcagtgccggacaggatgtgcagacacaactacgagctgggcgggcccatgaccrtgcagcgccgagtccagcctagggtgaatgtttccccctccaagaaggggcccttgcagcaccacaacctgcttgtctgccacgtgacggatttctaccc

SEQ ID NO: 535 - DNA, 201 bp, Homo sapiens
tgcaggtttctgcggccccccggacagtggctctgacggcgttactgatggtgctgctcacatctgtggtccagggcagggccactccagagaattacctyttccagggacggcaggaatgctacgcgtttaatgggacacagcgcttcctggagagatacatctacaaccgggaggagttcgcgcgcttcgacagcgacg

SEQ ID NO: 536 - DNA, 201 bp, Homo sapiens
ccgggcggtgacggagctggggcggcctgctgcggagtactggaacagccagaaggacatcctggaggagaagcgggcagtgccggacaggatgtgcagaracaactacgagctgggcgggcccatgaccctgcagcgccgagtccagcctagggtgaatgtttccccctccaagaaggggcccttgcagcaccacaacct

SEQ ID NO: 537 - DNA, 201 bp, Homo sapiens
agagatacatctacaaccgggaggagttcgcgcgcttcgacagcgacgtgggggagttccgggcggtgacggagctggggcggcctgctgcggagtactgsaacagccagaaggacatcctggaggagaagcgggcagtgccggacaggatgtgcagacacaactacgagctgggcgggcccatgaccctgcagcgccgag

SEQ ID NO: 538 - DNA, 201 bp, Homo sapiens
gggggcttcgtgctggggctcatcatctgtggagtgggcatcttcatgcacaggaggagcaagaaagaggcacagtctgattctgcccggagtaagacatrgacgggagctgggggcttcgtgctggggctcatcatctgtggagtgggcatcttcatgcacaggaggagcaagaaagttcaacgaggatctgcataaaca

SEQ ID NO: 539 - DNA, 201 bp, Homo sapiens
gatacatctacaaccgggaggagttcgcgcgcttcgacagcgacgtgggggagttccgggcggtgacggagctggggcggcctgctgcggagtactggaaragccagaaggacatcctggaggagaagcgggcagtgccggacaggatgtgcagacacaactacgagctgggcgggcccatgaccctgcagcgccgagtcc

SEQ ID NO: 540 - DNA, 201 bp, Homo sapiens
ttcgtgctggggctcatcatctgtggagtgggcatcttcatgcacaggaggagcaagaaagaggcacagtctgattctgcccggagtaagacattgacggmagctgggggcttcgtgctggggctcatcatctgtggagtgggcatcttcatgcacaggaggagcaagaaagttcaacgaggatctgcataaacagggttc

SEQ ID NO: 541 - DNA, 201 bp, Homo sapiens
gacagcgacgtgggggagttccgggcggtgacggagctggggcggcctgctgcggagtactggaacagccagaaggacatcctggaggagaagcgggcagygccggacaggatgtgcagacacaactacgagctgggcgggcccatgaccctgcagcgccgagtccagcctagggtgaatgtttccccctccaagaagggg

SEQ ID NO: 542 - DNA, 201 bp, Homo sapiens
ccaacctgatccgtaatggagactggaccttccagatcctggtgatgctggaaatgaccccccagcagggagatgtctacacctgccaagtggagcacacmagcctggatagtcctgtcaccgtggagtggaaggcacagtctgattctgcccggagtaagacattgacgggagctgggggcttcgtgctggggctcatca

SEQ ID NO: 543 - DNA, 144 bp, Homo sapiens
caggagctccctttagcgagtccttcttttcctgactgcagctyttttcattttgccatccttttccagctccatgatggttctgcaggtttctgcggccccccggacagtggctctgacggcgttactgatggtgctgctcac

SEQ ID NO: 544 - DNA, 201 bp, Homo sapiens
agttcgcgcgcttcgacagcgacgtgggggagttccgggcggtgacggagctggggcggcctgctgcggagtactggaacagccagaaggacatcctggargagaagcgggcagtgccggacaggatgtgcagacacaactacgagctgggcgggcccatgaccctgcagcgccgagtccagcctagggtgaatgtttccc

SEQ ID NO: 545 - DNA, 201 bp, Homo sapiens
tgccggacaggatgtgcagacacaactacgagctgggcgggcccatgaccctgcagcgccgagtccagcctagggtgaatgtttccccctccaagaagggycccttgcagcaccacaacctgcttgtctgccacgtgacggatttctacccaggcagcattcaagtccgatggttcctgaatggacaggaggaaacagctg

SEQ ID NO: 546 - DNA, 201 bp, Homo sapiens; identical to SEQ ID NO: 510

SEQ ID NO: 547 - DNA, 201 bp, Homo sapiens
gttctgcaggtttctgcggccccccggacagtggctctgacggcgttactgatggtgctgctcacatctgtggtccagggcagggccactccagagaattkccttttccagggacggcaggaatgctacgcgtttaatgggacacagcgcttcctggagagatacatctacaaccgggaggagttcgcgcgcttcgacagc

SEQ ID NO: 548 - DNA, 201 bp, Homo sapiens
acgtgggggagttccgggcggtgacggagctggggcggcctgctgcggagtactggaacagccagaaggacatcctggaggagaagcgggcagtgccggaraggatgtgcagacacaactacgagctgggcgggcccatgaccctgcagcgccgagtccagcctagggtgaatgtttccccctccaagaaggggcccttgc

SEQ ID NO: 549 - DNA, 201 bp, Homo sapiens
tctgcaggtttctgcggccccccggacagtggctctgacggcgttactgatggtgctgctcacatctgtggtccagggcagggccactccagagaattacwttttccagggacggcaggaatgctacgcgtttaatgggacacagcgcttcctggagagatacatctacaaccgggaggagttcgcgcgcttcgacagcga

SEQ ID NO: 550 - DNA, 201 bp, Homo sapiens
gtgggggagttccgggcggtgacggagctggggcggcctgctgcggagtactggaacagccagaaggacatcctggaggagaagcgggcagtgccggacargatgtgcagacacaactacgagctgggcgggcccatgaccctgcagcgccgagtccagcctagggtgaatgtttccccctccaagaaggggcccttgcag

SEQ ID NO: 551 - DNA, 201 bp, Homo sapiens
  misc_feature (1)...(201): n = A,T,C or G, or insertion/deletion polymorphism (see Tables 1-2)
aggtttctgcggccccccggacagtggctctgacggcgttactgatggtgctgctcacatctgtggtccagggcagggccactccagagaattaccttttncagggacggcaggaatgctacgcgtttaatgggacacagcgcttcctggagagatacatctacaaccgggaggagttcgcgcgcttcgacagcgacgtgg

SEQ ID NO: 552 - DNA, 157 bp, Homo sapiens
attcaatggtgagcagactgcaaatctgcctgataggacccatattcccacagcactaattcaacatataccttactgagagcatgttttatcattaccaktaagaagttaaatgaacatcagaatttaaaatcataaatataatctaatacacttt

SEQ ID NO: 553 - DNA, 201 bp, Homo sapiens
tggggctcatcatctgtggagtgggcatcttcatgcacaggaggagcaagaaagttcaacgaggatctgcataaacagggttcctgagctcactgaaaagwctattgtgccttaggaaaagcatttgctgtgtttcgttagcatctggctccaggacagaccttcaacttccaaattggatactgctgccaagaagttgct

SEQ ID NO: 554 - DNA, 201 bp, Homo sapiens
agctgggggcttcgtgctggggctcatcatctgtggagtgggcatcttcatgcacaggaggagcaagaaagttcaacgaggatctgcataaacagggttcstgagctcactgaaaagactattgtgccttaggaaaagcatttgctgtgtttcgttagcatctggctccaggacagaccttcaacttccaaattggatact

SEQ ID NO: 555 - DNA, 201 bp, Homo sapiens
cctagggtgaatgtttccccctccaagaaggggcccttgcagcaccacaacctgcttgtctgccacgtgacggatttctacccaggcagcattcaagtccsatggttcctgaatggacaggaggaaacagctggggtcgtgtccaccaacctgatccgtaatggagactggaccttccagatcctggtgatgctggaaatg

SEQ ID NO: 556 - DNA, 201 bp, Homo sapiens
ggagctggggcggcctgctgcggagtactggaacagccagaaggacatcctggaggagaagcgggcagtgccggacaggatgtgcagacacaactacgagdtgggcgggcccatgaccctgcagcgccgagtccagcctagggtgaatgtttccccctccaagaaggggcccttgcagcaccacaacctgcttgtctgcca

SEQ ID NO: 557 - DNA, 201 bp, Homo sapiens
ttccagggacggcaggaatgctacgcgtttaatgggacacagcgcttcctggagagatacatctacaaccgggaggagttcgcgcgcttcgacagcgacgrgggggagttccgggcggtgacggagctggggcggcctgctgcggagtactggaacagccagaaggacatcctggaggagaagcgggcagtgccggacagg

SEQ ID NO: 558 - DNA, 201 bp, Homo sapiens
gttcgcgcgcttcgacagcgacgtgggggagttccgggcggtgacggagctggggcggcctgctgcggagtactggaacagccagaaggacatcctggagragaagcgggcagtgccggacaggatgtgcagacacaactacgagctgggcgggcccatgaccctgcagcgccgagtccagcctagggtgaatgtttcccc

SEQ ID NO: 559 - DNA, 201 bp, Homo sapiens
gctggggcggcctgctgcggagtactggaacagccagaaggacatcctggaggagaagcgggcagtgccggacaggatgtgcagacacaactacgagctgrgcgggcccatgaccctgcagcgccgagtccagcctagggtgaatgtttccccctccaagaaggggcccttgcagcaccacaacctgcttgtctgccacgt

SEQ ID NO: 560 - DNA, 201 bp, Homo sapiens
taaacagggttcctgagctcactgaaaagactattgtgccttaggaaaagcatttgctgtgtttcgttagcatctggctccaggacagaccttcaacttckaaattggatactgctgccaagaagttgctctgaagtcagtttctatcattctgctctttgattcaaagcactgtttctctcactgggcctccaaccatgt

SEQ ID NO: 561 - DNA, 201 bp, Homo sapiens
aggcagcattcaagtccgatggttcctgaatggacaggaggaaacagctggggtcgtgtccaccaacctgatccgtaatggagactggaccttccagatcwtggtgatgctggaaatgaccccccagcagggagatgtctacacctgccaagtggagcacaccagcctggatagtcctgtcaccgtggagtggaaggcaca

SEQ ID NO: 562 - DNA, 201 bp, Homo sapiens; identical to SEQ ID NO: 513

SEQ ID NO: 563 - DNA, 201 bp, Homo sapiens
aaacagggttcctgagctcactgaaaagactattgtgccttaggaaaagcatttgctgtgtttcgttagcatctggctccaggacagaccttcaacttccwaattggatactgctgccaagaagttgctctgaagtcagtttctatcattctgctctttgattcaaagcactgtttctctcactgggcctccaaccatgtt

SEQ ID NO: 564 - DNA, 201 bp, Homo sapiens
acaggaggagcaagaaagttcaacgaggatctgcataaacagggttcctgagctcactgaaaagactattgtgccttaggaaaagcatttgctgtgtttcrttagcatctggctccaggacagaccttcaacttccaaattggatactgctgccaagaagttgctctgaagtcagtttctatcattctgctctttgattca

SEQ ID NO: 565 - DNA, 201 bp, Homo sapiens
gaaaagcatttgctgtgtttcgttagcatctggctccaggacagaccttcaacttccaaattggatactgctgccaagaagttgctctgaagtcagtttcratcattctgctctttgattcaaagcactgtttctctcactgggcctccaaccatgttcccttcttcttagcaccacaaataatcaaaacccaacatgact

SEQ ID NO: 566 - DNA, 201 bp, Homo sapiens
gacacagcgcttcctggagagatacatctacaaccgggaggagttcgcgcgcttcgacagcgacgtgggggagttccgggcggtgacggagctggggcggmctgctgcggagtactggaacagccagaaggacatcctggaggagaagcgggcagtgccggacaggatgtgcagacacaactacgagctgggcgggcccat

SEQ ID NO: 567 - DNA, 201 bp, Homo sapiens
tccagggcagggccactccagagaattaccttttccagggacggcaggaatgctacgcgtttaatgggacacagcgcttcctggagagatacatctacaascgggaggagttcgcgcgcttcgacagcgacgtgggggagttccgggcggtgacggagctggggcggcctgctgcggagtactggaacagccagaaggaca

SEQ ID NO: 568 - DNA, 201 bp, Homo sapiens
cagtttctatcattctgctctttgattcaaagcactgtttctctcactgggcctccaaccatgttcccttcttcttagcaccacaaataatcaaaacccarcatgactgtttgttttcctttaaaaatatgcaccaaatcatctctcatcacttttctctgagggttttagtagacagtaggagttaataaagaagttcat

SEQ ID NO: 569 - DNA, 201 bp, Homo sapiens
gtttctatcattctgctctttgattcaaagcactgtttctctcactgggcctccaaccatgttcccttcttcttagcaccacaaataatcaaaacccaacstgactgtttgttttcctttaaaaatatgcaccaaatcatctctcatcacttttctctgagggttttagtagacagtaggagttaataaagaagttcattt

SEQ ID NO: 570 - DNA, 201 bp, Homo sapiens
tcattctgctctttgattcaaagcactgtttctctcactgggcctccaaccatgttcccttcttcttagcaccacaaataatcaaaacccaacatgactgyttgttttcctttaaaaatatgcaccaaatcatctctcatcacttttctctgagggttttagtagacagtaggagttaataaagaagttcattttggttta

SEQ ID NO: 571 - DNA, 201 bp, Homo sapiens
ggaggagcaagaaagttcaacgaggatctgcataaacagggttcctgagctcactgaaaagactattgtgccttaggaaaagcatttgctgtgtttcgttygcatctggctccaggacagaccttcaacttccaaattggatactgctgccaagaagttgctctgaagtcagtttctatcattctgctctttgattcaaag

SEQ ID NO: 572 - DNA, 201 bp, Homo sapiens
aagcactgtttctctcactgggcctccaaccatgttcccttcttcttagcaccacaaataatcaaaacccaacatgactgtttgttttcctttaaaaataygcaccaaatcatctctcatcacttttctctgagggttttagtagacagtaggagttaataaagaagttcattttggtttaaacataggaaagaagagaac

SEQ ID NO: 573 - DNA, 201 bp, Homo sapiens
agcaagaaagttcaacgaggatctgcataaacagggttcctgagctcactgaaaagactattgtgccttaggaaaagcatttgctgtgtttcgttagcatytggctccaggacagaccttcaacttccaaattggatactgctgccaagaagttgctctgaagtcagtttctatcattctgctctttgattcaaagcactg

SEQ ID NO: 574 - DNA, 201 bp, Homo sapiens
gtttctctcactgggcctccaaccatgttcccttcttcttagcaccacaaataatcaaaacccaacatgactgtttgttttcctttaaaaatatgcaccaratcatctctcatcacttttctctgagggttttagtagacagtaggagttaataaagaagttcattttggtttaaacataggaaagaagagaaccatgaaa

SEQ ID NO: 575 - DNA, 201 bp, Homo sapiens
acgaggatctgcataaacagggttcctgagctcactgaaaagactattgtgccttaggaaaagcatttgctgtgtttcgttagcatctggctccaggacayaccttcaacttccaaattggatactgctgccaagaagttgctctgaagtcagtttctatcattctgctctttgattcaaagcactgtttctctcactggg

SEQ ID NO: 576 - DNA, 201 bp, Homo sapiens
actgggcctccaaccatgttcccttcttcttagcaccacaaataatcaaaacccaacatgactgtttgttttcctttaaaaatatgcaccaaatcatctcycatcacttttctctgagggttttagtagacagtaggagttaataaagaagttcattttggtttaaacataggaaagaagagaaccatgaaaatggggata

SEQ ID NO: 577 - DNA, 201 bp, Homo sapiens
  misc_feature (1)...(201): n = A,T,C or G, or insertion/deletion polymorphism (see Tables 1-2)
ggtttctgcggccccccggacagtggctctgacggcgttactgatggtgctgctcacatctgtggtccagggcagggccactccagagaattaccttttcnagggacggcaggaatgctacgcgtttaatgggacacagcgcttcctggagagatacatctacaaccgggaggagttcgcgcgcttcgacagcgacgtggg

SEQ ID NO: 578 - DNA, 201 bp, Homo sapiens
cagggccactccagagaattaccttttccagggacggcaggaatgctacgcgtttaatgggacacagcgcttcctggagagatacatctacaaccgggagwagttcgcgcgcttcgacagcgacgtgggggagttccgggcggtgacggagctggggcggcctgctgcggagtactggaacagccagaaggacatcctgga

SEQ ID NO: 579 - DNA, 201 bp, Homo sapiens
ggccactccagagaattaccttttccagggacggcaggaatgctacgcgtttaatgggacacagcgcttcctggagagatacatctacaaccgggaggagytcgcgcgcttcgacagcgacgtgggggagttccgggcggtgacggagctggggcggcctgctgcggagtactggaacagccagaaggacatcctggagga

SEQ ID NO: 580 - DNA, 201 bp, Homo sapiens
gggcttcgtgctggggctcatcatctgtggagtgggcatcttcatgcacaggaggagcaagaaagttcaacgaggatctgcataaacagggttcctgagcycactgaaaagactattgtgccttaggaaaagcatttgctgtgtttcgttagcatctggctccaggacagaccttcaacttccaaattggatactgctgcc

SEQ ID NO: 581 - DNA, 201 bp, Homo sapiens
acagcgcttcctggagagatacatctacaaccgggaggagttcgcgcgcttcgacagcgacgtgggggagttccgggcggtgacggagctggggcggcctmctgcggagtactggaacagccagaaggacatcctggaggagaagcgggcagtgccggacaggatgtgcagacacaactacgagctgggcgggcccatgac

SEQ ID NO: 582 - DNA, 201 bp, Homo sapiens
ggcgggcccatgaccctgcagcgccgagtccagcctagggtgaatgtttccccctccaagaaggggcccttgcagcaccacaacctgcttgtctgccacgrgacggatttctacccaggcagcattcaagtccgatggttcctgaatggacaggaggaaacagctggggtcgtgtccaccaacctgatccgtaatggagac

SEQ ID NO: 583 - DNA, 201 bp, Homo sapiens
ggacaggaggaaacagctggggtcgtgtccaccaacctgatccgtaatggagactggaccttccagatcctggtgatgctggaaatgaccccccagcaggyagatgtctacacctgccaagtggagcacaccagcctggatagtcctgtcaccgtggagtggaaggcacagtctgattctgcccggagtaagacattgacg

SEQ ID NO: 584 - DNA, 201 bp, Homo sapiens
cgcttcctggagagatacatctacaaccgggaggagttcgcgcgcttcgacagcgacgtgggggagttccgggcggtgacggagctggggcggcctgctgsggagtactggaacagccagaaggacatcctggaggagaagcgggcagtgccggacaggatgtgcagacacaactacgagctgggcgggcccatgaccctg

SEQ ID NO: 585 - DNA, 201 bp, Homo sapiens
ggaaacagctggggtcgtgtccaccaacctgatccgtaatggagactggaccttccagatcctggtgatgctggaaatgaccccccagcagggagatgtcyacacctgccaagtggagcacaccagcctggatagtcctgtcaccgtggagtggaaggcacagtctgattctgcccggagtaagacattgacgggagctgg

SEQ ID NO: 586 - DNA, 201 bp, Homo sapiens
acaaccgggaggagttcgcgcgcttcgacagcgacgtgggggagttccgggcggtgacggagctggggcggcctgctgcggagtactggaacagccagaamgacatcctggaggagaagcgggcagtgccggacaggatgtgcagacacaactacgagctgggcgggcccatgaccctgcagcgccgagtccagcctaggg

SEQ ID NO: 587 - DNA, 201 bp, Homo sapiens
ctgatccgtaatggagactggaccttccagatcctggtgatgctggaaatgaccccccagcagggagatgtctacacctgccaagtggagcacaccagccyggatagtcctgtcaccgtggagtggaaggcacagtctgattctgcccggagtaagacattgacgggagctgggggcttcgtgctggggctcatcatctgt

SEQ ID NO: 588 - DNA, 201 bp, Homo sapiens
ccagaaggacatcctggaggagaagcgggcagtgccggacaggatgtgcagacacaactacgagctgggcgggcccatgaccctgcagcgccgagtccagrctagggtgaatgtttccccctccaagaaggggcccttgcagcaccacaacctgcttgtctgccacgtgacggatttctacccaggcagcattcaagtccg

SEQ ID NO: 589 - DNA, 201 bp, Homo sapiens
cctgcagcgccgagtccagcctagggtgaatgtttccccctccaagaaggggcccttgcagcaccacaacctgcttgtctgccacgtgacggatttctacrcaggcagcattcaagtccgatggttcctgaatggacaggaggaaacagctggggtcgtgtccaccaacctgatccgtaatggagactggaccttccagat

SEQ ID NO: 590 - DNA, 201 bp, Homo sapiens
gggcggcctgctgcggagtactggaacagccagaaggacatcctggaggagaagcgggcagtgccggacaggatgtgcagacacaactacgagctgggcgsgcccatgaccctgcagcgccgagtccagcctagggtgaatgtttccccctccaagaaggggcccttgcagcaccacaacctgcttgtctgccacgtgacg

SEQ ID NO: 591 - DNA, 201 bp, Homo sapiens
ctacgagctgggcgggcccatgaccctgcagcgccgagtccagcctagggtgaatgtttccccctccaagaaggggcccttgcagcaccacaacctgcttrtctgccacgtgacggatttctacccaggcagcattcaagtccgatggttcctgaatggacaggaggaaacagctggggtcgtgtccaccaacctgatccg

SEQ ID NO: 592 - DNA, 201 bp, Homo sapiens
gcagggccactccagagaattaccttttccagggacggcaggaatgctacgcgtttaatgggacacagcgcttcctggagagatacatctacaaccgggaygagttcgcgcgcttcgacagcgacgtgggggagttccgggcggtgacggagctggggcggcctgctgcggagtactggaacagccagaaggacatcctgg

SEQ ID NO: 593 - DNA, 201 bp, Homo sapiens
ggcagtgccggacaggatgtgcagacacaactacgagctgggcgggcccatgaccctgcagcgccgagtccagcctagggtgaatgtttccccctccaagraggggcccttgcagcaccacaacctgcttgtctgccacgtgacggatttctacccaggcagcattcaagtccgatggttcctgaatggacaggaggaaac

SEQ ID NO: 594 - DNA, 201 bp, Homo sapiens
tggggcggcctgctgcggagtactggaacagccagaaggacatcctggaggagaagcgggcagtgccggacaggatgtgcagacacaactacgagctgggsgggcccatgaccctgcagcgccgagtccagcctagggtgaatgtttccccctccaagaaggggcccttgcagcaccacaacctgcttgtctgccacgtga

SEQ ID NO: 595 - DNA, 201 bp, Homo sapiens
ggatctgcataaacagggttcctgagctcactgaaaagactattgtgccttaggaaaagcatttgctgtgtttcgttagcatctggctccaggacagaccrtcaacttccaaattggatactgctgccaagaagttgctctgaagtcagtttctatcattctgctctttgattcaaagcactgtttctctcactgggcctc

SEQ ID NO: 596 - DNA, 201 bp, Homo sapiens
ggcggcctgctgcggagtactggaacagccagaaggacatcctggaggagaagcgggcagtgccggacaggatgtgcagacacaactacgagctgggcggrcccatgaccctgcagcgccgagtccagcctagggtgaatgtttccccctccaagaaggggcccttgcagcaccacaacctgcttgtctgccacgtgacgg

SEQ ID NO: 597 - DNA, 201 bp, Homo sapiens
gcataaacagggttcctgagctcactgaaaagactattgtgccttaggaaaagcatttgctgtgtttcgttagcatctggctccaggacagaccttcaacmtccaaattggatactgctgccaagaagttgctctgaagtcagtttctatcattctgctctttgattcaaagcactgtttctctcactgggcctccaacca

SEQ ID NO: 598 - DNA, 201 bp, Homo sapiens
gacatcctggaggagaagcgggcagtgccggacaggatgtgcagacacaactacgagctgggcgggcccatgaccctgcagcgccgagtccagcctagggygaatgtttccccctccaagaaggggcccttgcagcaccacaacctgcttgtctgccacgtgacggatttctacccaggcagcattcaagtccgatggttc

SEQ ID NO: 599 - DNA, 201 bp, Homo sapiens; identical to SEQ ID NO: 577
  misc_feature (1)...(201): n = A,T,C or G, or insertion/deletion polymorphism (see Tables 1-2)

SEQ ID NO: 600 - DNA, 144 bp, Homo sapiens; identical to SEQ ID NO: 543

SEQ ID NO: 601 - DNA, 201 bp, Homo sapiens; identical to SEQ ID NO: 578

SEQ ID NO: 602 - DNA, 201 bp, Homo sapiens; identical to SEQ ID NO: 544

SEQ ID NO: 603 - DNA, 201 bp, Homo sapiens; identical to SEQ ID NO: 579

SEQ ID NO: 604 - DNA, 201 bp, Homo sapiens; identical to SEQ ID NO: 510

SEQ ID NO: 605 - DNA, 201 bp, Homo sapiens
gcaccacaacctgcttgtctgccacgtgacggatttctacccaggcagcattcaagtccgatggttcctgaatggacaggaggaaacagctggggtcgtgyccaccaacctgatccgtaatggagactggaccttccagatcctggtgatgctggaaatgaccccccagcagggagatgtctacacctgccaagtggagca

SEQ ID NO: 606 - DNA, 201 bp, Homo sapiens; identical to SEQ ID NO: 547

SEQ ID NO: 607 - DNA, 201 bp, Homo sapiens; identical to SEQ ID NO: 581

SEQ ID NO: 608 - DNA, 201 bp, Homo sapiens; identical to SEQ ID NO: 548

SEQ ID NO: 609 - DNA, 201 bp, Homo sapiens; identical to SEQ ID NO: 549

SEQ ID NO: 610 - DNA, 201 bp, Homo sapiens; identical to SEQ ID NO: 550

SEQ ID NO: 611 - DNA, 201 bp, Homo sapiens; identical to SEQ ID NO: 551
  misc_feature (1)...(201): n = A,T,C or G, or insertion/deletion polymorphism (see Tables 1-2)

SEQ ID NO: 612 - DNA, 201 bp, Homo sapiens; identical to SEQ ID NO: 584

SEQ ID NO: 613 - DNA, 201 bp, Homo sapiens; identical to SEQ ID NO: 586

SEQ ID NO: 614 - DNA, 201 bp, Homo sapiens
tgcttgtctgccacgtgacggatttctacccaggcagcattcaagtccgatggttcctgaatggacaggaggaaacagctggggtcgtgtccaccaacctwatccgtaatggagactggaccttccagatcctggtgatgctggaaatgaccccccagcagggagatgtctacacctgccaagtggagcacaccagcctgg

SEQ ID NO: 615 - DNA, 201 bp, Homo sapiens
cttgcagcaccacaacctgcttgtctgccacgtgacggatttctacccaggcagcattcaagtccgatggttcctgaatggacaggaggaaacagctgggstcgtgtccaccaacctgatccgtaatggagactggaccttccagatcctggtgatgctggaaatgaccccccagcagggagatgtctacacctgccaagt

SEQ ID NO: 616 - DNA, 201 bp, Homo sapiens; identical to SEQ ID NO: 590

SEQ ID NO: 617 - DNA, 201 bp, Homo sapiens; identical to SEQ ID NO: 592

SEQ ID NO: 618 - DNA, 201 bp, Homo sapiens; identical to SEQ ID NO: 556

SEQ ID NO: 619 - DNA, 201 bp, Homo sapiens; identical to SEQ ID NO: 557

SEQ ID NO: 620 - DNA, 201 bp, Homo sapiens; identical to SEQ ID NO: 558

SEQ ID NO: 621 - DNA, 201 bp, Homo sapiens; identical to SEQ ID NO: 559

SEQ ID NO: 622 - DNA, 201 bp, Homo sapiens
gacggatttctacccaggcagcattcaagtccgatggttcctgaatggacaggaggaaacagctggggtcgtgtccaccaacctgatccgtaatggagackggaccttccagatcctggtgatgctggaaatgaccccccagcagggagatgtctacacctgccaagtggagcacaccagcctggatagtcctgtcaccgt

SEQ ID NO: 623 - DNA, 201 bp, Homo sapiens
acggatttctacccaggcagcattcaagtccgatggttcctgaatggacaggaggaaacagctggggtcgtgtccaccaacctgatccgtaatggagactwgaccttccagatcctggtgatgctggaaatgaccccccagcagggagatgtctacacctgccaagtggagcacaccagcctggatagtcctgtcaccgtg

SEQ ID NO: 624 - DNA, 201 bp, Homo sapiens; identical to SEQ ID NO: 594

SEQ ID NO: 625 - DNA, 201 bp, Homo sapiens
atggacaggaggaaacagctggggtcgtgtccaccaacctgatccgtaatggagactggaccttccagatcctggtgatgctggaaatgaccccccagcarggagatgtctacacctgccaagtggagcacaccagcctggatagtcctgtcaccgtggagtggaaggcacagtctgattctgcccggagtaagacattga

SEQ ID NO: 626 - DNA, 201 bp, Homo sapiens; identical to SEQ ID NO: 566

SEQ ID NO: 627 - DNA, 201 bp, Homo sapiens; identical to SEQ ID NO: 567

SEQ ID NO: 628 - DNA, 201 bp, Homo sapiens
cccagcagggagatgtctacacctgccaagtggagcacaccagcctggatagtcctgtcaccgtggagtggaaggcacagtctgattctgcccggagtaaracattgacgggagctgggggcttcgtgctggggctcatcatctgtggagtgggcatcttcatgcacaggaggagcaagaaagaggcacagtctgattctg

SEQ ID NO: 629 - DNA, 201 bp, Homo sapiens; identical to SEQ ID NO: 596

SEQ ID NO: 630 - DNA, 201 bp, Homo sapiens; identical to SEQ ID NO: 542

SEQ ID NO: 631 - DNA, 144 bp, Homo sapiens; identical to SEQ ID NO: 543

SEQ ID NO: 632 - DNA, 201 bp, Homo sapiens
agttcgcgcgcttcgacagcgacgtgggggagttccgggcggtgacggagctggggcggcctgctgcggagtactggaacagccagaaggacatcctggargagaagcgggcagtgccggacaggatgtgcagacacaactacgagctgggcgggcccatgaccctgcagcgccgaggctggagtgctgtggcaccatcat

SEQ ID NO: 633 - DNA, 201 bp, Homo sapiens; identical to SEQ ID NO: 510

SEQ ID NO: 634 - DNA, 201 bp, Homo sapiens
aggaggaacttgaaaaaggacgggatttctactactcaagcatgtaggagctcaggatattcttccagcctagggtgaatgtttccccctccaagaagggycccttgcagcaccacaacctgcttgtctgccacgtgacggatttctacccaggcagcattcaagtccgatggttcctgaatggacaggaggaaacagctg

SEQ ID NO: 635 - DNA, 201 bp, Homo sapiens; identical to SEQ ID NO: 547

SEQ ID NO: 636 - DNA, 201 bp, Homo sapiens
acgtgggggagttccgggcggtgacggagctggggcggcctgctgcggagtactggaacagccagaaggacatcctggaggagaagcgggcagtgccggaraggatgtgcagacacaactacgagctgggcgggcccatgaccctgcagcgccgaggctggagtgctgtggcaccatcatggctcactgcagcctcaacct

SEQ ID NO: 637 - DNA, 201 bp, Homo sapiens; identical to SEQ ID NO: 549

SEQ ID NO: 638 - DNA, 201 bp, Homo sapiens
gtgggggagttccgggcggtgacggagctggggcggcctgctgcggagtactggaacagccagaaggacatcctggaggagaagcgggcagtgccggacargatgtgcagacacaactacgagctgggcgggcccatgaccctgcagcgccgaggctggagtgctgtggcaccatcatggctcactgcagcctcaacctcc

SEQ ID NO: 639 - DNA, 201 bp, Homo sapiens; identical to SEQ ID NO: 551
  misc_feature (1)...(201): n = A,T,C or G, or insertion/deletion polymorphism (see Tables 1-2)

SEQ ID NO: 640 - DNA, 201 bp, Homo sapiens; identical to SEQ ID NO: 553

SEQ ID NO: 641 - DNA, 201 bp, Homo sapiens; identical to SEQ ID NO: 554

SEQ ID NO: 642 - DNA, 201 bp, Homo sapiens; identical to SEQ ID NO: 555

SEQ ID NO: 643 - DNA, 201 bp, Homo sapiens
ggagctggggcggcctgctgcggagtactggaacagccagaaggacatcctggaggagaagcgggcagtgccggacaggatgtgcagacacaactacgagdtgggcgggcccatgaccctgcagcgccgaggctggagtgctgtggcaccatcatggctcactgcagcctcaacctcctgggctcaagtgatcctcctgcc

SEQ ID NO: 644 - DNA, 201 bp, Homo sapiens; identical to SEQ ID NO: 557

SEQ ID NO: 645 - DNA, 201 bp, Homo sapiens
gttcgcgcgcttcgacagcgacgtgggggagttccgggcggtgacggagctggggcggcctgctgcggagtactggaacagccagaaggacatcctggagragaagcgggcagtgccggacaggatgtgcagacacaactacgagctgggcgggcccatgaccctgcagcgccgaggctggagtgctgtggcaccatcatg

SEQ ID NO: 646 - DNA, 201 bp, Homo sapiens
gctggggcggcctgctgcggagtactggaacagccagaaggacatcctggaggagaagcgggcagtgccggacaggatgtgcagacacaactacgagctgrgcgggcccatgaccctgcagcgccgaggctggagtgctgtggcaccatcatggctcactgcagcctcaacctcctgggctcaagtgatcctcctgcctca

SEQ ID NO: 647 - DNA, 201 bp, Homo sapiens; identical to SEQ ID NO: 560

SEQ ID NO: 648 - DNA, 201 bp, Homo sapiens; identical to SEQ ID NO: 513

SEQ ID NO: 649 - DNA, 201 bp, Homo sapiens; identical to SEQ ID NO: 563

SEQ ID NO: 650 - DNA, 201 bp, Homo sapiens; identical to SEQ ID NO: 561

SEQ ID NO: 651 - DNA, 201 bp, Homo sapiens; identical to SEQ ID NO: 564

SEQ ID NO: 652 - DNA, 201 bp, Homo sapiens; identical to SEQ ID NO: 565

SEQ ID NO: 653 - DNA, 201 bp, Homo sapiens; identical to SEQ ID NO: 566

SEQ ID NO: 654 - DNA, 201 bp, Homo sapiens; identical to SEQ ID NO: 567

SEQ ID NO: 655 - DNA, 201 bp, Homo sapiens; identical to SEQ ID NO: 568

SEQ ID NO: 656 - DNA, 201 bp, Homo sapiens; identical to SEQ ID NO: 571

SEQ ID NO: 657 - DNA, 201 bp, Homo sapiens; identical to SEQ ID NO: 573

SEQ ID NO: 658 - DNA, 201 bp, Homo sapiens; identical to SEQ ID NO: 575

SEQ ID NO: 659 - DNA, 201 bp, Homo sapiens; identical to SEQ ID NO: 577
  misc_feature (1)...(201): n = A,T,C or G, or insertion/deletion polymorphism (see Tables 1-2)

SEQ ID NO: 660 - DNA, 201 bp, Homo sapiens; identical to SEQ ID NO: 578

SEQ ID NO: 661 - DNA, 201 bp, Homo sapiens; identical to SEQ ID NO: 580

SEQ ID NO: 662 - DNA, 201 bp, Homo sapiens; identical to SEQ ID NO: 579

SEQ ID NO: 663 - DNA, 201 bp, Homo sapiens
tcaagcatgtaggagctcaggatattcttccagcctagggtgaatgtttccccctccaagaaggggcccttgcagcaccacaacctgcttgtctgccacgrgacggatttctacccaggcagcattcaagtccgatggttcctgaatggacaggaggaaacagctggggtcgtgtccaccaacctgatccgtaatggagac

SEQ ID NO: 664 - DNA, 201 bp, Homo sapiens; identical to SEQ ID NO: 581

SEQ ID NO: 665 - DNA, 201 bp, Homo sapiens; identical to SEQ ID NO: 583

SEQ ID NO: 666 - DNA, 201 bp, Homo sapiens; identical to SEQ ID NO: 584

SEQ ID NO: 667 - DNA, 201 bp, Homo sapiens
acaaccgggaggagttcgcgcgcttcgacagcgacgtgggggagttccgggcggtgacggagctggggcggcctgctgcggagtactggaacagccagaamgacatcctggaggagaagcgggcagtgccggacaggatgtgcagacacaactacgagctgggcgggcccatgaccctgcagcgccgaggctggagtgctg

SEQ ID NO: 668 - DNA, 201 bp, Homo sapiens; identical to SEQ ID NO: 585

SEQ ID NO: 669 - DNA, 201 bp, Homo sapiens; identical to SEQ ID NO: 587

SEQ ID NO: 670 - DNA, 201 bp, Homo sapiens
agaccttcatgggacctgaagacgcagcacagaggaggaacttgaaaaaggacgggatttctactactcaagcatgtaggagctcaggatattcttccagrctagggtgaatgtttccccctccaagaaggggcccttgcagcaccacaacctgcttgtctgccacgtgacggatttctacccaggcagcattcaagtccg

SEQ ID NO: 671 - DNA, 201 bp, Homo sapiens
gggcggcctgctgcggagtactggaacagccagaaggacatcctggaggagaagcgggcagtgccggacaggatgtgcagacacaactacgagctgggcgsgcccatgaccctgcagcgccgaggctggagtgctgtggcaccatcatggctcactgcagcctcaacctcctgggctcaagtgatcctcctgcctcagcct

SEQ ID NO: 672 - DNA, 201 bp, Homo sapiens
gctcaggatattcttccagcctagggtgaatgtttccccctccaagaaggggcccttgcagcaccacaacctgcttgtctgccacgtgacggatttctacrcaggcagcattcaagtccgatggttcctgaatggacaggaggaaacagctggggtcgtgtccaccaacctgatccgtaatggagactggaccttccagat

SEQ ID NO: 673 - DNA, 201 bp, Homo sapiens; identical to SEQ ID NO: 592

SEQ ID NO: 674 - DNA, 201 bp, Homo sapiens
tttctactactcaagcatgtaggagctcaggatattcttccagcctagggtgaatgtttccccctccaagaaggggcccttgcagcaccacaacctgcttrtctgccacgtgacggatttctacccaggcagcattcaagtccgatggttcctgaatggacaggaggaaacagctggggtcgtgtccaccaacctgatccg

SEQ ID NO: 675 - DNA, 201 bp, Homo sapiens
cacagaggaggaacttgaaaaaggacgggatttctactactcaagcatgtaggagctcaggatattcttccagcctagggtgaatgtttccccctccaagraggggcccttgcagcaccacaacctgcttgtctgccacgtgacggatttctacccaggcagcattcaagtccgatggttcctgaatggacaggaggaaac

SEQ ID NO: 676 - DNA, 201 bp, Homo sapiens
tggggcggcctgctgcggagtactggaacagccagaaggacatcctggaggagaagcgggcagtgccggacaggatgtgcagacacaactacgagctgggsgggcccatgaccctgcagcgccgaggctggagtgctgtggcaccatcatggctcactgcagcctcaacctcctgggctcaagtgatcctcctgcctcagc

SEQ ID NO: 677 - DNA, 201 bp, Homo sapiens; identical to SEQ ID NO: 595

SEQ ID NO: 678 - DNA, 201 bp, Homo sapiens; identical to SEQ ID NO: 597

SEQ ID NO: 679 - DNA, 201 bp, Homo sapiens
ggcggcctgctgcggagtactggaacagccagaaggacatcctggaggagaagcgggcagtgccggacaggatgtgcagacacaactacgagctgggcggrcccatgaccctgcagcgccgaggctggagtgctgtggcaccatcatggctcactgcagcctcaacctcctgggctcaagtgatcctcctgcctcagcctc

SEQ ID NO: 680 - DNA, 201 bp, Homo sapiens
catgggacctgaagacgcagcacagaggaggaacttgaaaaaggacgggatttctactactcaagcatgtaggagctcaggatattcttccagcctagggygaatgtttccccctccaagaaggggcccttgcagcaccacaacctgcttgtctgccacgtgacggatttctacccaggcagcattcaagtccgatggttc

SEQ ID NO: 681 - DNA, 144 bp, Homo sapiens
ttccctttcgtgtaaaatggtgctgttattactctgtcttgaaataggaaggtgggatttctggggaggctggtgaaggagggcagggttcttttctctaygtgtcatgttaaaattgccaaataaagtacctctgcctgtgat

SEQ ID NO: 682 - DNA, 201 bp, Homo sapiens
cccagtggtggggtttgagcaatgcttctctgcccttccatggaaagtggaaccagaaatggtgccaaggctgtggctgttccctttcgtgtaaaatggtrctgttattactctgtcttgaaataggaaggtgggatttctggggaggctggtgaaggagggcagggttcttttctctacgtgtcatgttaaaattgccaa

SEQ ID NO: 683 - DNA, 201 bp, Homo sapiens
tggagtcctcaccgtccgagatgctgggagctggtggctagctgtgcctggagctgggagattcatcaagtactttgttaaagggcgccaggctgtccttrgcatggtccggaaggcaaagtaccgggaactgctcctatcagagctcctgggccggcgggcgcctgtcgtggtgcggcttggcctcacctaccatgtgca

SEQ ID NO: 684 - DNA, 201 bp, Homo sapiens
gctggtggctagctgtgcctggagctgggagattcatcaagtactttgttaaagggcgccaggctgtccttagcatggtccggaaggcaaagtaccgggarctgctcctatcagagctcctgggccggcgggcgcctgtcgtggtgcggcttggcctcacctaccatgtgcacgacctcattggggcccagctagtggact

SEQ ID NO: 685 - DNA, 201 bp, Homo sapiens
ttcatcaagtactttgttaaagggcgccaggctgtccttagcatggtccggaaggcaaagtaccgggaactgctcctatcagagctcctgggccggcgggygcctgtcgtggtgcggcttggcctcacctaccatgtgcacgacctcattggggcccagctagtggactgcatctctaccacttcaggaaccctcctccgc

SEQ ID NO: 686 - DNA, 201 bp, Homo sapiens
tctgctttcgatgatgcaatcattcagcgacagtggcgggcaaacccctcccggggcgggggaggtgtgagcttcacgaaggaggttgacaccaacgtggmcaccggcgcccctccacgccgccaacgagtccccgggcgtgcgtgcccttggagggagccaatccgcggccggcgtggggcccggcctggcggaggtgat

SEQ ID NO: 687 - DNA, 144 bp, Homo sapiens; identical to SEQ ID NO: 681

SEQ ID NO: 688 - DNA, 201 bp, Homo sapiens; identical to SEQ ID NO: 682

SEQ ID NO: 689 - DNA, 201 bp, Homo sapiens; identical to SEQ ID NO: 683

SEQ ID NO: 690 - DNA, 201 bp, Homo sapiens; identical to SEQ ID NO: 684

SEQ ID NO: 691 - DNA, 201 bp, Homo sapiens; identical to SEQ ID NO: 685

SEQ ID NO: 692 - DNA, 201 bp, Homo sapiens; identical to SEQ ID NO: 686

SEQ ID NO: 693 - DNA, 144 bp, Homo sapiens; identical to SEQ ID NO: 681

SEQ ID NO: 694 - DNA, 201 bp, Homo sapiens; identical to SEQ ID NO: 682

SEQ ID NO: 695 - DNA, 201 bp, Homo sapiens; identical to SEQ ID NO: 683

SEQ ID NO: 696 - DNA, 201 bp, Homo sapiens; identical to SEQ ID NO: 684

SEQ ID NO: 697 - DNA, 201 bp, Homo sapiens; identical to SEQ ID NO: 685

SEQ ID NO: 698 - DNA, 201 bp, Homo sapiens; identical to SEQ ID NO: 686

SEQ ID NO: 699 - DNA, 201 bp, Homo sapiens
agctgtgctgcccaacatgatgcctcctccaaggtacaatccacacccagtgactaataaacaggggttacaaaggcatgcctgcttgccccagtttgggwcaactttaccaggccaacccagcctcaaggctctccacaggaacaggtgaggccatagttgtgattacatcacaggtcagtttctcctctgcccaagcct

SEQ ID NO: 700 - DNA, 201 bp, Homo sapiens
ggaaaggaaactgggagcccgggagaactaaaattcccaattaaaagtgaatttaaatctgagctgttcttagacccagaatttcttgcctgaaggaggartcaggtccccacaaggaaagaccctgcaactgtataaaaaaagaatctaaaaagatcatgactccttcagtcctttcccaaagagacctatggaaatttc

SEQ ID NO: 701 - DNA, 201 bp, Homo sapiens
gactaataaacaggggttacaaaggcatgcctgcttgccccagtttgggacaactttaccaggccaacccagcctcaaggctctccacaggaacaggtgasgccatagttgtgattacatcacaggtcagtttctcctctgcccaagccttcttccttcattcctccacagatgctgatcctgagattcctttccagtaaa

SEQ ID NO: 702 - DNA, 201 bp, Homo sapiens
gtgctgcccaacatgatgcctcctccaaggtacaatccacacccagtgactaataaacaggggttacaaaggcatgcctgcttgccccagtttgggacaamtttaccaggccaacccagcctcaaggctctccacaggaacaggtgaggccatagttgtgattacatcacaggtcagtttctcctctgcccaagccttctt

SEQ ID NO: 703 - DNA, 201 bp, Homo sapiens
ggccctgcaggctgagaaactggaccaccatcctgaatggtttaacgtgtacaacaaggtccacatcacgctgagcacccatgagtgtgccggcctttcakaacgggacataaacctggccagcttcatcgaacaagtagcagtgtccatgacatagaccctgcccttcctctttgaattcttccgggggaaggggtgact

SEQ ID NO: 704 - DNA, 201 bp, Homo sapiens
gcctttgggttcatgacaagagtggccctgcaggctgagaaactggaccaccatcctgaatggtttaacgtgtacaacaaggtccacatcacgctgagcayccatgagtgtgccggcctttcagaacgggacataaacctggccagcttcatcgaacaagtagcagtgtccatgacatagaccctgcccttcctctttgaa

SEQ ID NO: 705 - DNA, 201 bp, Homo sapiens
ctgcaggctgagaaactggaccaccatcctgaatggtttaacgtgtacaacaaggtccacatcacgctgagcacccatgagtgtgccggcctttcagaacrggacataaacctggccagcttcatcgaacaagtagcagtgtccatgacatagaccctgcccttcctctttgaattcttccgggggaaggggtgactgaac

SEQ ID NO: 706 - DNA, 201 bp, Homo sapiens
gcctttcagaacgggacataaacctggccagcttcatcgaacaagtagcagtgtccatgacatagaccctgcccttcctctttgaattcttccgggggaargggtgactgaactgggagtccagggagggagctgaggagcccttaccctcccaccactcccctcccaagacccagccgccgccgttgagggctgagtcct

SEQ ID NO: 707 - DNA, 201 bp, Homo sapiens
tcctgaatggtttaacgtgtacaacaaggtccacatcacgctgagcacccatgagtgtgccggcctttcagaacgggacataaacctggccagcttcatcraacaagtagcagtgtccatgacatagaccctgcccttcctctttgaattcttccgggggaaggggtgactgaactgggagtccagggagggagctgagga

SEQ ID NO: 708 - DNA, 201 bp, Homo sapiens
tgaatggtttaacgtgtacaacaaggtccacatcacgctgagcacccatgagtgtgccggcctttcagaacgggacataaacctggccagcttcatcgaayaagtagcagtgtccatgacatagaccctgcccttcctctttgaattcttccgggggaaggggtgactgaactgggagtccagggagggagctgaggagcc

SEQ ID NO: 709 - DNA, 201 bp, Homo sapiens
ataaactctcccctttctttgcaacttcccagcaacaataatgattttcttgccaggccgtctcttgctccctaattcatttcccaggaagctgtgatacrgggtgaaataaagtcttgtcttagaaaccaggaccctaaaccccacactatgtaatagaaacacatgtgtttttatgtctcaaataaaactattatatca

SEQ ID NO: 710 - DNA, 176 bp, Homo sapiens
gctggcaaagcacacaggctgagcgctgaggagagggaccagctgctgccaaacctgagggctgtggggtggaatkagctggaaggccgtgatgccatcttcaagcagtttcatttcaaagacttcaacagggcctttgggttcatgacaagagtggccctgcaggctgagaaact

SEQ ID NO: 711 - DNA, 201 bp, Homo sapiens; identical to SEQ ID NO: 703

SEQ ID NO: 712 - DNA, 201 bp, Homo sapiens; identical to SEQ ID NO: 704

SEQ ID NO: 713 - DNA, 201 bp, Homo sapiens; identical to SEQ ID NO: 705

SEQ ID NO: 714 - DNA, 201 bp, Homo sapiens; identical to SEQ ID NO: 706

SEQ ID NO: 715 - DNA, 129 bp, Homo sapiens
ccgccccgggacggcagcctgcgcgcccrgccgccgcctgccctctccgctggccacctgctgccgcccgcgccatggctggcaaagcacacaggctgagcgctgaggagagggaccagctgctgccaa

SEQ ID NO: 716 - DNA, 201 bp, Homo sapiens; identical to SEQ ID NO: 707

SEQ ID NO: 717 - DNA, 201 bp, Homo sapiens; identical to SEQ ID NO: 708

SEQ ID NO: 718 - DNA, 201 bp, Homo sapiens; identical to SEQ ID NO: 709

SEQ ID NO: 719 - DNA, 201 bp, Homo sapiens
gccacctgctgccgcccgcgccatggctggcaaagcacacaggctgagcgctgaggagagggaccagctgctgccaaacctgagggctgtggggtggaatkagctggaaggccgtgatgccatcttcaagcagtttcatttcaaagacttcaacagggcctttgggttcatgacaagagtggccctgcaggctgagaaact

SEQ ID NO: 720 - DNA, 201 bp, Homo sapiens
ctgcaggctgagaaactggaccaccatcctgaatggtttaacgtgtacaacaaggtctcaaggctacaagcctccggtgtgcaacaataccatctgctttsctggttctccagcttgccaactacagatcttgggacttgtcagcctccataatcacatgagccaattccttataagaaatctctttgtgtgtattggttc

SEQ ID NO: 721 - DNA, 129 bp, Homo sapiens; identical to SEQ ID NO: 715

SEQ ID NO: 722 - DNA, 201 bp, Homo sapiens; identical to SEQ ID NO: 719

SEQ ID NO: 723 - DNA, 201 bp, Homo sapiens
cctcttccctgggcctgtttctcgctgtccctgtcttttatccttctcatctgcctcttttttgctcaccctgtttctcactgccctcccctccgcctttytcacccctctgtccttttgagctcttttttgctctgtctcttcatttgccttttgcactctcaaactctttcatcttcccattcgctgtctgtatttctc

SEQ ID NO: 724 - DNA, 201 bp, Homo sapiens
caccctgtttctcactgccctcccctccgcctttctcacccctctgtccttttgagctcttttttgctctgtctcttcatttgccttttgcactctcaaamtctttcatcttcccattcgctgtctgtatttctccataactatatctttcttcctctgtctccgcccacccacatttttctctttccctttctctctttg

SEQ ID NO: 725 - DNA, 201 bp, Homo sapiens
acatgagcctcctggagaaccacacccgccaagcagacgaggactacagccacgacctcatgctgctccgcctgacagagcctgctgataccatcacagaygctgtgaaggtcgtggagttgcccaccgaggaacccgaagtggggagcacctgtttggcttccggctggggcagcatcgaaccagagaatttctcatttc

SEQ ID NO: 726 - DNA, 201 bp, Homo sapiens
ctgtttggcttccggctggggcagcatcgaaccagagaatttctcatttccagatgatctccagtgtgtggacctcaaaatcctgcctaatgatgagtgcraaaaagcccacgtccagaaggtgacagacttcatgctgtgtgtcggacacctggaaggtggcaaagacacctgtgtgggtgattcagggggcccgctgat

SEQ ID NO: 727 - DNA, 201 bp, Homo sapiens
agcatcgaaccagagaatttctcatttccagatgatctccagtgtgtggacctcaaaatcctgcctaatgatgagtgcaaaaaagcccacgtccagaaggwgacagacttcatgctgtgtgtcggacacctggaaggtggcaaagacacctgtgtgggtgattcagggggcccgctgatgtgtgatggtgtgctccaaggt

SEQ ID NO: 728 - DNA, 201 bp, Homo sapiens
ccctcccccatgctcccctgccccatccccttttccccttcccgtcttctcatccctccattcccatctttccccagcaattaccagctctggctgggtcrccacaacttgtttgacgacgaaaacacagcccagtttgttcatgtcagtgagagcttcccacaccctggcttcaacatgagcctcctggagaaccacacc

SEQ ID NO: 729 - DNA, 201 bp, Homo sapiens
ccaagcagacgaggactacagccacgacctcatgctgctccgcctgacagagcctgctgataccatcacagacgctgtgaaggtcgtggagttgcccaccsaggaacccgaagtggggagcacctgtttggcttccggctggggcagcatcgaaccagagaatttctcatttccagatgatctccagtgtgtggacctcaa

SEQ ID NO: 730 - DNA, 201 bp, Homo sapiens
ttcttcctctgtctccgcccacccacatttttctctttccctttctctctttggggaccctcccccatgctcccctgccccatccccttttccccttcccrtcttctcatccctccattcccatctttccccagcaattaccagctctggctgggtcgccacaacttgtttgacgacgaaaacacagcccagtttgttcat

SEQ ID NO: 731 - DNA, 201 bp, Homo sapiens; identical to SEQ ID NO: 727

SEQ ID NO: 732 - DNA, 201 bp, Homo sapiens; identical to SEQ ID NO: 729

SEQ ID NO: 733 - DNA, 201 bp, Homo sapiens
catttcagcactttccagtgtgggggcatcctggtgcaccgccagtgggtgctcacagctgctcattgcatcagcgacaattaccagctctggctgggtcrccacaacttgtttgacgacgaaaacacagcccagtttgttcatgtcagtgagagcttcccacaccctggcttcaacatgagcctcctggagaaccacacc

SEQ ID NO: 734 - DNA, 201 bp, Homo sapiens; identical to SEQ ID NO: 725

SEQ ID NO: 735 - DNA, 201 bp, Homo sapiens; identical to SEQ ID NO: 726

SEQ ID NO: 736 - DNA, 201 bp, Homo sapiens
cagcctccccaacaaagaccaccgcaatgacatcatgctggtgaagatggcatcgccagtctccatcacctgggctgtgcgacccctcaccctctcctcaygctgtgtcactgctggcaccagctgcctcatttccggctggggcagcacgtccagcccccagttacgcctgcctcacaccttgcgatgcgccaacatcac

SEQ ID NO: 737 - DNA, 201 bp, Homo sapiens
cactgggactcaagagaggaacctggggcccgctcctcccccctccaggccatgaggattctgcagttaatcctgcttgctctggcaacagggcttgtagrgggagagaccaggatcatcaaggggttcgagtgcaagcctcactcccagccctggcaggcagccctgttcgagaagacgcggctactctgtggggcgacg

SEQ ID NO: 738 - DNA, 201 bp, Homo sapiens
agagctcagcctacgtctttaatcctcctgcccaccccttggattctgtctccactgggactcaagagaggaacctggggcccgctcctcccccctccagrccatgaggattctgcagttaatcctgcttgctctggcaacagggcttgtagggggagagaccaggatcatcaaggggttcgagtgcaagcctcactccca

SEQ ID NO: 739 - DNA, 201 bp, Homo sapiens
acgctgtgtcactgctggcaccagctgcctcatttccggctggggcagcacgtccagcccccagttacgcctgcctcacaccttgcgatgcgccaacatcrccatcattgagcaccagaagtgtgagaacgcctaccccggcaacatcacagacaccatggtgtgtgccagcgtgcaggaagggggcaaggactcctgcca

SEQ ID NO: 740 - DNA, 201 bp, Homo sapiens
tagactggacccacccaccacagcccatcaccctccatttccacttggtgtttggttcctgttcactctgttaataagaaaccctaagccaagaccctctrcgaacattctttgggcctcctggactacaggagatgctgtcacttaataatcaacctggggttcgaaatcagtgagacctggattcaaattctgccttga

SEQ ID NO: 741 - DNA, 201 bp, Homo sapiens; identical to SEQ ID NO: 736

SEQ ID NO: 742 - DNA, 201 bp, Homo sapiens
ggtctcacagcagccaaggaacctggggcccgctcctcccccctccaggccatgaggattctgcagttaatcctgcttgctctggcaacagggcttgtagrgggagagaccaggatcatcaaggggttcgagtgcaagcctcactcccagccctggcaggcagccctgttcgagaagacgcggctactctgtggggcgacg

SEQ ID NO: 743 - DNA, 201 bp, Homo sapiens
tccgcagatgcagaggttgaggtggctgcgggactggaagtcatcgggcagaggtctcacagcagccaaggaacctggggcccgctcctcccccctccagrccatgaggattctgcagttaatcctgcttgctctggcaacagggcttgtagggggagagaccaggatcatcaaggggttcgagtgcaagcctcactccca

SEQ ID NO: 744 - DNA, 201 bp, Homo sapiens; identical to SEQ ID NO: 739

SEQ ID NO: 745 - DNA, 201 bp, Homo sapiens; identical to SEQ ID NO: 740

SEQ ID NO: 746 - DNA, 201 bp, Homo sapiens
tagagaaaatgttccaaagtctggcacgccccagcttcctagtaatagaggaggagacatttctaaaatcgcacccagaactgtctacaccaagagcaaakattcgactgtcaatcacactttgacttgcaccaaaataccacctatgaactatgtgtcaaagaggctgccattcgctgcaaggttgaacacccccatggg

SEQ ID NO: 747 - DNA, 201 bp, Homo sapiens
ggagcgcctgaaacaccagtctttggggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaatcccgtatgttggcaccattcct

SEQ ID NO: 748 - DNA, 153 bp, Homo sapiens
aaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatct

SEQ ID NO: 749 - DNA, 201 bp, Homo sapiens
ggtcatacacagaagagactccaatcgacaagaagctggaaaagaatgatgttgtccttaaacaacctacagaatatcatctataacccggtaatcccgtwtgttggcaccattcctgatcagctggatcctggaactttgattgtgatacgtgggcatgttcctagtgacgcagacagattccaggtggatctgcagaat

SEQ ID NO: 750 - DNA, 201 bp, Homo sapiens
ccttgctgaaacgcatctcactgtcattctattgtttatattgttaaaatgagcttgtgcaccattaggtcctgctgggtgttctcagtccttgccatgamgtatggtggtgtctagcactgaatggggaaactgggggcagcaacacttatagccagttaaagccactctgccctctctcctactttggctgactcttca

SEQ ID NO: 751 - DNA, 201 bp, Homo sapiens
tctcttgagcttcgactcttctgtgcgctactgctgcgcactgctttttctacaggcattacatcaactcctaaggggtcctctgggattagttatgcagmtattaaatcacccgaagacactaacttacagaagacacaactccttccccagtgatcactgtcataaccagtgctctaccgtatcccatcactgaggact

SEQ ID NO: 752 - DNA, 201 bp, Homo sapiens
gactccaatcgacaagaagctggaaaagaatgatgttgtccttaaacaacctacagaatatcatctataacccggtaatcccgtatgttggcaccattccygatcagctggatcctggaactttgattgtgatacgtgggcatgttcctagtgacgcagacagattccaggtggatctgcagaatggcagcagcatgaaac

SEQ ID NO: 753 - DNA, 201 bp, Homo sapiens
tttgcaatactttgataaatgaaaaatggggacgggaagagatcacctatgacacgcctttcaaaagagaaaagtcttttgagatcgtgattatggtgctraaggacaaattccaggtggctgtaaatggaaaacatactctgctctatggccacaggatcggcccagagaaaatagacactctgggcatttatggcaaag

SEQ ID NO: 754 - DNA, 201 bp, Homo sapiens
accaaaatacagaatggcttctgtgatactggccttgctgaaacgcatctcactgtcattctattgtttatattgttaaaatgagcttgtgcaccattagrtcctgctgggtgttctcagtccttgccatgaagtatggtggtgtctagcactgaatggggaaactgggggcagcaacacttatagccagttaaagccact

SEQ ID NO: 755 - DNA, 201 bp, Homo sapiens
cctgttctcttgagcttcgactcttctgtgcgctactgctgcgcactgctttttctacaggcattacatcaactcctaaggggtcctctgggattagttawgcagatattaaatcacccgaagacactaacttacagaagacacaactccttccccagtgatcactgtcataaccagtgctctaccgtatcccatcactga

SEQ ID NO: 756 - DNA, 201 bp, Homo sapiens
gcacttctatactagcaagctctgtctctaaaatgcaagttggccttttgcttgccacatttctgcattaaacttctatattagcttcaaaggcttttaawctcaatgcgaacattctacgggatgttcttagatgcctttaaaaagggggcagatctaattttatttgaaccctcactttccaacttcaccatgacccag

SEQ ID NO: 757 - DNA, 201 bp, Homo sapiens
ttgtaagaaattcttttcttcaggagtcctggggagaagaagagagaaatattacctctttcccatttagtcctgggatgtactttgagatgataatttaytgtgatgttagagaattcaaggttgcagtaaatggcgtacacagcctggagtacaaacacagatttaaagagctcagcagtattgacacgctggaaatta

SEQ ID NO: 758 - DNA, 201 bp, Homo sapiens
gttgtccttaaacaacctacagaatatcatctataacccggtaatcccgtatgttggcaccattcctgatcagctggatcctggaactttgattgtgataygtgggcatgttcctagtgacgcagacagattccaggtggatctgcagaatggcagcagcatgaaacctcgagccgatgtggcctttcatttcaatcctcg

SEQ ID NO: 759 - DNA, 201 bp, Homo sapiens
agattttttttggtaaaactgtgaagagctaggatatatacttggtgaaacaaaccagtatgttccctgttctcttgagcttcgactcttctgtgcgctaytgctgcgcactgctttttctacaggcattacatcaactcctaaggggtcctctgggattagttatgcagatattaaatcacccgaagacactaacttaca

SEQ ID NO: 760 - DNA, 201 bp, Homo sapiens
ggaatattttcagaacagattttagatattatttctatccatatattgaaaagaataccattgtcaatcttatttttttaaaagtactcagtgtagaaatygctagcccttaattcttttccagcttttcatattaatgtatgcagagtctcaccaagctcaaagacactggttgggggtggagggtgccacagggaaagc

SEQ ID NO: 761 - DNA, 201 bp, Homo sapiens
cgctactgctgcgcactgctttttctacaggcattacatcaactcctaaggggtcctctgggattagttatgcagatattaaatcacccgaagacactaayttacagaagacacaactccttccccagtgatcactgtcataaccagtgctctaccgtatcccatcactgaggactgatgttgactgacatcattttcttt

SEQ ID NO: 762 - DNA, 201 bp, Homo sapiens
gcacagattttttttggtaaaactgtgaagagctaggatatatacttggtgaaacaaaccagtatgttccctgttctcttgagcttcgactcttctgtgckctactgctgcgcactgctttttctacaggcattacatcaactcctaaggggtcctctgggattagttatgcagatattaaatcacccgaagacactaact

SEQ ID NO: 763 - DNA, 201 bp, Homo sapiens
cattcctgatcagctggatcctggaactttgattgtgatacgtgggcatgttcctagtgacgcagacagattccaggtggatctgcagaatggcagcagcrtgaaacctcgagccgatgtggcctttcatttcaatcctcgtttcaaaagggccggctgcattgtttgcaatactttgataaatgaaaaatggggacggga

SEQ ID NO: 764 - DNA, 201 bp, Homo sapiens
gactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggt

SEQ ID NO: 765 - DNA, 201 bp, Homo sapiens
ggcacgccccagcttcctagtaatagaggaggagacatttctaaaatcgcacccagaactgtctacaccaagagcaaagattcgactgtcaatcacacttwgacttgcaccaaaataccacctatgaactatgtgtcaaagaggctgccattcgctgcaaggttgaacacccccatgggccctggacgaactgtcgtcgtt

SEQ ID NO: 766 - DNA, 201 bp, Homo sapiens
ccattcctgatcagctggatcctggaactttgattgtgatacgtgggcatgttcctagtgacgcagacagattccaggtggatctgcagaatggcagcagyatgaaacctcgagccgatgtggcctttcatttcaatcctcgtttcaaaagggccggctgcattgtttgcaatactttgataaatgaaaaatggggacggg

SEQ ID NO: 767 - DNA, 107 bp, Homo sapiens
attttgbctttacattttacataatttcagatacattttcctcatatcaaataattcagcattttttagtactaacatcatagtctgtaagccattcaaaaaatgta

SEQ ID NO: 768 - DNA, 201 bp, Homo sapiens
ttcttagttaaccaccaatggaactgggttcattctgaatcctggaggagcttcctcgtgccacccagtgtttctgggccctctgtgtgagcagccaggtrtgagctgttttagaagcagcgtgttgccttcatctctcccgtttcccaaaagaacaaaggataaaggtgacagtcacactcctgggttaaaaaaagcatt

SEQ ID NO: 769 - DNA, 201 bp, Homo sapiens
aggctttacagtcaaaagtacttctgttgattgctaaataacttcattttcttgaaatagagcaactttgagtgaaatctgcaacatggataccatgtatrtaagatactgctgtacagaagagttaaggcttacagtgcaaatgaggcgtcagctttgggtgctaaaattaacaagtctaatattattaccatcaatcag

SEQ ID NO: 770 - DNA, 201 bp, Homo sapiens
tctgtataaaaataccgtgtatcatttactctttctgcagctctatacgataggcaggagaggcttatgtggcagcacaagccaggtggggattttgtaamgaagtgataaaacatttgtaagtaatccaagtaggtgtattaaggcaccaaaagtaacatggcacccaacacccaaaaataaaaatatgaaatatgagtg

SEQ ID NO: 771 - DNA, 201 bp, Homo sapiens
aaaatgttccaaagtctggcacgccccagcttcctagtaatagaggaggagacatttctaaaatcgcacccagaactgtctacaccaagagcaaagattcractgtcaatcacactttgacttgcaccaaaataccacctatgaactatgtgtcaaagaggctgccattcgctgcaaggttgaacacccccatgggccctg

SEQ ID NO: 772 - DNA, 201 bp, Homo sapiens
cccatcactgaggactgatgttgactgacatcattttctttatcgtaataaacatgtggctctattagctgcaagctttaccaagtaattggcatgacatytgagcacagaaattaaggcaaaaaaccaaagcaaaacaaatacatggtgctgaaattaacttgatgccaagcccaaggcagctgatttctgtgtatttga

SEQ ID NO: 773 - DNA, 201 bp, Homo sapiens
gactcttcaagaatgccattcaacaagtatttatggagtacctactataatacagtagctaacatgtattgagcacagattttttttggtaaaactgtgargagctaggatatatacttggtgaaacaaaccagtatgttccctgttctcttgagcttcgactcttctgtgcgctactgctgcgcactgctttttctacag

SEQ ID NO: 774 - DNA, 201 bp, Homo sapiens
gagctgttttagaagcagcgtgttgccttcatctctcccgtttcccaaaagaacaaaggataaaggtgacagtcacactcctgggttaaaaaaagcattcmagaaccacttctctttatgggcacaacaaagaaacgaaggctgaagttcgcctacccaaaatgaaaagtaggctttacagtcaaaagtacttctgttgat

SEQ ID NO: 775 - DNA, 201 bp, Homo sapiens
ttacaaagtacccaagcatctagtctggaactgacagagataagtagagaaaatgttccaaagtctggcacgccccagcttcctagtaatagaggaggagrcatttctaaaatcgcacccagaactgtctacaccaagagcaaagattcgactgtcaatcacactttgacttgcaccaaaataccacctatgaactatgtg

SEQ ID NO: 776 - DNA, 201 bp, Homo sapiens
aaatcgcacccagaactgtctacaccaagagcaaagattcgactgtcaatcacactttgacttgcaccaaaataccacctatgaactatgtgtcaaagagsctgccattcgctgcaaggttgaacacccccatgggccctggacgaactgtcgtcgttaaaggagaagtgaatgcaaatgccaaaagctttaatgttgacc

SEQ ID NO: 777 - DNA, 201 bp, Homo sapiens
agcctcctgagtagctgggactacagggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaatcccgtatgttggcaccattcct

SEQ ID NO: 778 - DNA, 153 bp, Homo sapiens; identical to SEQ ID NO: 748

SEQ ID NO: 779 - DNA, 201 bp, Homo sapiens; identical to SEQ ID NO: 749

SEQ ID NO: 780 - DNA, 201 bp, Homo sapiens; identical to SEQ ID NO: 750

SEQ ID NO: 781 - DNA, 201 bp, Homo sapiens; identical to SEQ ID NO: 751

SEQ ID NO: 782 - DNA, 201 bp, Homo sapiens; identical to SEQ ID NO: 752

SEQ ID NO: 783 - DNA, 201 bp, Homo sapiens; identical to SEQ ID NO: 753

SEQ ID NO: 784 - DNA, 201 bp, Homo sapiens
acaccagtctttggatggagtctcgttctgttgcccaggctggagtgcagtggcacaatctcggctcacttcaacctccgtctcccaggttcaagcaattstcctgtctcagcctcctgagtagctgggactacagggccagtgcctcagtttcaatccaggtaacctttaaatgaaacttgcctaaaatcttaggtcata

SEQ ID NO: 785 - DNA, 201 bp, Homo sapiens; identical to SEQ ID NO: 754

SEQ ID NO: 786 - DNA, 201 bp, Homo sapiens; identical to SEQ ID NO: 755

SEQ ID NO: 787 - DNA, 201 bp, Homo sapiens; identical to SEQ ID NO: 756

SEQ ID NO: 788 - DNA, 201 bp, Homo sapiens; identical to SEQ ID NO: 757

SEQ ID NO: 789 - DNA, 201 bp, Homo sapiens; identical to SEQ ID NO: 758

SEQ ID NO: 790 - DNA, 201 bp, Homo sapiens; identical to SEQ ID NO: 759

SEQ ID NO: 791 - DNA, 201 bp, Homo sapiens; identical to SEQ ID NO: 760

SEQ ID NO: 792 - DNA, 201 bp, Homo sapiens; identical to SEQ ID NO: 761

SEQ ID NO: 793 - DNA, 201 bp, Homo sapiens; identical to SEQ ID NO: 762

SEQ ID NO: 794 - DNA, 201 bp, Homo sapiens; identical to SEQ ID NO: 763

SEQ ID NO: 795 - DNA, 201 bp, Homo sapiens; identical to SEQ ID NO: 764

SEQ ID NO: 796 - DNA, 201 bp, Homo sapiens; identical to SEQ ID NO: 766

SEQ ID NO: 797 - DNA, 201 bp, Homo sapiens; identical to SEQ ID NO: 768

SEQ ID NO: 798 - DNA, 201 bp, Homo sapiens; identical to SEQ ID NO: 769

SEQ ID NO: 799 - DNA, 201 bp, Homo sapiens; identical to SEQ ID NO: 770

SEQ ID NO: 800 - DNA, 201 bp, Homo sapiens; identical to SEQ ID NO: 772

SEQ ID NO: 801 - DNA, 201 bp, Homo sapiens; identical to SEQ ID NO: 773

SEQ ID NO: 802 - DNA, 201 bp, Homo sapiens; identical to SEQ ID NO: 774

SEQ ID NO: 803 - DNA, 201 bp, Homo sapiens
ttagcttcagctcggacttacaaagtacccaagcatctagtctggaactgacagagataagtagagaaaatgttccaaagtctggcacgccccagcttagsctgccattcgctgcaaggttgaacacccccatgggccctggacgaactgtcgtcgttaaaggagaagtgaatgcaaatgccaaaagctttaatgttgacc

SEQ ID NO: 804 - DNA, 201 bp, Homo sapiens; identical to SEQ ID NO: 747

SEQ ID NO: 805 - DNA, 153 bp, Homo sapiens; identical to SEQ ID NO: 748

SEQ ID NO: 806 - DNA, 201 bp, Homo sapiens; identical to SEQ ID NO: 749

SEQ ID NO: 807 - DNA, 201 bp, Homo sapiens; identical to SEQ ID NO: 750

SEQ ID NO: 808 - DNA, 201 bp, Homo sapiens; identical to SEQ ID NO: 751

SEQ ID NO: 809 - DNA, 201 bp, Homo sapiens; identical to SEQ ID NO: 752

SEQ ID NO: 810 - DNA, 201 bp, Homo sapiens; identical to SEQ ID NO: 753

SEQ ID NO: 811 - DNA, 201 bp, Homo sapiens; identical to SEQ ID NO: 754

SEQ ID NO: 812 - DNA, 201 bp, Homo sapiens; identical to SEQ ID NO: 755

SEQ ID NO: 813 - DNA, 201 bp, Homo sapiens; identical to SEQ ID NO: 756

SEQ ID NO: 814 - DNA, 201 bp, Homo sapiens; identical to SEQ ID NO: 757

SEQ ID NO: 815 - DNA, 201 bp, Homo sapiens; identical to SEQ ID NO: 758

SEQ ID NO: 816 - DNA, 201 bp, Homo sapiens; identical to SEQ ID NO: 759

SEQ ID NO: 817 - DNA, 201 bp, Homo sapiens; identical to SEQ ID NO: 760

SEQ ID NO: 818 - DNA, 201 bp, Homo sapiens; identical to SEQ ID NO: 761

SEQ ID NO: 819 - DNA, 201 bp, Homo sapiens; identical to SEQ ID NO: 762

SEQ ID NO: 820 - DNA, 201 bp, Homo sapiens; identical to SEQ ID NO: 763

SEQ ID NO: 821 - DNA, 201 bp, Homo sapiens; identical to SEQ ID NO: 764

SEQ ID NO: 822 - DNA, 107 bp, Homo sapiens; identical to SEQ ID NO: 767

SEQ ID NO: 823 - DNA, 201 bp, Homo sapiens; identical to SEQ ID NO: 766

SEQ ID NO: 824 - DNA, 201 bp, Homo sapiens; identical to SEQ ID NO: 768

SEQ ID NO: 825 - DNA, 201 bp, Homo sapiens; identical to SEQ ID NO: 769

SEQ ID NO: 826 - DNA, 201 bp, Homo sapiens; identical to SEQ ID NO: 770

SEQ ID NO: 827 - DNA, 201 bp, Homo sapiens; identical to SEQ ID NO: 772

SEQ ID NO: 828 - DNA, 201 bp, Homo sapiens; identical to SEQ ID NO: 773

SEQ ID NO: 829 - DNA, 201 bp, Homo sapiens; identical to SEQ ID NO: 774

SEQ ID NO: 830 - DNA, 201 bp, Homo sapiens; identical to SEQ ID NO: 803

SEQ ID NO: 831 - DNA, 201 bp, Homo sapiens; identical to SEQ ID NO: 749

SEQ ID NO: 832 - DNA, 201 bp, Homo sapiens; identical to SEQ ID NO: 750

SEQ ID NO: 833 - DNA, 201 bp, Homo sapiens; identical to SEQ ID NO: 752

SEQ ID NO: 834 - DNA, 201 bp, Homo sapiens; identical to SEQ ID NO: 753

SEQ ID NO: 835 - DNA, 201 bp, Homo sapiens; identical to SEQ ID NO: 754

SEQ ID NO: 836 - DNA, 201 bp, Homo sapiens; identical to SEQ ID NO: 756

SEQ ID NO: 837 - DNA, 201 bp, Homo sapiens; identical to SEQ ID NO: 758

SEQ ID NO: 838 - DNA, 201 bp, Homo sapiens; identical to SEQ ID NO: 760

SEQ ID NO: 839 - DNA, 201 bp, Homo sapiens; identical to SEQ ID NO: 761

SEQ ID NO: 840 - DNA, 201 bp, Homo sapiens
cagagataagtagagaaaatgttccaaagtctggcacgccccagcttgcagactgtctctcccctcctgggatttacagggtcatggctctgaaacattcygtagtgttctttggacacgagttttccctggagatcgctttctgcaggcctcttggtcctgactgtggcttcttttcagaggctgccattcgctgcaagg

SEQ ID NO: 841 - DNA, 201 bp, Homo sapiens; identical to SEQ ID NO: 764

SEQ ID NO: 842 - DNA, 201 bp, Homo sapiens; identical to SEQ ID NO: 768

SEQ ID NO: 843 - DNA, 201 bp, Homo sapiens; identical to SEQ ID NO: 769

SEQ ID NO: 844 - DNA, 201 bp, Homo sapiens; identical to SEQ ID NO: 770

SEQ ID NO: 845 - DNA, 201 bp, Homo sapiens; identical to SEQ ID NO: 772

SEQ ID NO: 846 - DNA, 201 bp, Homo sapiens; identical to SEQ ID NO: 774

SEQ ID NO: 847 - DNA, 201 bp, Homo sapiens
gggatttacagggtcatggctctgaaacattccgtagtgttctttggacacgagttttccctggagatcgctttctgcaggcctcttggtcctgactgtgscttcttttcagaggctgccattcgctgcaaggttgaacacccccatgggccctggacgaactgtcgtcgttaaaggagaagtgaatgcaaatgccaaaag

SEQ ID NO: 848 - DNA, 201 bp, Homo sapiens
gagataagtagagaaaatgttccaaagtctggcacgccccagcttgcagactgtctctcccctcctgggatttacagggtcatggctctgaaacattccgkagtgttctttggacacgagttttccctggagatcgctttctgcaggcctcttggtcctgactgtggcttcttttcagaggctgccattcgctgcaaggtt

SEQ ID NO: 849 - DNA, 201 bp, Homo sapiens
ttacaaagtacccaagcatctagtctggaactgacagagataagtagagaaaatgttccaaagtctggcacgccccagcttgcagactgtctctcccctcstgggatttacagggtcatggctctgaaacattccgtagtgttctttggacacgagttttccctggagatcgctttctgcaggcctcttggtcctgactgt

SEQ ID NO: 850 - DNA, 201 bp, Homo sapiens; identical to SEQ ID NO: 747

SEQ ID NO: 851 - DNA, 153 bp, Homo sapiens; identical to SEQ ID NO: 748

SEQ ID NO: 852 - DNA, 201 bp, Homo sapiens; identical to SEQ ID NO: 751

SEQ ID NO: 853 - DNA, 201 bp, Homo sapiens; identical to SEQ ID NO: 755

SEQ ID NO: 854 - DNA, 201 bp, Homo sapiens; identical to SEQ ID NO: 757

SEQ ID NO: 855 - DNA, 201 bp, Homo sapiens; identical to SEQ ID NO: 759

SEQ ID NO: 856 - DNA, 201 bp, Homo sapiens; identical to SEQ ID NO: 762

SEQ ID NO: 857 - DNA, 201 bp, Homo sapiens; identical to SEQ ID NO: 763

SEQ ID NO: 858 - DNA, 201 bp, Homo sapiens; identical to SEQ ID NO: 766

SEQ ID NO: 859 - DNA, 181 bp, Homo sapiens
tggacttggatccgaggcagacgaggaagctgagaaaaccctggcgttgaccccgtggacctgggcgccccgggaaggccrgcgcttggtccaggcaggcggggcctgtgcggtgaccaccctggtcctgaaaagtcccagccccgagcgccctccctcctagacctggaggcctggaaca

SEQ ID NO: 860 - DNA, 201 bp, Homo sapiens; identical to SEQ ID NO: 773

SEQ ID NO: 861 - DNA, 201 bp, Homo sapiens
gtagagaaaatgttccaaagtctggcacgccccagcttgcagactgtctctcccctcctgggatttacagggtcatggctctgaaacattccgtagtgttstttggacacgagttttccctggagatcgctttctgcaggcctcttggtcctgactgtggcttcttttcagaggctgccattcgctgcaaggttgaacacc

SEQ ID NO: 862 - DNA, 201 bp, Homo sapiens
catggctctgaaacattccgtagtgttctttggacacgagttttccctggagatcgctttctgcaggcctcttggtcctgactgtggcttcttttcagagsctgccattcgctgcaaggttgaacacccccatgggccctggacgaactgtcgtcgttaaaggagaagtgaatgcaaatgccaaaagctttaatgttgacc

SEQ ID NO: 863 - DNA, 201 bp, Homo sapiens
agtatgtcgaatcagagaacgggcagatgtatatccagaaaaagcctaccatgtacccaccctgggacagcacttttgatgcccatatcaacaagggaagrgtcatgcagatcattgtgaaaggcaaaaacgtggacctcatctctgaaaccaccgtggagctctactcgctggctgagaggtgcaggaagaacaacggga

SEQ ID NO: 864 - DNA, 133 bp, Homo sapiens
catgctgtttgcagcagtcaattgagttgaattagaattccaaccatacattttaaaggtatttgtgctgtgtgtatattttgataaaatgttgtgacttmatggcaaacaggtggatgtgtaaaaatggaat

SEQ ID NO: 865 - DNA, 201 bp, Homo sapiens
cttcatgaaccccgggatggagcggctgatatcctgaatcttgcccctccagagacaggaaagaatttgccttctccctgggaactggttcaagagacacwgcttgggttcctttttcaacttggaaaaagaaagaaacactcaacaataaagactgagacccgttcgcccccatgtgacttttatctgtagcagaaacca

SEQ ID NO: 866 - DNA, 201 bp, Homo sapiens
ctccctgggaactggttcaagagacactgcttgggttcctttttcaacttggaaaaagaaagaaacactcaacaataaagactgagacccgttcgcccccrtgtgacttttatctgtagcagaaaccaagtctacttcactaatgacgatgccgtgtgtctcgtctcctgacatgtctcacagacgctcctgaagttaggt

SEQ ID NO: 867 - DNA, 201 bp, Homo sapiens
ggatgaggaggagctcttccactccatccgcatggacaatcccttttacccacggtggctggagaaggaagcaaaggaccttctggtgaagctcttcgtgmgagaacctgagaagaggctgggcgtgaggggagacatccgccagcaccctttgtttcgggagatcaactgggaggaacttgaacggaaggagattgaccc

SEQ ID NO: 868 - DNA, 201 bp, Homo sapiens
tggtcttgatggacgatgatgttgagtgcacgatggtagagaagagagttctttccttggcctgggagcatccgtttctgacgcacatgttttgtacattycagaccaaggaaaacctcttttttgtgatggagtacctcaacggaggggacttaatgtaccacatccaaagctgccacaagttcgacctttccagagcga

SEQ ID NO: 869 - DNA, 201 bp, Homo sapiens
gagatgccaagacgaataccttctgtgggacacctgactacatcgccccagagatcttgctgggtcagaaatacaaccactctgtggactggtggtccttyggggttctcctttatgaaatgctgattggtcagtcgcctttccacgggcaggatgaggaggagctcttccactccatccgcatggacaatcccttttacc

SEQ ID NO: 870 - DNA, 201 bp, Homo sapiens
aggccttaaagaaagatgtggtcttgatggacgatgatgttgagtgcacgatggtagagaagagagttctttccttggcctgggagcatccgtttctgacrcacatgttttgtacattccagaccaaggaaaacctcttttttgtgatggagtacctcaacggaggggacttaatgtaccacatccaaagctgccacaagt

SEQ ID NO: 871 - DNA, 201 bp, Homo sapiens
agacaggaaagaatttgccttctccctgggaactggttcaagagacactgcttgggttcctttttcaacttggaaaaagaaagaaacactcaacaataaakactgagacccgttcgcccccatgtgacttttatctgtagcagaaaccaagtctacttcactaatgacgatgccgtgtgtctcgtctcctgacatgtctca

SEQ ID NO: 872 - DNA, 201 bp, Homo sapiens
aagactgaaacggccccattgcctggtctagtagcggatctcactcagccgcagacaagtaatcactaacccgttttattctattcctatctgtggatgtrtaaatggctggggggccagccctggataggtttttatgggaattctttacaataaacatagcttgtaacttgagatctacaaatccattcatcctgattg

SEQ ID NO: 873 - DNA, 201 bp, Homo sapiens
gttatttacttgaaagatgggtctccgcacttggaaaggtttcaagacttgatactgcaataaattatggctcttcacctgggcgccaactgctgatcaaygaaatgcttgttgaatcaggggcaaacggagtacagacgtctcaagactgaaacggccccattgcctggtctagtagcggatctcactcagccgcagaca

SEQ ID NO: 874 - DNA, 201 bp, Homo sapiens
aaattatggctcttcacctgggcgccaactgctgatcaatgaaatgcttgttgaatcaggggcaaacggagtacagacgtctcaagactgaaacggccccrttgcctggtctagtagcggatctcactcagccgcagacaagtaatcactaacccgttttattctattcctatctgtggatgtgtaaatggctggggggcc

SEQ ID NO: 875 - DNA, 201 bp, Homo sapiens
agcactcaacaggctcgctgcttaagagatactgaacagatcttcagagaaggtccggttgaaattggtctcccatgctccatcaaaaatgaagcaaggcygccatgtttaccgacaccgggaaaaagagagcctcagggcatttcctgggagtctccgttggatgaggtggataaaatgtgccatcttccagaacctgaa

SEQ ID NO: 876 - DNA, 201 bp, Homo sapiens
ctccagtattggcacagtcactcactgccattctcacactataacaagaaaagaaatgaagtgcataagtctcctgggaaaagaaccttaaccccttctcrtgccatgactggtgatttcatgactcataagcccctccgtaggcatcattcaagatcaatggcccatgcatgctgtttgcagcagtcaattgagttgaat

SEQ ID NO: 877 - DNA, 201 bp, Homo sapiens
aaatcattcttggtctgcagttccttcattccaaaggaatagtctacagggacctgaagctagataacatcctgttagacaaagatggacatatcaagatygcggattttggaatgtgcaaggagaacatgttaggagatgccaagacgaataccttctgtgggacacctgactacatcgccccagagatcttgctgggtc

SEQ ID NO: 878 - DNA, 201 bp, Homo sapiens
gtgatgcatgtggcatgaatgtgcatcatagatgccagacaaaggtggccaacctttgtggcataaaccagaagctaatggctgaagcgctggccatgatwgagagcactcaacaggctcgctgcttaagagatactgaacagatcttcagagaaggtccggttgaaattggtctcccatgctccatcaaaaatgaagcaa

SEQ ID NO: 879 - DNA, 201 bp, Homo sapiens; identical to SEQ ID NO: 863

SEQ ID NO: 880 - DNA, 133 bp, Homo sapiens; identical to SEQ ID NO: 864

SEQ ID NO: 881 - DNA, 201 bp, Homo sapiens; identical to SEQ ID NO: 865

SEQ ID NO: 882 - DNA, 201 bp, Homo sapiens; identical to SEQ ID NO: 866

SEQ ID NO: 883 - DNA, 201 bp, Homo sapiens; identical to SEQ ID NO: 867

SEQ ID NO: 884 - DNA, 201 bp, Homo sapiens; identical to SEQ ID NO: 868

SEQ ID NO: 885 - DNA, 201 bp, Homo sapiens; identical to SEQ ID NO: 869

SEQ ID NO: 886 - DNA, 201 bp, Homo sapiens; identical to SEQ ID NO: 870

SEQ ID NO: 887 - DNA, 201 bp, Homo sapiens; identical to SEQ ID NO: 871

SEQ ID NO: 888 - DNA, 201 bp, Homo sapiens; identical to SEQ ID NO: 872

SEQ ID NO: 889 - DNA, 201 bp, Homo sapiens; identical to SEQ ID NO: 873

SEQ ID NO: 890 - DNA, 201 bp, Homo sapiens; identical to SEQ ID NO: 874

SEQ ID NO: 891 - DNA, 201 bp, Homo sapiens; identical to SEQ ID NO: 875

SEQ ID NO: 892 - DNA, 201 bp, Homo sapiens; identical to SEQ ID NO: 876

SEQ ID NO: 893 - DNA, 201 bp, Homo sapiens; identical to SEQ ID NO: 877

SEQ ID NO: 894 - DNA, 201 bp, Homo sapiens; identical to SEQ ID NO: 878

SEQ ID NO: 895 - DNA, 201 bp, Homo sapiens; identical to SEQ ID NO: 863

SEQ ID NO: 896 - DNA, 201 bp, Homo sapiens; identical to SEQ ID NO: 875

SEQ ID NO: 897 - DNA, 140 bp, Homo sapiens
tggtcttgatggacgatgatgttgagtgcacgatggtagagaagagagttctttccttggcctgggagcatccgtttctgacgcacatgttttgtacattycagaccaaggtatggcttctgctccgacaaccctacctc

SEQ ID NO: 898 - DNA, 158 bp, Homo sapiens
aggccttaaagaaagatgtggtcttgatggacgatgatgttgagtgcacgatggtagagaagagagttctttccttggcctgggagcatccgtttctgacrcacatgttttgtacattccagaccaaggtatggcttctgctccgacaaccctacctc

SEQ ID NO: 899 - DNA, 201 bp, Homo sapiens; identical to SEQ ID NO: 878

SEQ ID NO: 900 - DNA, 201 bp, Homo sapiens; identical to SEQ ID NO: 863

SEQ ID NO: 901 - DNA, 133 bp, Homo sapiens; identical to SEQ ID NO: 864

SEQ ID NO: 902 - DNA, 201 bp, Homo sapiens; identical to SEQ ID NO: 865

SEQ ID NO: 903 - DNA, 201 bp, Homo sapiens; identical to SEQ ID NO: 866

SEQ ID NO: 904 - DNA, 201 bp, Homo sapiens; identical to SEQ ID NO: 867

SEQ ID NO: 905 - DNA, 201 bp, Homo sapiens; identical to SEQ ID NO: 868

SEQ ID NO: 906 - DNA, 201 bp, Homo sapiens; identical to SEQ ID NO: 869

SEQ ID NO: 907 - DNA, 201 bp, Homo sapiens; identical to SEQ ID NO: 870

SEQ ID NO: 908 - DNA, 201 bp, Homo sapiens; identical to SEQ ID NO: 871

SEQ ID NO: 909 - DNA, 201 bp, Homo sapiens; identical to SEQ ID NO: 872

SEQ ID NO: 910 - DNA, 201 bp, Homo sapiens; identical to SEQ ID NO: 873

SEQ ID NO: 911 - DNA, 201 bp, Homo sapiens; identical to SEQ ID NO: 874

SEQ ID NO: 912 - DNA, 201 bp, Homo sapiens; identical to SEQ ID NO: 875

SEQ ID NO: 913 - DNA, 201 bp, Homo sapiens; identical to SEQ ID NO: 876

SEQ ID NO: 914 - DNA, 201 bp, Homo sapiens; identical to SEQ ID NO: 877

SEQ ID NO: 915 - DNA, 201 bp, Homo sapiens; identical to SEQ ID NO: 878

SEQ ID NO: 916 - DNA, 201 bp, Homo sapiens
ctgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgc

SEQ ID NO: 917 - DNA, 201 bp, Homo sapiens
atgcaagaattttggtgcagaaaatccagatccttttgtcccagtgctgaacactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaat

SEQ ID NO: 918 - DNA, 201 bp, Homo sapiens
gctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcc

SEQ ID NO: 919 - DNA, 201 bp, Homo sapiens
cccatccttgttcaacttgttgatacactgggtgcagagaaattcctctggattctcctcatcttgctttttgaacagtatgtcacaaaaacagtgctggyggctgcctgtggcgaaaaggatgctattttagaagcagacactgaattttggttttcagtctgttgtgagtttagtgtccagcatcagatacaaagcttg

SEQ ID NO: 920 - DNA, 201 bp, Homo sapiens
cagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcggccacaatcgacagggacaccgccttcgccattggatgtactggcctggaagagttgc

SEQ ID NO: 921 - DNA, 201 bp, Homo sapiens
accagtgtctttgagcttggtgagactctgcatacattaatatgaaaagctggaaaagaattaagggctagcgatttctacactgagtacttttaaaaaaataagattgacaatggtattcttttcaatatatggatagaaataatatctaaaatctgttctgaaaatattcctaaatcctggcagagttctgccccagtc

SEQ ID NO: 922 - DNA, 201 bp, Homo sapiens
aatgctttttttaacccaggagtgtgactgtcacctttatcctttgttcttttgggaaacgggagagatgaaggcaacacgctgcttctaaaacagctcayacctggctgctcacacagagggcccagaaacactgggtggcacgaggaagctcctccaggattcagaatgaacccagttccattggtggttaactaagaa

SEQ ID NO: 923 - DNA, 201 bp, Homo sapiens
ctagccttctatttgaagagtatatttcatatagttcacaggaagaaatggattctaataaagtgtctttgcttaatgaacaatttcttccactcattagrcttttagaaagcaaataccccagaacattagatgttgtattagaggaacacttaaaggaaattgcagatctgaaaaaacaagagcttttccatcagtttg

SEQ ID NO: 924 - DNA, 201 bp, Homo sapiens
ctgattgatggtaataatattagacttgttaattttagcacccaaagctgacgcctcatttgcactgtaagccttaactcttctgtacagcagtatcttayatacatggtatccatgttgcagatttcactcaaagttgctctatttcaagaaaatgaagttatttagcaatcaacagaagtacttttgactgtaaagcct

SEQ ID NO: 925 - DNA, 201 bp, Homo sapiens
acatgggtccgtttatgagcatcttgcaagagcatattggggtgatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaac

SEQ ID NO: 926 - DNA, 201 bp, Homo sapiens
tgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgatagttcagtgcatccgcctttcggagatgccgcaga

SEQ ID NO: 927 - DNA, 201 bp, Homo sapiens
cactcatatttcatatttttatttttgggtgttgggtgccatgttacttttggtgccttaatacacctacttggattacttacaaatgttttatcacttckttacaaactgcagaaagagtaaatgatacacggtatttttatacagactgctgtgtttgtttaaacatttattattctcttcctgattgatggtaataat

SEQ ID NO: 928 - DNA, 201 bp, Homo sapiens
gtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggaagccctggacttccgagcccagcactctgagaacgatctggag

SEQ ID NO: 929 - DNA, 201 bp, Homo sapiens
attcttagttgtctgctcaacatctgccaaaaactatctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacac

SEQ ID NO: 930 - DNA, 201 bp, Homo sapiens
tgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagggattgaaatcatctttaccagattacagagctgcaacatacatgataatatgtc

SEQ ID NO: 931 - DNA, 201 bp, Homo sapiens
actcctcgcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactggaaactgtcctgggagagccactccaga

SEQ ID NO: 932 - DNA, 201 bp, Homo sapiens
ccttagcccagcagctgcaacgactcgccctccctcaaagtgatgccagcctcttatctagagatgaagttgcttctttgttatttgaccctaaggaagcrgccacaatcgacagggacaccgccttcgccattggatgtactggcctggaagagttgcttggaattgatccttcctttgagcagtttgaagcaccgttgt

SEQ ID NO: 933 - DNA, 201 bp, Homo sapiens
atcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctc

SEQ ID NO: 934 - DNA, 201 bp, Homo sapiens
tcttccaataattttctgaaaaaggtagttgagagtggtggtcctgagattttaaaaggccttgaagagaggttgctggagaccgttctcggctatatcartgcagttgcacagtccatggaaaggaacgcagacaaactcaccgtgaagttctggcgcgcgctccttagtaaagcttacgacctgttagataaggtcaat

SEQ ID NO: 935 - DNA, 201 bp, Homo sapiens
tgttgcagaaaaaaataaagaagcttgaaagtgtcattactgcagtggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatg

SEQ ID NO: 936 - DNA, 201 bp, Homo sapiens
gaaaactaatcggtgtagcaaatcagaagatgattgagttgttggctgataatataaatttaggagatccttcttcaatgttaaagatggtggaggatttrataagcgtgggtgaggaggagtcctttaacctgaagcagaaagtaacgtttcatgtgatcctgtctgtgctcgtctcttgttgttcatctttaaaagaaa

SEQ ID NO: 937 - DNA, 201 bp, Homo sapiens
cttcaatgttaaagatggtggaggatttaataagcgtgggtgaggaggagtcctttaacctgaagcagaaagtaacgtttcatgtgatcctgtctgtgctygtctcttgttgttcatctttaaaagaaacccactttccatttgcgataagagtcttcagtttgttgcagaaaaaaataaagaagcttgaaagtgtcatta

SEQ ID NO: 938 - DNA, 201 bp, Homo sapiens
acatattaattaaagaagagatactgagtgaaaatgatcagttgtcaaatcaggtggttgtatgtttgctgccatttatggttatcaataatgatgatacrgaatctgctgagatgaaaattgctatatatttatcaaaatcaggaatctgctccctgcaccctctattaagaggctgggaagaagctcttgaaaatgtaa

SEQ ID NO: 939 - DNA, 201 bp, Homo sapiens
tattgtcttgctaccagaatccattcctttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttt

SEQ ID NO: 940 - DNA, 201 bp, Homo sapiens
atctctataatcaagatagcctcattgcttgtgttctgccataccacgagacaagaatatttgtgcgagtcatacagcttctaaaaattaataattcaaarcacagatggttctggttgttgccagttaagcaatctggagtgccgttagctaaaggaactttgattacccactgctacaaagatcttggattcatggatt

SEQ ID NO: 941 - DNA, 201 bp, Homo sapiens
agccttgggaaaaagccattccctcacttatgtaatgttcctgatcttattacaatacttcatgggatttctgaaacttacgatgtcagtcctcttctgcrttacatgcttccccatctggtcgtctccatcattcatcatgttacaggagaagaaactgaaggaatggatggtcaaatctacaagagacacttagaagct

SEQ ID NO: 942 - DNA, 201 bp, Homo sapiens
tagttacccgtttcctaaaactggttccagaccttttggccattgtgcagcgtaagaaaaaggaaggggaagaagaacaagcaatcaacagacagacagcrttgtataccttaaagcttttatgcaagaattttggtgcagaaaatccagatccttttgtcccagtgctgaacactgctgtgaaactgattgctccagaga

SEQ ID NO: 943 - DNA, 201 bp, Homo sapiens
gaagaacaagcaatcaacagacagacagcgttgtataccttaaagcttttatgcaagaattttggtgcagaaaatccagatccttttgtcccagtgctgarcactgctgtgaaactgattgctccagagagaaaggaggagaagaatgtcctgggaagcgcgctgctgtgcatagcagaggtgacctccaccctggaggcg

SEQ ID NO: 944 - DNA, 201 bp, Homo sapiens
gcagggactatctgcacttgctcattgggctgtttgagatgatgctcaatggtgccgatgctgttcatttcagagttctgatgaaacttttcataaaggtkcatctagaagatgtttttcagttattcaagttctgttctgttttatggacctatggttctagcctttcaaatccactaaactgcagtgtgaaaacagtgc

SEQ ID NO: 945 - DNA, 201 bp, Homo sapiens
tgatgcctctggtggatcagctggaaaacaggcttgggggagaagagaaattccaggaacgggtgacaaagcacctgataccatgcatcgcacagttttcrgtggccatggcggatgactctctttggaaaccactgaactaccagattctgctaaagacgagagactcctcgcctaaggttcgatttgctgctttgatta

SEQ ID NO: 946 - DNA, 201 bp, Homo sapiens
gttcaacttgttgatacactgggtgcagagaaattcctctggattctcctcatcttgctttttgaacagtatgtcacaaaaacagtgctggcggctgcctrtggcgaaaaggatgctattttagaagcagacactgaattttggttttcagtctgttgtgagtttagtgtccagcatcagatacaaagcttgatgaatatc

SEQ ID NO: 947 - DNA, 201 bp, Homo sapiens
taagaaaaaggaaggggaagaagaacaagcaatcaacagacagacagcgttgtataccttaaagcttttatgcaagaattttggtgcagaaaatccagatscttttgtcccagtgctgaacactgctgtgaaactgattgctccagagagaaaggaggagaagaatgtcctgggaagcgcgctgctgtgcatagcagaggt

SEQ ID NO: 948 - DNA, 201 bp, Homo sapiens
gaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgca

SEQ ID NO: 949 - DNA, 201 bp, Homo sapiens
cacctgataccatgcatcgcacagttttcggtggccatggcggatgactctctttggaaaccactgaactaccagattctgctaaagacgagagactcctygcctaaggttcgatttgctgctttgattactgtgttagcactggctgaaaaactaaaggagaattatattgtcttgctaccagaatccattcctttctta

SEQ ID NO: 950 - DNA, 201 bp, Homo sapiens
gttgacattttacaacttggcagattgcattgctgaaaagctgaaagggctttttactctgtttgccggccacttagtgaagccttttgctgacaccttgraccaggtgaacatctccaaaacagatgaagcattttttgactctgaaaatgaccctgaaaagtgctgcttgctgttgcagtttattttgaactgtttata

SEQ ID NO: 951 - DNA, 201 bp, Homo sapiens
cgaggtacttaagatagccgctgacatattaattaaagaagagatactgagtgaaaatgatcagttgtcaaatcaggtggttgtatgtttgctgccatttrtggttatcaataatgatgatacggaatctgctgagatgaaaattgctatatatttatcaaaatcaggaatctgctccctgcaccctctattaagaggctg

SEQ ID NO: 952 - DNA, 201 bp, Homo sapiens; identical to SEQ ID NO: 916

SEQ ID NO: 953 - DNA, 201 bp, Homo sapiens; identical to SEQ ID NO: 917

SEQ ID NO: 954 - DNA, 201 bp, Homo sapiens; identical to SEQ ID NO: 918

SEQ ID NO: 955 - DNA, 201 bp, Homo sapiens; identical to SEQ ID NO: 919

SEQ ID NO: 956 - DNA, 201 bp, Homo sapiens; identical to SEQ ID NO: 920

SEQ ID NO: 957 - DNA, 201 bp, Homo sapiens; identical to SEQ ID NO: 921

SEQ ID NO: 958 - DNA, 201 bp, Homo sapiens; identical to SEQ ID NO: 922

SEQ ID NO: 959 - DNA, 201 bp, Homo sapiens; identical to SEQ ID NO: 923

SEQ ID NO: 960 - DNA, 201 bp, Homo sapiens; identical to SEQ ID NO: 924

SEQ ID NO: 961 - DNA, 201 bp, Homo sapiens; identical to SEQ ID NO: 925

SEQ ID NO: 962 - DNA, 201 bp, Homo sapiens; identical to SEQ ID NO: 926

SEQ ID NO: 963 - DNA, 201 bp, Homo sapiens
cactcatatttcatatttttatttttgggtgttgggtgccatgttacttttggtgccttaatacacctacttggattacttacaaatgttttatcacttckttacaaaatccccacctggcttgtgctgccacataagcctctcctgcctatcgtatagagctgcagaaagagtaaatgatacacggtatttttatacaga

SEQ ID NO: 964 - DNA, 201 bp, Homo sapiens; identical to SEQ ID NO: 928

SEQ ID NO: 965 - DNA, 201 bp, Homo sapiens; identical to SEQ ID NO: 929

SEQ ID NO: 966 - DNA, 201 bp, Homo sapiens
tgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagtctttgtacctcactggaaggaggacggagcagacagtctctttgaggcatcatc

SEQ ID NO: 967 - DNA, 201 bp, Homo sapiens; identical to SEQ ID NO: 931

SEQ ID NO: 968 - DNA, 201 bp, Homo sapiens; identical to SEQ ID NO: 932

SEQ ID NO: 969 - DNA, 201 bp, Homo sapiens; identical to SEQ ID NO: 933

SEQ ID NO: 970 - DNA, 201 bp, Homo sapiens; identical to SEQ ID NO: 934

SEQ ID NO: 971 - DNA, 201 bp, Homo sapiens
tggctgataatataaatttaggagatccttcttcaatgttaaagatggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatg

SEQ ID NO: 972 - DNA, 201 bp, Homo sapiens; identical to SEQ ID NO: 938

SEQ ID NO: 973 - DNA, 201 bp, Homo sapiens; identical to SEQ ID NO: 939

SEQ ID NO: 974 - DNA, 201 bp, Homo sapiens
ggtgctagtcagaggccattccctcacttatgtaatgttcctgatcttattacaatacttcatgggatttctgaaacttacgatgtcagtcctcttctgcrttacatgcttccccatctggtcgtctccatcattcatcatgttacaggagaagaaactgaaggaatggatggtcaaatctacaagagacacttagaagct

SEQ ID NO: 975 - DNA, 201 bp, Homo sapiens; identical to SEQ ID NO: 940

SEQ ID NO: 976 - DNA, 201 bp, Homo sapiens; identical to SEQ ID NO: 942

SEQ ID NO: 977 - DNA, 201 bp, Homo sapiens; identical to SEQ ID NO: 943

SEQ ID NO: 978 - DNA, 201 bp, Homo sapiens; identical to SEQ ID NO: 944

SEQ ID NO: 979 - DNA, 201 bp, Homo sapiens; identical to SEQ ID NO: 945

SEQ ID NO: 980 - DNA, 201 bp, Homo sapiens; identical to SEQ ID NO: 946

SEQ ID NO: 981 - DNA, 201 bp, Homo sapiens; identical to SEQ ID NO: 947

SEQ ID NO: 982 - DNA, 201 bp, Homo sapiens; identical to SEQ ID NO: 948

SEQ ID NO: 983 - DNA, 201 bp, Homo sapiens; identical to SEQ ID NO: 949

SEQ ID NO: 984 - DNA, 201 bp, Homo sapiens; identical to SEQ ID NO: 950

SEQ ID NO: 985 - DNA, 201 bp, Homo sapiens; identical to SEQ ID NO: 951

SEQ ID NO: 986 - DNA, 201 bp, Homo sapiens; identical to SEQ ID NO: 916

SEQ ID NO: 987 - DNA, 201 bp, Homo sapiens; identical to SEQ ID NO: 917

SEQ ID NO: 988 - DNA, 201 bp, Homo sapiens; identical to SEQ ID NO: 918

SEQ ID NO: 989 - DNA, 201 bp, Homo sapiens; identical to SEQ ID NO: 919

SEQ ID NO: 990 - DNA, 201 bp, Homo sapiens; identical to SEQ ID NO: 920

SEQ ID NO: 991 - DNA, 201 bp, Homo sapiens; identical to SEQ ID NO: 921

SEQ ID NO: 992 - DNA, 201 bp, Homo sapiens; identical to SEQ ID NO: 922

SEQ ID NO: 993 - DNA, 201 bp, Homo sapiens; identical to SEQ ID NO: 923

SEQ ID NO: 994 - DNA, 201 bp, Homo sapiens; identical to SEQ ID NO: 924

SEQ ID NO: 995 - DNA, 201 bp, Homo sapiens; identical to SEQ ID NO: 925

SEQ ID NO: 996 - DNA, 201 bp, Homo sapiens; identical to SEQ ID NO: 926

SEQ ID NO: 997 - DNA, 201 bp, Homo sapiens; identical to SEQ ID NO: 927

SEQ ID NO: 998 - DNA, 201 bp, Homo sapiens; identical to SEQ ID NO: 928

SEQ ID NO: 999 - DNA, 201 bp, Homo sapiens; identical to SEQ ID NO: 929

SEQ ID NO: 1000 - DNA, 201 bp, Homo sapiens; identical to SEQ ID NO: 966

SEQ ID NO: 1001 - DNA, 201 bp, Homo sapiens; identical to SEQ ID NO: 931

SEQ ID NO: 1002 - DNA, 201 bp, Homo sapiens; identical to SEQ ID NO: 932

SEQ ID NO: 1003 - DNA, 201 bp, Homo sapiens; identical to SEQ ID NO: 933

SEQ ID NO: 1004 - DNA, 201 bp, Homo sapiens; identical to SEQ ID NO: 934

SEQ ID NO: 1005 - DNA, 201 bp, Homo sapiens; identical to SEQ ID NO: 971

SEQ ID NO: 1006 - DNA, 201 bp, Homo sapiens; identical to SEQ ID NO: 938

SEQ ID NO: 1007 - DNA, 201 bp, Homo sapiens; identical to SEQ ID NO: 939

SEQ ID NO: 1008 - DNA, 201 bp, Homo sapiens; identical to SEQ ID NO: 974

SEQ ID NO: 1009 - DNA, 201 bp, Homo sapiens; identical to SEQ ID NO: 940

SEQ ID NO: 1010 - DNA, 201 bp, Homo sapiens; identical to SEQ ID NO: 942

SEQ ID NO: 1011 - DNA, 201 bp, Homo sapiens; identical to SEQ ID NO: 943

SEQ ID NO: 1012 - DNA, 201 bp, Homo sapiens; identical to SEQ ID NO: 944

SEQ ID NO: 1013 - DNA, 201 bp, Homo sapiens; identical to SEQ ID NO: 945

SEQ ID NO: 1014 - DNA, 201 bp, Homo sapiens; identical to SEQ ID NO: 946

SEQ ID NO: 1015 - DNA, 201 bp, Homo sapiens; identical to SEQ ID NO: 947

SEQ ID NO: 1016 - DNA, 201 bp, Homo sapiens; identical to SEQ ID NO: 948

SEQ ID NO: 1017 - DNA, 201 bp, Homo sapiens; identical to SEQ ID NO: 949

SEQ ID NO: 1018 - DNA, 201 bp, Homo sapiens; identical to SEQ ID NO: 950

SEQ ID NO: 1019 - DNA, 201 bp, Homo sapiens; identical to SEQ ID NO: 951

SEQ ID NO: 1020 - DNA, 201 bp, Homo sapiens; identical to SEQ ID NO: 916

SEQ ID NO: 1021 - DNA, 201 bp, Homo sapiens; identical to SEQ ID NO: 917

SEQ ID NO: 1022 - DNA, 201 bp, Homo sapiens; identical to SEQ ID NO: 918

SEQ ID NO: 1023 - DNA, 201 bp, Homo sapiens; identical to SEQ ID NO: 919

SEQ ID NO: 1024 - DNA, 201 bp, Homo sapiens; identical to SEQ ID NO: 920

SEQ ID NO: 1025 - DNA, 201 bp, Homo sapiens; identical to SEQ ID NO: 921

SEQ ID NO: 1026 - DNA, 201 bp, Homo sapiens; identical to SEQ ID NO: 922

SEQ ID NO: 1027 - DNA, 201 bp, Homo sapiens; identical to SEQ ID NO: 923

SEQ ID NO: 1028 - DNA, 201 bp, Homo sapiens; identical to SEQ ID NO: 924

SEQ ID NO: 1029 - DNA, 201 bp, Homo sapiens; identical to SEQ ID NO: 925

SEQ ID NO: 1030 - DNA, 201 bp, Homo sapiens; identical to SEQ ID NO: 926

SEQ ID NO: 1031 - DNA, 201 bp, Homo sapiens; identical to SEQ ID NO: 963

SEQ ID NO: 1032 - DNA, 201 bp, Homo sapiens; identical to SEQ ID NO: 928

SEQ ID NO: 1033 - DNA, 201 bp, Homo sapiens; identical to SEQ ID NO: 929

SEQ ID NO: 1034 - DNA, 201 bp, Homo sapiens; identical to SEQ ID NO: 966

SEQ ID NO: 1035 - DNA, 201 bp, Homo sapiens; identical to SEQ ID NO: 931

SEQ ID NO: 1036 - DNA, 201 bp, Homo sapiens; identical to SEQ ID NO: 932

SEQ ID NO: 1037 - DNA, 201 bp, Homo sapiens; identical to SEQ ID NO: 933

SEQ ID NO: 1038 - DNA, 201 bp, Homo sapiens; identical to SEQ ID NO: 934

SEQ ID NO: 1039 - DNA, 201 bp, Homo sapiens; identical to SEQ ID NO: 971

SEQ ID NO: 1040 - DNA, 201 bp, Homo sapiens; identical to SEQ ID NO: 938

SEQ ID NO: 1041 - DNA, 201 bp, Homo sapiens; identical to SEQ ID NO: 939

SEQ ID NO: 1042 - DNA, 201 bp, Homo sapiens; identical to SEQ ID NO: 974

SEQ ID NO: 1043 - DNA, 201 bp, Homo sapiens; identical to SEQ ID NO: 940

SEQ ID NO: 1044 - DNA, 201 bp, Homo sapiens; identical to SEQ ID NO: 942

SEQ ID NO: 1045 - DNA, 201 bp, Homo sapiens; identical to SEQ ID NO: 943

SEQ ID NO: 1046 - DNA, 201 bp, Homo sapiens; identical to SEQ ID NO: 944

SEQ ID NO: 1047 - DNA, 201 bp, Homo sapiens; identical to SEQ ID NO: 945

SEQ ID NO: 1048 - DNA, 201 bp, Homo sapiens; identical to SEQ ID NO: 946

SEQ ID NO: 1049 - DNA, 201 bp, Homo sapiens; identical to SEQ ID NO: 947

SEQ ID NO: 1050 - DNA, 201 bp, Homo sapiens; identical to SEQ ID NO: 948

SEQ ID NO: 1051 - DNA, 201 bp, Homo sapiens; identical to SEQ ID NO: 949

SEQ ID NO: 1052 - DNA, 201 bp, Homo sapiens; identical to SEQ ID NO: 950

SEQ ID NO: 1053 - DNA, 201 bp, Homo sapiens; identical to SEQ ID NO: 951

SEQ ID NO: 1054 - DNA, 201 bp, Homo sapiens; identical to SEQ ID NO: 922

SEQ ID NO: 1055 - DNA, 201 bp, Homo sapiens; identical to SEQ ID NO: 925

SEQ ID NO: 1056 - DNA, 201 bp, Homo sapiens; identical to SEQ ID NO: 939

SEQ ID NO: 1057 - DNA, 201 bp, Homo sapiens; identical to SEQ ID NO: 924

SEQ ID NO: 1058 - DNA, 201 bp, Homo sapiens; identical to SEQ ID NO: 945

SEQ ID NO: 1059 - DNA, 201 bp, Homo sapiens; identical to SEQ ID NO: 928

SEQ ID NO: 1060 - DNA, 201 bp, Homo sapiens; identical to SEQ ID NO: 963

SEQ ID NO: 1061 - DNA, 201 bp, Homo sapiens; identical to SEQ ID NO: 931

SEQ ID NO: 1062 - DNA, 201 bp, Homo sapiens; identical to SEQ ID NO: 916

SEQ ID NO: 1063 - DNA, 201 bp, Homo sapiens; identical to SEQ ID NO: 948

SEQ ID NO: 1064 - DNA, 201 bp, Homo sapiens; identical to SEQ ID NO: 918

SEQ ID NO: 1065 - DNA, 201 bp, Homo sapiens; identical to SEQ ID NO: 933

SEQ ID NO: 1066 - DNA, 201 bp, Homo sapiens; identical to SEQ ID NO: 949

SEQ ID NO: 1067 - DNA, 201 bp, Homo sapiens; identical to SEQ ID NO: 950

SEQ ID NO: 1068 - DNA, 201 bp, Homo sapiens; identical to SEQ ID NO: 921

SEQ ID NO: 1069 - DNA, 201 bp, Homo sapiens; identical to SEQ ID NO: 916

SEQ ID NO: 1070 - DNA, 201 bp, Homo sapiens; identical to SEQ ID NO: 917

SEQ ID NO: 1071 - DNA, 201 bp, Homo sapiens; identical to SEQ ID NO: 918

SEQ ID NO: 1072 - DNA, 201 bp, Homo sapiens; identical to SEQ ID NO: 919

SEQ ID NO: 1073 - DNA, 201 bp, Homo sapiens; identical to SEQ ID NO: 920

SEQ ID NO: 1074 - DNA, 201 bp, Homo sapiens; identical to SEQ ID NO: 921

SEQ ID NO: 1075 - DNA, 201 bp, Homo sapiens; identical to SEQ ID NO: 922

SEQ ID NO: 1076 - DNA, 201 bp, Homo sapiens; identical to SEQ ID NO: 923

SEQ ID NO: 1077 - DNA, 201 bp, Homo sapiens; identical to SEQ ID NO: 924

SEQ ID NO: 1078 - DNA, 201 bp, Homo sapiens; identical to SEQ ID NO: 925

SEQ ID NO: 1079 - DNA, 201 bp, Homo sapiens; identical to SEQ ID NO: 926

SEQ ID NO: 1080 - DNA, 201 bp, Homo sapiens; identical to SEQ ID NO: 963

SEQ ID NO: 1081 - DNA, 201 bp, Homo sapiens; identical to SEQ ID NO: 928

SEQ ID NO: 1082 - DNA, 201 bp, Homo sapiens; identical to SEQ ID NO: 929

SEQ ID NO: 1083 - DNA, 201 bp, Homo sapiens; identical to SEQ ID NO: 930

SEQ ID NO: 1084 - DNA, 201 bp, Homo sapiens; identical to SEQ ID NO: 931

SEQ ID NO: 1085 - DNA, 201 bp, Homo sapiens; identical to SEQ ID NO: 932

SEQ ID NO: 1086 - DNA, 201 bp, Homo sapiens; identical to SEQ ID NO: 933

SEQ ID NO: 1087 - DNA, 201 bp, Homo sapiens; identical to SEQ ID NO: 934

SEQ ID NO: 1088 - DNA, 201 bp, Homo sapiens; identical to SEQ ID NO: 971

SEQ ID NO: 1089 - DNA, 201 bp, Homo sapiens; identical to SEQ ID NO: 938

SEQ ID NO: 1090 - DNA, 201 bp, Homo sapiens; identical to SEQ ID NO: 939

SEQ ID NO: 1091 - DNA, 201 bp, Homo sapiens; identical to SEQ ID NO: 941

SEQ ID NO: 1092 - DNA, 201 bp, Homo sapiens; identical to SEQ ID NO: 940

SEQ ID NO: 1093 - DNA, 201 bp, Homo sapiens; identical to SEQ ID NO: 942

SEQ ID NO: 1094 - DNA, 201 bp, Homo sapiens; identical to SEQ ID NO: 943

SEQ ID NO: 1095 - DNA, 201 bp, Homo sapiens; identical to SEQ ID NO: 944

SEQ ID NO: 1096 - DNA, 201 bp, Homo sapiens; identical to SEQ ID NO: 945

SEQ ID NO: 1097 - DNA, 201 bp, Homo sapiens; identical to SEQ ID NO: 946

SEQ ID NO: 1098 - DNA, 201 bp, Homo sapiens; identical to SEQ ID NO: 947

SEQ ID NO: 1099 - DNA, 201 bp, Homo sapiens; identical to SEQ ID NO: 948

SEQ ID NO: 1100 - DNA, 201 bp, Homo sapiens; identical to SEQ ID NO: 949

SEQ ID NO: 1101 - DNA, 201 bp, Homo sapiens; identical to SEQ ID NO: 950

SEQ ID NO: 1102 - DNA, 201 bp, Homo sapiens; identical to SEQ ID NO: 951

SEQ ID NO: 1103 - DNA, 201 bp, Homo sapiens
ccctggagctccagctgaagctgaaccaccctgagtcctcacagctgtttgccaagctgctccagaaaatgacagacctcagacagattgtcacggaacaygtgcagctactgcaggtgatcaagaagacggagacagacatgagtcttcacccgctcctgcaggagatctacaaggacttgtactagcagagagtcctga

SEQ ID NO: 1104 - DNA, 201 bp, Homo sapiens
ttgatcttttgctagatagagacaaaatatcagtgtgaattacagcaaacccctattccatgctgttatgggtgaaactctgggagattctcctattgacscagaaagcgattccttcactgatacactgtctgcaaacatatcacaagaaatgaccatggttgacacagagatgccattctggcccaccaactttgggat

SEQ ID NO: 1105 - DNA, 201 bp, Homo sapiens
gacattccattcacaagaacagatccagtggttgcagattacaagtatgacctgaaacttcaagagtaccaaagtgcaatcaaagtggagcctgcatctcmaccttattattctgagaagactcagctctacaataagcctcatgaagagccttccaactccctcatggcaattgaatgtcgtgtctgtggagataaagct

SEQ ID NO: 1106 - DNA, 201 bp, Homo sapiens
acacaatgctggcctccttgatgaataaagatggggttctcatatccgagggccaaggcttcatgacaagggagtttctaaagagcctgcgaaagcctttwggtgactttatggagcccaagtttgagtttgctgtgaagttcaatgcactggaattagatgacagcgacttggcaatatttattgctgtcattattctca

SEQ ID NO: 1107 - DNA, 201 bp, Homo sapiens
agattctcctattgacccagaaagcgattccttcactgatacactgtctgcaaacatatcacaagaaatgaccatggttgacacagagatgccattctggsccaccaactttgggatcagctccgtggatctctccgtaatggaagaccactcccactcctttgatatcaagcccttcactactgttgacttctccagcat

SEQ ID NO: 1108 - DNA, 201 bp, Homo sapiens
gatgggagaagataaaatcaagttcaaacacatcacccccctgcaggagcagagcaaagaggtggccatccgcatctttcagggctgccagtttcgctccrtggaggctgtgcaggagatcacagagtatgccaaaagcattcctggttttgtaaatcttgacttgaacgaccaagtaactctcctcaaatatggagtcca

SEQ ID NO: 1109 - DNA, 201 bp, Homo sapiens
aagctgctccagaaaatgacagacctcagacagattgtcacggaacacgtgcagctactgcaggtgatcaagaagacggagacagacatgagtcttcaccygctcctgcaggagatctacaaggacttgtactagcagagagtcctgagccactgccaacatttcccttcttccagttgcactattctgagggaaaatctg

SEQ ID NO: 1110 - DNA, 201 bp, Homo sapiens
  misc_feature (1)...(201): n = A,T,C or G, or insertion/deletion polymorphism (see Tables 1-2)
ccagctgaagctgaaccaccctgagtcctcacagctgtttgccaagctgctccagaaaatgacagacctcagacagattgtcacggaacacgtgcagctantgcaggtgatcaagaagacggagacagacatgagtcttcacccgctcctgcaggagatctacaaggacttgtactagcagagagtcctgagccactgcca

SEQ ID NO: 1111 - DNA, 201 bp, Homo sapiens; identical to SEQ ID NO: 1108

SEQ ID NO: 1112 - DNA, 201 bp, Homo sapiens; identical to SEQ ID NO: 1104

SEQ ID NO: 1113 - DNA, 201 bp, Homo sapiens; identical to SEQ ID NO: 1105

SEQ ID NO: 1114 - DNA, 201 bp, Homo sapiens; identical to SEQ ID NO: 1106

SEQ ID NO: 1115 - DNA, 201 bp, Homo sapiens; identical to SEQ ID NO: 1107

SEQ ID NO: 1116 - DNA, 201 bp, Homo sapiens; identical to SEQ ID NO: 1103

SEQ ID NO: 1117 - DNA, 201 bp, Homo sapiens; identical to SEQ ID NO: 1108

SEQ ID NO: 1118 - DNA, 201 bp, Homo sapiens; identical to SEQ ID NO: 1105

SEQ ID NO: 1119 - DNA, 201 bp, Homo sapiens; identical to SEQ ID NO: 1106

SEQ ID NO: 1120 - DNA, 201 bp, Homo sapiens
cgcctggggcgcttgggtcggcctcgaggacaccggagaggggcgccacgccgccgtggccgcagaaatgaccatggttgacacagagatgccattctggsccaccaactttgggatcagctccgtggatctctccgtaatggaagaccactcccactcctttgatatcaagcccttcactactgttgacttctccagcat

SEQ ID NO: 1121 - DNA, 201 bp, Homo sapiens; identical to SEQ ID NO: 1109

SEQ ID NO: 1122 - DNA, 201 bp, Homo sapiens; identical to SEQ ID NO: 1110
  misc_feature (1)...(201): n = A,T,C or G, or insertion/deletion polymorphism (see Tables 1-2)

SEQ ID NO: 1123 - DNA, 201 bp, Homo sapiens
gatgggagaagataaaatcaagttcaaacacatcacccccctgcaggagcagagcaaagaggtggccatccgcatctttcagggctgccagtttcgctccrtggaggctaccgcccaggtttgctgaatgtgaagcccattgaagacattcaagacaacctgctacaagccctggagctccagctgaagctgaaccaccct

SEQ ID NO: 1124 - DNA, 201 bp, Homo sapiens; identical to SEQ ID NO: 1103

SEQ ID NO: 1125 - DNA, 201 bp, Homo sapiens; identical to SEQ ID NO: 1105

SEQ ID NO: 1126 - DNA, 201 bp, Homo sapiens
caaatatacaacaaggccattttctcaaacgagagtcagcctttaacgtctatttttcctttcagaaatgaccatggttgacacagagatgccattctggsccaccaactttgggatcagctccgtggatctctccgtaatggaagaccactcccactcctttgatatcaagcccttcactactgttgacttctccagcat

SEQ ID NO: 1127 - DNA, 201 bp, Homo sapiens; identical to SEQ ID NO: 1109

SEQ ID NO: 1128 - DNA, 201 bp, Homo sapiens
ctcggtgtttagggaggagcctaaggtaaggagtcagaaacggggagtaaccgagctgcggcttttatataaggtcagtggtaggtaaggaaggggccttwacctctgctggtgaccagaagcctgcatttctgcattctgcttaattccctttccttagatttgaaagaagccaacactaaaccacaaatatacaacaag

SEQ ID NO: 1129 - DNA, 201 bp, Homo sapiens; identical to SEQ ID NO: 1110
  misc_feature (1)...(201): n = A,T,C or G, or insertion/deletion polymorphism (see Tables 1-2)

SEQ ID NO: 1130 - DNA, 201 bp, Homo sapiens
agaaaaaacaagtccatttttttgtaaatgcatctgatgtcgacaatgtgaaagcccatttaaatgtgagcggaattccatgcagtgtcttgctggcagaygtggaagatcttattcaacagcagatttccaacgacacagtcagcccccgagcctccgcatcgtactatgaacagtatcactcactaaatgaaatctatt

SEQ ID NO: 1131 - DNA, 201 bp, Homo sapiens
acacagtcagcccccgagcctccgcatcgtactatgaacagtatcactcactaaatgaaatctattcttggatagaatttataactgagaggcatcctgayatgcttacaaaaatccacattggatcctcatttgagaagtacccactctatgttttaaaggtttctggaaaagaacaagcagccaaaaatgccatatgga

SEQ ID NO: 1132 - DNA, 201 bp, Homo sapiens
gactagggttcatgtctttttaccctttaaaaaaaattgtaaaagtctagttacctactttttctttgattttcgacgtttgactagccatctcaagcaastttcgacgtttgactagccatctcaagcaagtttaatcaatgatcatctcacgctgatcattggatcctactcaacaaaaggaagggtggtcagaagtac

SEQ ID NO: 1133 - DNA, 201 bp, Homo sapiens
tatcactcactaaatgaaatctattcttggatagaatttataactgagaggcatcctgatatgcttacaaaaatccacattggatcctcatttgagaagtwcccactctatgttttaaaggtttctggaaaagaacaagcagccaaaaatgccatatggattgactgtggaatccatgccagagaatggatctctcctgct

SEQ ID NO: 1134 - DNA, 201 bp, Homo sapiens
tagcttggcatgtcattaggaatgtttaatgcccctgattttatcattctgcttccgtattttaatttactgattccagcaagaccaaatcattgtatcarattatttttaagttttatccgtagttttgataaaagattttcctattccttggttctgtcagagaacctaataagtgctactttgccattaaggcagact

SEQ ID NO: 1135 - DNA, 201 bp, Homo sapiens
cactaaatgaaatctattcttggatagaatttataactgagaggcatcctgatatgcttacaaaaatccacattggatcctcatttgagaagtacccactstatgttttaaaggtttctggaaaagaacaagcagccaaaaatgccatatggattgactgtggaatccatgccagagaatggatctctcctgctttctgct

SEQ ID NO: 1136 - DNA, 108 bp, Homo sapiens
acgctgatcattggatcctactcaacaaaaggaagggtggtcagaagtacattaaagatttctgctccaaattttcaataaatttctgcttgtgcctttaraaataca

SEQ ID NO: 1137 - DNA, 201 bp, Homo sapiens
aaagtctagttacctactttttctttgattttcgacgtttgactagccatctcaagcaactttcgacgtttgactagccatctcaagcaagtttaatcaawgatcatctcacgctgatcattggatcctactcaacaaaaggaagggtggtcagaagtacattaaagatttctgctccaaattttcaataaatttctgctt

SEQ ID NO: 1138 - DNA, 201 bp, Homo sapiens
tataactgagaggcatcctgatatgcttacaaaaatccacattggatcctcatttgagaagtacccactctatgttttaaaggtttctggaaaagaacaarcagccaaaaatgccatatggattgactgtggaatccatgccagagaatggatctctcctgctttctgcttgtggttcataggccataatcgaatgtggag

SEQ ID NO: 1139 - DNA, 117 bp, Homo sapiens
gatcatctcacgctgatcattggatcctactcaacaaaaggaagggtggtcagaagtacattaaagatttctgctccaaattttcaataaatttctgcttstgcctttagaaataca

SEQ ID NO: 1140 - DNA, 201 bp, Homo sapiens
atgccagagaatggatctctcctgctttctgcttgtggttcataggccataatcgaatgtggagaaagaaccgttctttctatgcgaacaatcattgcatyggaacagacctgaataggaactttgcttccaaacactggtgtgaggaaggtgcatccagttcctcatgctcggaaacctactgtggactttatcctgagt

SEQ ID NO: 1141 - DNA, 121 bp, Homo sapiens
caatgatcatctcacgctgatcattggatcctactcaacaaaaggaagggtggtcagaagtacattaaagatttctgctccaaattttcaataaatttctkcttgtgcctttagaaataca

SEQ ID NO: 1142 - DNA, 201 bp, Homo sapiens
cagcatatagtgtttccatattcctatacacgaagtaaaagcaaagaccatgaggaactgtctctagtagccagtgaagcagttcgtgctattgagaaaaytagtaaaaataccaggtatacacatggccatggctcagaaaccttatacctagctcctggaggtggggacgattggatctatgatttgggcatcaaatat

SEQ ID NO: 1143 - DNA, 201 bp, Homo sapiens
ttgtaaaagtctagttacctactttttctttgattttcgacgtttgactagccatctcaagcaactttcgacgtttgactagccatctcaagcaagtttavtcaatgatcatctcacgctgatcattggatcctactcaacaaaaggaagggtggtcagaagtacattaaagatttctgctccaaattttcaataaatttc

SEQ ID NO: 1144 - DNA, 201 bp, Homo sapiens
ggttcataggccatataactcaattctatgggataatagggcaatataccaatctcctgaggcttgtggatttctatgttatgccggtggttaatgtggayggttatgactactcatggaaaaagaatcgaatgtggagaaagaaccgttctttctatgcgaacaatcattgcatcggaacagacctgaataggaactttg

SEQ ID NO: 1145 - DNA, 201 bp, Homo sapiens; identical to SEQ ID NO: 1130

SEQ ID NO: 1146 - DNA, 201 bp, Homo sapiens; identical to SEQ ID NO: 1131

SEQ ID NO: 1147 - DNA, 201 bp, Homo sapiens; identical to SEQ ID NO: 1132

SEQ ID NO: 1148 - DNA, 201 bp, Homo sapiens; identical to SEQ ID NO: 1133

SEQ ID NO: 1149 - DNA, 201 bp, Homo sapiens; identical to SEQ ID NO: 1134

SEQ ID NO: 1150 - DNA, 201 bp, Homo sapiens; identical to SEQ ID NO: 1135

SEQ ID NO: 1151 - DNA, 201 bp, Homo sapiens
acgctgatcattggatcctactcaacaaaaggaagggtggtcagaagtacattaaagatttctgctccaaattttcaataaatttctgcttgtgcctttaraaatacaaccatgcattccgtttgctccacggtaattaggcgatggcccagaaaggggaggggtgtcaaaaacgacaaacatagcctctcattccagctc

SEQ ID NO: 1152 - DNA, 201 bp, Homo sapiens
tataactgagaggcatcctgatatgcttacaaaaatccacattggatcctcatttgagaagtacccactctatgttttaaaggtttctggaaaagaacaarcagccaaaaatgccatatggattgactgtggaatccatgccagagaatggatctctcctgctttctgcttgtggttcataggccatataactcaattcta

SEQ ID NO: 1153 - DNA, 201 bp, Homo sapiens
gatcatctcacgctgatcattggatcctactcaacaaaaggaagggtggtcagaagtacattaaagatttctgctccaaattttcaataaatttctgcttstgcctttagaaatacaaccatgcattccgtttgctccacggtaattaggcgatggcccagaaaggggaggggtgtcaaaaacgacaaacatagcctctca

SEQ ID NO: 1154 - DNA, 201 bp, Homo sapiens
caatgatcatctcacgctgatcattggatcctactcaacaaaaggaagggtggtcagaagtacattaaagatttctgctccaaattttcaataaatttctkcttgtgcctttagaaatacaaccatgcattccgtttgctccacggtaattaggcgatggcccagaaaggggaggggtgtcaaaaacgacaaacatagcct

SEQ ID NO: 1155 - DNA, 201 bp, Homo sapiens; identical to SEQ ID NO: 1137

SEQ ID NO: 1156 - DNA, 201 bp, Homo sapiens
ctgctttctgcttgtggttcataggccatataactcaattctatgggataatagggcaatataccaatctcctgaggcttgtggatttctatgttatgccrgtggttaatgtggatggttatgactactcatggaaaaagaatcgaatgtggagaaagaaccgttctttctatgcgaacaatcattgcatcggaacagacc

SEQ ID NO: 1157 - DNA, 201 bp, Homo sapiens
atgttatgccggtggttaatgtggatggttatgactactcatggaaaaagaatcgaatgtggagaaagaaccgttctttctatgcgaacaatcattgcatyggaacagacctgaataggaactttgcttccaaacactggtgtgaggaaggtgcatccagttcctcatgctcggaaacctactgtggactttatcctgagt

SEQ ID NO: 1158 - DNA, 201 bp, Homo sapiens; identical to SEQ ID NO: 1142

SEQ ID NO: 1159 - DNA, 201 bp, Homo sapiens; identical to SEQ ID NO: 1143

SEQ ID NO: 1160 - DNA, 201 bp, Homo sapiens
caggtagtttggggcaaaaatccgaggtgcttgggagttttgaatgttaagaattgaccatctgcttttattaaatttgttgacaaaattttctcattttyttttcacttcgggctgtgtaaacacagtcaaaataattctaaatccctcgatatttttaaagatctgtaagtaacttcacattaaaaaatgaaatatttt

SEQ ID NO: 1161 - DNA, 201 bp, Homo sapiens
atatttttaaagatctgtaagtaacttcacattaaaaaatgaaatattttttaatttaaagcttactctgtccatttatccacaggaaagtgttatttttmaaggaaggttcatgtagagaaaagcacacttgtaggataagtgaaatggatactacatctttaaacagtatttcattgcctgtgtatggaaaaaccattt

SEQ ID NO: 1162 - DNA, 201 bp, Homo sapiens
agtgttatttttcaaggaaggttcatgtagagaaaagcacacttgtaggataagtgaaatggatactacatctttaaacagtatttcattgcctgtgtatkgaaaaaccatttgaagtgtacctgtgtacataactctgtaaaaacactgaaaaattatactaacttatttatgttaaaagattttttttaatctagacaa

SEQ ID NO: 1163 - DNA, 201 bp, Homo sapiens
gttcggttttgtttttttgagagtgcgagagaggcggtcgtgcagacccgggagaaagatgtcaaacgtgcgagtgtctaacgggagccctagcctggagyggatggacgccaggcaggcggagcaccccaagccctcggcctgcaggaacctcttcggcccggtggaccacgaagagttaacccgggacttggagaagca

SEQ ID NO: 1164 - DNA, 201 bp, Homo sapiens
tggcaagaggtggagaagggcagcttgcccgagttctactacagacccccgcggccccccaaaggtgcctgcaaggtgccggcgcaggagagccaggatgkcagcgggagccgcccggcggcgcctttaattggggctccggctaactctgaggacacgcatttggtggacccaaagactgatccgtcggacagccagacg

SEQ ID NO: 1165 - DNA, 201 bp, Homo sapiens
cgcagcccctgcgcgctcctagagctcgggccgtggctcgtcggggtctgtgtcttttggctccgagggcagtcgctgggcttccgagaggggttcgggcygcgtaggggcgctttgttttgttcggttttgtttttttgagagtgcgagagaggcggtcgtgcagacccgggagaaagatgtcaaacgtgcgagtgtcta

SEQ ID NO: 1166 - DNA, 201 bp, Homo sapiens
accttttatgtagcacataaactttggggaagggagggcagggtggggctgaggaactgacgtggagcggggtatgaagagcttgctttgatttacagcargtagataaatatttgacttgcatgaagagaagcaattttggggaagggtttgaattgttttctttaaagatgtaatgtccctttcagagacagctgatac

SEQ ID NO: 1167 - DNA, 201 bp, Homo sapiens; identical to SEQ ID NO: 1160

SEQ ID NO: 1168 - DNA, 201 bp, Homo sapiens; identical to SEQ ID NO: 1161

SEQ ID NO: 1169 - DNA, 201 bp, Homo sapiens; identical to SEQ ID NO: 1162

SEQ ID NO: 1170 - DNA, 201 bp, Homo sapiens; identical to SEQ ID NO: 1166

SEQ ID NO: 1171 - DNA, 201 bp, Homo sapiens
agccagctgtgggggagcccgctgaggtcacgaccacggtgctggtgaggagagatcaccatggagccaatttctcgtgccgcactgaactggacctgcgsccccaagggctggagctgtttgagaacacctcggccccctaccagctccagacctttgtcctgccagcgactcccccacaacttgtcagcccccgggtcc

SEQ ID NO: 1172 - DNA, 201 bp, Homo sapiens
agaacacctcggccccctaccagctccagacctttgtcctgccagcgactcccccacaacttgtcagcccccgggtcctagaggtggacacgcaggggacmgtggtctgttccctggacgggctgttcccagtctcggaggcccaggtccacctggcactgggggaccagaggttgaaccccacagtcacctatggcaacg

SEQ ID NO: 1173 - DNA, 201 bp, Homo sapiens
gccagctgtgggggagcccgctgaggtcacgaccacggtgctggtgaggagagatcaccatggagccaatttctcgtgccgcactgaactggacctgcggscccaagggctggagctgtttgagaacacctcggccccctaccagctccagacctttgtcctgccagcgactcccccacaacttgtcagcccccgggtcct

SEQ ID NO: 1174 - DNA, 154 bp, Homo sapiens
gtgatcctcccacctcagcctcctgagtagctgggaccataggctcacaacaccacacctggcaaatttgatttttttttttttttcagagacggggtctygcaacattgcccagacttcctttgtgttagttaataaagctttctcaactgcc

SEQ ID NO: 1175 - DNA, 201 bp, Homo sapiens
ccagctccagacctttgtcctgccagcgactcccccacaacttgtcagcccccgggtcctagaggtggacacgcaggggaccgtggtctgttccctggacrggctgttcccagtctcggaggcccaggtccacctggcactgggggaccagaggttgaaccccacagtcacctatggcaacgactccttctcggccaaggc

SEQ ID NO: 1176 - DNA, 154 bp, Homo sapiens
gcgccccagtcgacgctgagctcctctgctactcagagttgcaacctcagcctmgctatggctcccagcagcccccggcccgcgctgcccgcactcctggtcctgctcggggctctgttcccaggacctggcaatgcccagacatctgtgtccc

SEQ ID NO: 1177 - DNA, 201 bp, Homo sapiens
aagccagaggtctcagaagggaccgaggtgacagtgaagtgtgaggcccaccctagagccaaggtgacgctgaatggggttccagcccagccactgggccygagggcccagctcctgctgaaggccaccccagaggacaacgggcgcagcttctcctgctctgcaaccctggaggtggccggccagcttatacacaagaac

SEQ ID NO: 1178 - DNA, 201 bp, Homo sapiens
cactttcccactgcccatcggggaatcagtgactgtcactcgagatcttgagggcacctacctctgtcgggccaggagcactcaaggggaggtcacccgcraggtgaccgtgaatgtgctctccccccggtatgagattgtcatcatcactgtggtagcagccgcagtcataatgggcactgcaggcctcagcacgtacct

SEQ ID NO: 1179 - DNA, 201 bp, Homo sapiens
tatgtatttattcatttgttattttaccagctatttattgagtgtcttttatgtaggctaaatgaacataggtctctggcctcacggagctcccagtcctratcacattcaaggtcaccaggtacagttgtacaggttgtacactgcaggagagtgcctggcaaaaagatcaaatggggctgggacttctcattggccaac

SEQ ID NO: 1180 - DNA, 168 bp, Homo sapiens
ccttttgggctcaagtgatcctcccacctcagcctcctgagtagctgggaccataggctcacaacaccacacctggcaaatttgatttttttttttttttyagagacggggtctcgcaacattgcccagacttcctttgtgttagttaataaagctttctcaactgcc

SEQ ID NO: 1181 - DNA, 201 bp, Homo sapiens
gacaacgggcgcagcttctcctgctctgcaaccctggaggtggccggccagcttatacacaagaaccagacccgggagcttcgtgtcctgtatggcccccractggacgagagggattgtccgggaaactggacgtggccagaaaattcccagcagactccaatgtgccaggcttgggggaacccattgcccgagctcaag

SEQ ID NO: 1182 - DNA, 201 bp, Homo sapiens
ggacgagggcacccagcggctgacgtgtgcagtaatactggggaaccagagccaggagacactgcagacagtgaccatctacagctttccggcgcccaacrtgattctgacgaagccagaggtctcagaagggaccgaggtgacagtgaagtgtgaggcccaccctagagccaaggtgacgctgaatggggttccagccca

SEQ ID NO: 1183 - DNA, 201 bp, Homo sapiens
taaccgccagcggaagatcaagaaatacagactacaacaggcccaaaaagggacccccatgaaaccgaacacacaagccacgcctccctgaacctatcccrggacagggcctcttcctcggccttcccatattggtggcagtggtgccacactgaacagagtggaagacatatgccatgcagctacacctaccggccctgg

SEQ ID NO: 1184 - DNA, 201 bp, Homo sapiens
tgcagctccagtttcctgcagtgatcagggtcctgcaagcagtggggaagggggccaaggtattggaggactccctcccagctttggaagcctcatccgcktgtgtgtgtgtgtgtatgtgtagacaagctctcgctctgtcacccaggctggagtgcagtggtgcaatcatggttcactgcagtcttgaccttttgggct

SEQ ID NO: 1185 - DNA, 201 bp, Homo sapiens
agctccagacctttgtcctgccagcgactcccccacaacttgtcagcccccgggtcctagaggtggacacgcaggggaccgtggtctgttccctggacggkctgttcccagtctcggaggcccaggtccacctggcactgggggaccagaggttgaaccccacagtcacctatggcaacgactccttctcggccaaggcct

SEQ ID NO: 1186 - DNA, 201 bp, Homo sapiens
cctcttggcagccagtgggcaagaaccttaccctacgctgccaggtggagggtggggcaccccgggccaacctcaccgtggtgctgctccgtggggagaasgagctgaaacgggagccagctgtgggggagcccgctgaggtcacgaccacggtgctggtgaggagagatcaccatggagccaatttctcgtgccgcactg

SEQ ID NO: 1187 - DNA, 201 bp, Homo sapiens
cgagggcccagctcctgctgaaggccaccccagaggacaacgggcgcagcttctcctgctctgcaaccctggaggtggccggccagcttatacacaagaaycagacccgggagcttcgtgtcctgtatggcccccgactggacgagagggattgtccgggaaactggacgtggccagaaaattcccagcagactccaatgt

SEQ ID NO: 1188 - DNA, 201 bp, Homo sapiens
caggttgtacactgcaggagagtgcctggcaaaaagatcaaatggggctgggacttctcattggccaacctgcctttccccagaaggagtgatttttctaycggcacaaaagcactatatggactggtaatggttacaggttcagagattacccagtgaggccttattcctcccttccccccaaaactgacacctttgtta

SEQ ID NO: 1189 - DNA, 201 bp, Homo sapiens
cgcgtgtgtgtgtgtgtgtatgtgtagacaagctctcgctctgtcacccaggctggagtgcagtggtgcaatcatggttcactgcagtcttgaccttttgrgctcaagtgatcctcccacctcagcctcctgagtagctgggaccataggctcacaacaccacacctggcaaatttgatttttttttttttttcagagacg

SEQ ID NO: 1190 - DNA, 201 bp, Homo sapiens
tctctggcctcacggagctcccagtcctaatcacattcaaggtcaccaggtacagttgtacaggttgtacactgcaggagagtgcctggcaaaaagatcaratggggctgggacttctcattggccaacctgcctttccccagaaggagtgatttttctatcggcacaaaagcactatatggactggtaatggttacaggt

SEQ ID NO: 1191 - DNA, 169 bp, Homo sapiens
accttttgggctcaagtgatcctcccacctcagcctcctgagtagctgggaccataggctcacaacaccacacctggcaaatttgattttttttttttttycagagacggggtctcgcaacattgcccagacttcctttgtgttagttaataaagctttctcaactgcc

SEQ ID NO: 1192 - DNA, 162 bp, Homo sapiens
gggctcaagtgatcctcccacctcagcctcctgagtagctgggaccataggctcacaacaccacacctggcaaatttgatttttttttttttttcagagayggggtctcgcaacattgcccagacttcctttgtgttagttaataaagctttctcaactgcc

SEQ ID NO: 1193 - DNA, 201 bp, Homo sapiens
cctatcccgggacagggcctcttcctcggccttcccatattggtggcagtggtgccacactgaacagagtggaagacatatgccatgcagctacacctacyggccctgggacgccggaggacagggcattgtcctcagtcagatacaacagcatttggggccatggtacctgcacacctaaaacactaggccacgcatctg

SEQ ID NO: 1194 - DNA, 149 bp, Homo sapiens
gcgccccagtcgacgctgagctcctctgctactcagagttgcaacctcmgcctcgctatggctcccagcagcccccggcccgcgctgcccgcactcctggtcctgctcggggctctgttcccaggacctggcaatgcccagacatctgt

SEQ ID NO: 1195 - DNA, 201 bp, Homo sapiens
gcaagcagtggggaagggggccaaggtattggaggactccctcccagctttggaagcctcatccgcgtgtgtgtgtgtgtgtatgtgtagacaagctctckctctgtcacccaggctggagtgcagtggtgcaatcatggttcactgcagtcttgaccttttgggctcaagtgatcctcccacctcagcctcctgagtagc

SEQ ID NO: 1196 - DNA, 201 bp, Homo sapiens
ggacctggcaatgcccagacatctgtgtccccctcaaaagtcatcctgccccggggaggctccgtgctggtgacatgcagcacctcctgtgaccagcccawgttgttgggcatagagaccccgttgcctaaaaaggagttgctcctgcctgggaacaaccggaaggtgtatgaactgagcaatgtgcaagaagatagccaa

SEQ ID NO: 1197 - DNA, 201 bp, Homo sapiens
aggtccacctggcactgggggaccagaggttgaaccccacagtcacctatggcaacgactccttctcggccaaggcctcagtcagtgtgaccgcagaggaygagggcacccagcggctgacgtgtgcagtaatactggggaaccagagccaggagacactgcagacagtgaccatctacagctttccggcgcccaacgtga

SEQ ID NO: 1198 - DNA, 201 bp, Homo sapiens
tagcctgatgagaggggaagtggtgggggagacatagccccaccatgaggacatacaactgggaaatactgaaacttgctgcctattgggtatgctgaggycccacagacttacagaagaagtggccctccatagacatgtgtagcatcaaaacacaaaggcccacacttcctgacggatgccagcttgggcactgctgtc

SEQ ID NO: 1199 - DNA, 154 bp, Homo sapiens; identical to SEQ ID NO: 1174

SEQ ID NO: 1200 - DNA, 201 bp, Homo sapiens
cactttcccactgcccatcggggaatcagtgactgtcactcgagatcttgagggcacctacctctgtcgggccaggagcactcaaggggaggtcacccgcragccccccggtatgagattgtcatcatcactgtggtagcagccgcagtcataatgggcactgcaggcctcagcacgtacctctataaccgccagcggaag

SEQ ID NO: 1201 - DNA, 201 bp, Homo sapiens; identical to SEQ ID NO: 1179

SEQ ID NO: 1202 - DNA, 168 bp, Homo sapiens; identical to SEQ ID NO: 1180

SEQ ID NO: 1203 - DNA, 123 bp, Homo sapiens
cgtgtttttccagatggcccccractggacgagagggattgtccgggaaactggacgtggccagaaaattcccagcagactccaatgtgccaggcttgggggaacccattgcccgagctcaag

SEQ ID NO: 1204 - DNA, 102 bp, Homo sapiens
crtgtttttccagatggcccccgactggacgagagggattgtccgggaaactggacgtggccagaaaattcccagcagactccaatgtgccaggcttggggg

SEQ ID NO: 1205 - DNA, 201 bp, Homo sapiens; identical to SEQ ID NO: 1183

SEQ ID NO: 1206 - DNA, 201 bp, Homo sapiens; identical to SEQ ID NO: 1184

SEQ ID NO: 1207 - DNA, 201 bp, Homo sapiens; identical to SEQ ID NO: 1189

SEQ ID NO: 1208 - DNA, 201 bp, Homo sapiens; identical to SEQ ID NO: 1188

SEQ ID NO: 1209 - DNA, 162 bp, Homo sapiens; identical to SEQ ID NO: 1192

SEQ ID NO: 1210 - DNA, 169 bp, Homo sapiens; identical to SEQ ID NO: 1191

SEQ ID NO: 1211 - DNA, 201 bp, Homo sapiens; identical to SEQ ID NO: 1190

SEQ ID NO: 1212 - DNA, 201 bp, Homo sapiens; identical to SEQ ID NO: 1193

SEQ ID NO: 1213 - DNA, 201 bp, Homo sapiens; identical to SEQ ID NO: 1195

SEQ ID NO: 1214 - DNA, 201 bp, Homo sapiens; identical to SEQ ID NO: 1198

SEQ ID NO: 1215 - DNA, 201 bp, Homo sapiens
atgtcccgcatgtccctgtcctccttcagcgtgaaccgccccttcctcttcttcatcttcgaggacaccacaggccttcccctcttcgtgggcagcgtgargaaccccaaccccagtgcaccgcgggagctcaaggaacagcaggattccccgggcaacaaggacttcctccagagcctgaaaggcttcccccgcggagac

SEQ ID NO: 1216 - DNA, 201 bp, Homo sapiens
agtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtgctcagaaccacacgttgcagagg

SEQ ID NO: 1217 - DNA, 201 bp, Homo sapiens
agcccttgggctggcagctaactagcgggccgaaccaggagcaggtgtccccacttaccctcctcaagttgggcaaccaggagcctggtggccagactgcyctgaagagtcccccaggagtctgcagcagagaccccaccccagagcagacccacaggctggcccgggccatgatggccttcactgccgacctgttctccc

SEQ ID NO: 1218 - DNA, 201 bp, Homo sapiens
gattacccccagtttggcagccccaagtgaggggccgtggctgtggcatccagagtccctgcctggaccagcctctccactcatgtgactctttccaacckgctttgtggcactggggcaggggccgggggcagtctgagagaggccattctttcccaacacctcttggggagtttagggtgggggggggcgcggctggga

SEQ ID NO: 1219 - DNA, 201 bp, Homo sapiens
tgggctgggccagctggagcctgggcagagagtgaggagcacccaagtggggccagaggaacgttgtgtgtggcagcaaggagcccgcagaggaacatggygctgctctgggggctcctggtgctcagctggtcctgcctgcaaggcccctgctccgtgttctcccctgtgagcgccatggagcccttgggctggcagcta

SEQ ID NO: 1220 - DNA, 201 bp, Homo sapiens
tgtgactctttccaaccggctttgtggcactggggcaggggccgggggcagtctgagagaggccattctttcccaacacctcttggggagtttagggtggsggggggcgcggctgggaggagggcaggcatcggggagccgggagcctgaccctcatctttcttccaaacaggctcagagggtgtcctgcaccggggcctg

SEQ ID NO: 1221 - DNA, 201 bp, Homo sapiens
cgtgcagcatcagtccaccctggagctcagcgaggtcggcgtggaggcggcggcggccaccagcattgccatgtcccgcatgtccctgtcctccttcagcrtgaaccgccccttcctcttcttcatcttcgaggacaccacaggccttcccctcttcgtgggcagcgtgaggaaccccaaccccagtgcaccgcgggagct

SEQ ID NO: 1222 - DNA, 201 bp, Homo sapiens
gaacatggcgctgctctgggggctcctggtgctcagctggtcctgcctgcaaggcccctgctccgtgttctcccctgtgagcgccatggagcccttgggcyggcagctaactagcgggccgaaccaggagcaggtgtccccacttaccctcctcaagttgggcaaccaggagcctggtggccagactgccctgaagagtcc

SEQ ID NO: 1223 - DNA, 201 bp, Homo sapiens; identical to SEQ ID NO: 1215

SEQ ID NO: 1224 - DNA, 201 bp, Homo sapiens; identical to SEQ ID NO: 1216

SEQ ID NO: 1225 - DNA, 201 bp, Homo sapiens; identical to SEQ ID NO: 1217

SEQ ID NO: 1226 - DNA, 201 bp, Homo sapiens
gctgctcggcctgctccttgggtaggagaggaggagggagctgcctccctggctgaggggtctgggatttattcaggaggcctgtcactccccagcctctyctgggacttgaaaaactggagcctgttcttggcaagaagattctaatgcccaggaacatggcgctgctctgggggctcctggtgctcagctggtcctgcc

SEQ ID NO: 1227 - DNA, 201 bp, Homo sapiens; identical to SEQ ID NO: 1218

SEQ ID NO: 1228 - DNA, 201 bp, Homo sapiens
tgggatttattcaggaggcctgtcactccccagcctcttctgggacttgaaaaactggagcctgttcttggcaagaagattctaatgcccaggaacatggygctgctctgggggctcctggtgctcagctggtcctgcctgcaaggcccctgctccgtgttctcccctgtgagcgccatggagcccttgggctggcagcta

SEQ ID NO: 1229 - DNA, 201 bp, Homo sapiens; identical to SEQ ID NO: 1220

SEQ ID NO: 1230 - DNA, 201 bp, Homo sapiens; identical to SEQ ID NO: 1221

SEQ ID NO: 1231 - DNA, 201 bp, Homo sapiens; identical to SEQ ID NO: 1222

SEQ ID NO: 1232 - DNA, 201 bp, Homo sapiens; identical to SEQ ID NO: 1215

SEQ ID NO: 1233 - DNA, 201 bp, Homo sapiens; identical to SEQ ID NO: 1216

SEQ ID NO: 1234 - DNA, 201 bp, Homo sapiens
aaaaagacggtcttattttggtcctcaccatgcatgtgagaagagtgagggacttgtgccaccgttttacaagctttctgtccctgccacaggaacatggygctgctctgggggctcctggtgctcagctggtcctgcctgcaaggcccctgctccgtgttctcccctgtgagcgccatggagcccttgggctgcagctaa

SEQ ID NO: 1235 - DNA, 201 bp, Homo sapiens
gagcccttgggctgcagctaactagcgggccgaaccaggagcaggtgtccccacttaccctcctcaagttgggcaaccaggagcctggtggccagactgcyctgaagagtcccccaggagtctgcagcagagaccccaccccagagcagacccacaggctggcccgggccatgatggccttcactgccgacctgttctccc

SEQ ID NO: 1236 - DNA, 201 bp, Homo sapiens; identical to SEQ ID NO: 1218

SEQ ID NO: 1237 - DNA, 201 bp, Homo sapiens; identical to SEQ ID NO: 1221

SEQ ID NO: 1238 - DNA, 201 bp, Homo sapiens; identical to SEQ ID NO: 1220

SEQ ID NO: 1239 - DNA, 201 bp, Homo sapiens
gaacatggcgctgctctgggggctcctggtgctcagctggtcctgcctgcaaggcccctgctccgtgttctcccctgtgagcgccatggagcccttgggcygcagctaactagcgggccgaaccaggagcaggtgtccccacttaccctcctcaagttgggcaaccaggagcctggtggccagactgccctgaagagtccc

SEQ ID NO: 1240 - DNA, 201 bp, Homo sapiens
ctccgtctcaaaaaataaacaacaaaaaatcccaaaaagacggtcttattttggtcctcaccatgcatgtgagaagagtgagggacttgtgccaccgtttkacaagctttctgtccctgccacaggaacatggcgctgctctgggggctcctggtgctcagctggtcctgcctgcaaggcccctgctccgtgttctcccct

SEQ ID NO: 1241 - DNA, 201 bp, Homo sapiens; identical to SEQ ID NO: 1215

SEQ ID NO: 1242 - DNA, 201 bp, Homo sapiens; identical to SEQ ID NO: 1216

SEQ ID NO: 1243 - DNA, 201 bp, Homo sapiens; identical to SEQ ID NO: 1217

SEQ ID NO: 1244 - DNA, 201 bp, Homo sapiens; identical to SEQ ID NO: 1218

SEQ ID NO: 1245 - DNA, 109 bp, Homo sapiens
gaacatggygctgctctgggggctcctggtgctcagctggtcctgcctgcaaggcccctgctccgtgttctcccctgtgagcgccatggagcccttgggctggcagcta

SEQ ID NO: 1246 - DNA, 201 bp, Homo sapiens; identical to SEQ ID NO: 1220

SEQ ID NO: 1247 - DNA, 201 bp, Homo sapiens; identical to SEQ ID NO: 1221

SEQ ID NO: 1248 - DNA, 201 bp, Homo sapiens; identical to SEQ ID NO: 1222

SEQ ID NO: 1249 - DNA, 201 bp, Homo sapiens
gtttgggagaagaactggcaattagggagtttgtggagcttctaattacacaccagcccctctgccaggagctggtgcccgccagccgggggcaggctgcygggagtacccagctccagctggagacagtcagtgcctgaggatttgggggaagcaggtggggaaaccttggcacagggctgacaccttcctctgtgccag

SEQ ID NO: 1250 - DNA, 201 bp, Homo sapiens
ggacttgtgccaccgttttacaaggcacaggggctgtgacaaggccttcaacacagaacctggagctgaccccttgacctccctgacccctgatctgtccytgcaggagcctggtggccagactgccctgaagagtcccccaggagtctgcagcagagaccccaccccagagcagacccacaggctggcccgggccatgat

SEQ ID NO: 1251 - DNA, 201 bp, Homo sapiens
agtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtttctggaggaacaagtttgacccg

SEQ ID NO: 1252 - DNA, 201 bp, Homo sapiens
acaggggctgtgacaaggccttcaacacagaacctggagctgaccccttgacctccctgacccctgatctgtccctgcaggagcctggtggccagactgcyctgaagagtcccccaggagtctgcagcagagaccccaccccagagcagacccacaggctggcccgggccatgatggccttcactgccgacctgttctccc

SEQ ID NO: 1253 - DNA, 139 bp, Homo sapiens
atgcatgtgagaagagtgagggacttgtgccaccgtttkacaaggcacaggggctgtgacaaggccttcaacacagaacctggagctgaccccttgacctccctgacccctgatctgtccctgcaggagcctggtggcc

SEQ ID NO: 1254 - DNA, 201 bp, Homo sapiens
ctggaccctgattacccccgaaatatctctgacggcttcgatggcatcccggacaacgtggatgcagccttggccctccctgcccatagctacagtggccrggagcgggtctacttcttcaaggggaaacagtactgggagtaccagttccagcaccagcccagtcaggaggagtgtgaaggcagctccctgtcggctgtg

SEQ ID NO: 1255 - DNA, 201 bp, Homo sapiens
tgtccatgaacaggtggggggcccctccctgacctctgacctccaggcccagtccaaagggaatcctgagcagacacctgttctgaaacctgaggaagagkcccctgcgcctgaggtgggcgcctctaagcctgaggggatagactcaaggcctgagacccttcatccagggagacctcagcccccagcagaggaggagct

SEQ ID NO: 1256 - DNA, 201 bp, Homo sapiens
ctgggcattttgtctggtccagttcatgtaatctcccaacaccccatgaagcaaggctttgttaatcctattttactgaaaatgaactaagactcagagasataaagctgttgcccaatgagccttctttctgccctccagatccacggtgctaattccccttccgatgacctaatgattctgagcttggcaaaggtctta

SEQ ID NO: 1257 - DNA, 201 bp, Homo sapiens
cccatgaagcaaggctttgttaatcctattttactgaaaatgaactaagactcagagagataaagctgttgcccaatgagccttctttctgccctccagayccacggtgctaattccccttccgatgacctaatgattctgagcttggcaaaggtcttatctcccagctcgcccaggcccagtgttccaggaatgtgacct

SEQ ID NO: 1258 - DNA, 201 bp, Homo sapiens
acaactatgatgactacaggatggactggcttgtgcctgccacctgtgaacccatccagagtgtcttcttcttctctggagacaagtactaccgagtcaaycttcgcacacggcgagtggacactgtggaccctccctacccacgctccatcgctcagtactggctgggctgcccagctcctggccatctgtaggagtcag

SEQ ID NO: 1259 - DNA, 201 bp, Homo sapiens
aagaaacaaaggtttaggcatcgcaaccgcaaaggctaccgttcacaacgaggccacagccgtggccgcaaccagaactcccgccggccatcccgcgccaygtggctgtccttgttctccagtgaggagagcaacttgggagccaacaactatgatgactacaggatggactggcttgtgcctgccacctgtgaacccatc

SEQ ID NO: 1260 - DNA, 201 bp, Homo sapiens
caggcatggcaccccgcccctccttggccaagaaacaaaggtttaggcatcgcaaccgcaaaggctaccgttcacaacgaggccacagccgtggccgcaaycagaactcccgccggccatcccgcgccatgtggctgtccttgttctccagtgaggagagcaacttgggagccaacaactatgatgactacaggatggact

SEQ ID NO: 1261 - DNA, 201 bp, Homo sapiens
actcaaggcctgagacccttcatccagggagacctcagcccccagcagaggaggagctgtgcagtgggaagcccttcgacgccttcaccgacctcaagaayggttccctctttgccttccgagggcagtactgctatgaactggacgaaaaggcagtgaggcctgggtaccccaagctcatccgagatgtctggggcatcg

SEQ ID NO: 1262 - DNA, 201 bp, Homo sapiens
gctacagtggccgggagcgggtctacttcttcaaggggaaacagtactgggagtaccagttccagcaccagcccagtcaggaggagtgtgaaggcagctcyctgtcggctgtgtttgaacactttgccatgatgcagcgggacagctgggaggacatcttcgagcttctcttctggggcagaacctctgctggtaccagac

SEQ ID NO: 1263 - DNA, 201 bp, Homo sapiens
gcccaatgagccttctttctgccctccagatccacggtgctaattccccttccgatgacctaatgattctgagcttggcaaaggtcttatctcccagctckcccaggcccagtgttccaggaatgtgacctttgctgcagcagccgctggagggggcagaggggatgggctggaggttgagcaaacagagcagcagaaaag

SEQ ID NO: 1264 - DNA, 133 bp, Homo sapiens
tcagtactggctgggctgcccagctcctggccatctgtaggagtcagagcccacatggccgggccctctgtagctccctcctcccatctccttcccccagyccaataaaggtcccttagccccgagtttaaaa

SEQ ID NO: 1265 - DNA, 201 bp, Homo sapiens
cacatatgacagattctttttgggcgtcaatgttgttattggttttgtgggatggatatcttatgcctctttgttgatcatcaagtctcattccaaccttwtaaaaggtgttagtaaagaagtgaagaaaccaagccatctcctgccttgtagttttgtagctattggcattttagtagcattttttctgctgattcaagc

SEQ ID NO: 1266 - DNA, 201 bp, Homo sapiens
ggcttaggaataccctcccggctatcgcttcagtgggtagaggggaccactgcccgagagctttaatggagctgggtcctgccttcgcgctgaggagcccycgttttcgagatcaggcctgaccgggataagctccagagattcaccaacaatagcaaattacacactggcttggaaagtactcccatgttccgtttgatc

SEQ ID NO: 1267 - DNA, 201 bp, Homo sapiens
gatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccag

SEQ ID NO: 1268 - DNA, 201 bp, Homo sapiens
tgggtgcaggcttgctggttcttctgttatccctgtgtgttgtaacatctctcatgaaaagaaaagatagctttataaaggaagagctattggtacatctrttacaggtgctgagcacagtgctctccatgtatgttgtgtatagcactcagagtagtctactcaggaagcaaggactgcctctcatgaatcaaattatta

SEQ ID NO: 1269 - DNA, 201 bp, Homo sapiens
aagaaaagatagctttataaaggaagagctattggtacatctgttacaggtgctgagcacagtgctctccatgtatgttgtgtatagcactcagagtagtytactcaggaagcaaggactgcctctcatgaatcaaattattagctgggcaacattagcctcttccttggttgtgccactactgagttctccagttctctt

SEQ ID NO: 1270 - DNA, 201 bp, Homo sapiens
tcaagtctcattccaaccttataaaaggtgttagtaaagaagtgaagaaaccaagccatctcctgccttgtagttttgtagctattggcattttagtagcrttttttctgctgattcaagcctgtccctggacatattatgtatatggtttgttgccactgccaatatggtatgcggttctaagagaatttcaagttattc

SEQ ID NO: 1271 - DNA, 201 bp, Homo sapiens
tgtcatatttctttagtatgcaataatgctatcttatcctttttagtgctatttctcaggttttctcagtcaaccagctagatgcatgtgatgcatgtctrtccttcactttttttttttcatttctggattttcctgggatttctgacaacacaaaagtagaaagtgcttggtatttctgtcttatacataggaaaacat

SEQ ID NO: 1272 - DNA, 201 bp, Homo sapiens
aatggagctgggtcctgccttcgcgctgaggagccctcgttttcgagatcaggcctgaccgggataagctccagagattcaccaacaatagcaaattacasactggcttggaaagtactcccatgttccgtttgatcttggcaatttaatgctgttcttgaagactaattagttacactggatatgctgctgttctttact

SEQ ID NO: 1273 - DNA, 201 bp, Homo sapiens
tgaaagtaaatacacatggagctggggaagcccagatatcctgcctatgtttgccaaaggtgctagtggagaccacgtttatacatatagttatgatgctraaagagaggattttggtgctcaagatgcaacaaaactggatacgtgggtttttgataatgttaaggacttctttcatcatgccagaaacaaccagtcttt

SEQ ID NO: 1274 - DNA, 201 bp, Homo sapiens
tggctttgcattttttcttcttggtcaaggattatggcagctggcttgatattgggacaagcatcagccactatgtgattgtcatgtccatgaccatcttkttggtgttcctcaatggcctggcccagctgctcacaacgaagaaactcagactatgtggcaaacccaaaagtcacttcatgtgaggttgctgaagcacca

SEQ ID NO: 1275 - DNA, 201 bp, Homo sapiens
ttgcttatacattttgtgttcttcgcctccatctttgacatttattttacatctcctttggttcatggaatgactcctcagtttacaccattgcctcctcyagcgagaagattagtgttgtttgttgctgatggccttcgagcagatgcactttacgaattagatgaaaatggaaactctagagcaccgtttattaggaat

SEQ ID NO: 1276 - DNA, 201 bp, Homo sapiens
ttaccctgggaattgaagtattagttctcagttttttctaccgctatatgcttaccgctggacttactgcctttgcagcttggccatttctcactcggctrtggactcgagcaaagatgacctcactgagttggactttcttctctttgctcctggcagtgttcccactgatgccggttgtaggtcgaaagccagacatct

SEQ ID NO: 1277 - DNA, 201 bp, Homo sapiens
cgagatcaggcctgaccgggataagctccagagattcaccaacaatagcaaattacacactggcttggaaagtactcccatgttccgtttgatcttggcartttaatgctgttcttgaagactaattagttacactggatatgctgctgttctttactttgggattgcttatacattttgtgttcttcgcctccatctttg

SEQ ID NO: 1278 - DNA, 201 bp, Homo sapiens
tgccttcgcgctgaggagccctcgttttcgagatcaggcctgaccgggataagctccagagattcaccaacaatagcaaattacacactggcttggaaagyactcccatgttccgtttgatcttggcaatttaatgctgttcttgaagactaattagttacactggatatgctgctgttctttactttgggattgcttata

SEQ ID NO: 1279 - DNA, 201 bp, Homo sapiens
gttttctaaaataaatgaagagaaaatagtttttttcttacatttattaggaatagatacaaacggacatgctcatcgaccatcctcgagagactacaagsacaatattaaaaaagttgatgatggagttaaagaaatcgtgtctatgtttaaccacttctatggaaatgatgggaaaacaacatttatctttacctctga

SEQ ID NO: 1280 - DNA, 201 bp, Homo sapiens
atacaaacggacatgctcatcgaccatcctcgagagactacaagcacaatattaaaaaagttgatgatggagttaaagaaatcgtgtctatgtttaaccayttctatggaaatgatgggaaaacaacatttatctttacctctgaccatggaatgacagactggggttcccatggggctggtcatccttcagagactttaa

SEQ ID NO: 1281 - DNA, 201 bp, Homo sapiens
gaaaagatagctttataaaggaagagctattggtacatctgttacaggtgctgagcacagtgctctccatgtatgttgtgtatagcactcagagtagtctrctcaggaagcaaggactgcctctcatgaatcaaattattagctgggcaacattagcctcttccttggttgtgccactactgagttctccagttctctttc

SEQ ID NO: 1282 - DNA, 201 bp, Homo sapiens
ctttaccatttttgtttacaccatttaaactgctttctgattccaaacagttcaacattttaagaaaagcaagatcttatataaaacacagaaagtttgaygaagtggtctccctttgcaaggagctaattcatcttgcattgaaaggattgtcctattatcacacatatgacagattctttttgggcgtcaatgttgtta

SEQ ID NO: 1283 - DNA, 201 bp, Homo sapiens
tggatacgtgggtttttgataatgttaaggacttctttcatcatgccagaaacaaccagtctttgttttctaaaataaatgaagagaaaatagtttttttyttacatttattaggaatagatacaaacggacatgctcatcgaccatcctcgagagactacaagcacaatattaaaaaagttgatgatggagttaaagaaa

SEQ ID NO: 1284 - DNA, 201 bp, Homo sapiens
taactcctttagtcacttggggagctggaatcaagtatccccaaagagtatcagctcagcaatttgatgatgcatttttgaaagagtggagattggagaaytggaagaggctagatgtcaatcaggctgatattgcaccattgatgacttcccttattggagttccctttcctcttaactcagtgggaatccttcctgtgg

SEQ ID NO: 1285 - DNA, 122 bp, Homo sapiens
agcagcagcggccgggcaggtrttgggggcgttccggaattgaggggtggttgtagtggtggcttaggaataccctcccggctatcgcttcagtgggtagaggggaccactgcccgagagct

SEQ ID NO: 1286 - DNA, 201 bp, Homo sapiens; identical to SEQ ID NO: 1265

SEQ ID NO: 1287 - DNA, 201 bp, Homo sapiens
ggcttaggaataccctcccggctatcgcttcagtgggtagaggggaccactgcccgagagctttaatggagctgggtcctgccttcgcgctgaggagcccycgttttcgagatcaggcctgaccgggataagctccagaaacagtattatgtctcagtcctgtgcaaagtgagatgagctgtagcctttggagacctataa

SEQ ID NO: 1288 - DNA, 201 bp, Homo sapiens; identical to SEQ ID NO: 1267

SEQ ID NO: 1289 - DNA, 201 bp, Homo sapiens; identical to SEQ ID NO: 1268

SEQ ID NO: 1290 - DNA, 201 bp, Homo sapiens; identical to SEQ ID NO: 1269

SEQ ID NO: 1291 - DNA, 201 bp, Homo sapiens; identical to SEQ ID NO: 1270

SEQ ID NO: 1292 - DNA, 201 bp, Homo sapiens
gagacctataattttgaacatagatgttccttaaaagctaaatctttttgaacagatgatgataaacctggaagagattcaccaacaatagcaaattacasactggcttggaaagtactcccatgttccgtttgatcttggcaatttaatgctgttcttgaagactaattagttacactggatatgctgctgttctttact

SEQ ID NO: 1293 - DNA, 201 bp, Homo sapiens; identical to SEQ ID NO: 1271

SEQ ID NO: 1294 - DNA, 201 bp, Homo sapiens; identical to SEQ ID NO: 1273

SEQ ID NO: 1295 - DNA, 201 bp, Homo sapiens; identical to SEQ ID NO: 1274

SEQ ID NO: 1296 - DNA, 201 bp, Homo sapiens; identical to SEQ ID NO: 1275

SEQ ID NO: 1297 - DNA, 201 bp, Homo sapiens; identical to SEQ ID NO: 1276

SEQ ID NO: 1298 - DNA, 201 bp, Homo sapiens
ctttttgaacagatgatgataaacctggaagagattcaccaacaatagcaaattacacactggcttggaaagtactcccatgttccgtttgatcttggcartttaatgctgttcttgaagactaattagttacactggatatgctgctgttctttactttgggattgcttatacattttgtgttcttcgcctccatctttg

SEQ ID NO: 1299 - DNA, 201 bp, Homo sapiens
gaacatagatgttccttaaaagctaaatctttttgaacagatgatgataaacctggaagagattcaccaacaatagcaaattacacactggcttggaaagyactcccatgttccgtttgatcttggcaatttaatgctgttcttgaagactaattagttacactggatatgctgctgttctttactttgggattgcttata

SEQ ID NO: 1300 - DNA, 201 bp, Homo sapiens; identical to SEQ ID NO: 1279

SEQ ID NO: 1301 - DNA, 201 bp, Homo sapiens; identical to SEQ ID NO: 1280

SEQ ID NO: 1302 - DNA, 201 bp, Homo sapiens; identical to SEQ ID NO: 1281

SEQ ID NO: 1303 - DNA, 201 bp, Homo sapiens; identical to SEQ ID NO: 1282

SEQ ID NO: 1304 - DNA, 201 bp, Homo sapiens; identical to SEQ ID NO: 1283

SEQ ID NO: 1305 - DNA, 201 bp, Homo sapiens; identical to SEQ ID NO: 1284

SEQ ID NO: 1306 - DNA, 201 bp, Homo sapiens; identical to SEQ ID NO: 1265

SEQ ID NO: 1307 - DNA, 201 bp, Homo sapiens; identical to SEQ ID NO: 1266

SEQ ID NO: 1308 - DNA, 201 bp, Homo sapiens; identical to SEQ ID NO: 1267

SEQ ID NO: 1309 - DNA, 201 bp, Homo sapiens; identical to SEQ ID NO: 1268

SEQ ID NO: 1310 - DNA, 201 bp, Homo sapiens; identical to SEQ ID NO: 1269

SEQ ID NO: 1311 - DNA, 201 bp, Homo sapiens; identical to SEQ ID NO: 1270

SEQ ID NO: 1312 - DNA, 152 bp, Homo sapiens
cagggtgtattatttcaagagcttcaataaaaaaagtcctttttagtgctatttctcaggttttctcagtcaaccagctagatgcatgtgatgcatgtctrtccttcactttttttttttcatttctggattttcctgggatttctgacaac

SEQ ID NO: 1313 - DNA, 201 bp, Homo sapiens; identical to SEQ ID NO: 1272

SEQ ID NO: 1314 - DNA, 201 bp, Homo sapiens; identical to SEQ ID NO: 1273

SEQ ID NO: 1315 - DNA, 201 bp, Homo sapiens; identical to SEQ ID NO: 1274

SEQ ID NO: 1316 - DNA, 201 bp, Homo sapiens; identical to SEQ ID NO: 1275

SEQ ID NO: 1317 - DNA, 201 bp, Homo sapiens; identical to SEQ ID NO: 1276

SEQ ID NO: 1318 - DNA, 201 bp, Homo sapiens; identical to SEQ ID NO: 1277

SEQ ID NO: 1319 - DNA, 201 bp, Homo sapiens; identical to SEQ ID NO: 1278

SEQ ID NO: 1320 - DNA, 201 bp, Homo sapiens; identical to SEQ ID NO: 1279

SEQ ID NO: 1321 - DNA, 201 bp, Homo sapiens; identical to SEQ ID NO: 1280

SEQ ID NO: 1322 - DNA, 201 bp, Homo sapiens; identical to SEQ ID NO: 1281

SEQ ID NO: 1323 - DNA, 201 bp, Homo sapiens; identical to SEQ ID NO: 1282

SEQ ID NO: 1324 - DNA, 201 bp, Homo sapiens; identical to SEQ ID NO: 1283

SEQ ID NO: 1325 - DNA, 201 bp, Homo sapiens; identical to SEQ ID NO: 1284

SEQ ID NO: 1326 - DNA, 201 bp, Homo sapiens; identical to SEQ ID NO: 1274

SEQ ID NO: 1327 - DNA, 201 bp, Homo sapiens; identical to SEQ ID NO: 1273

SEQ ID NO: 1328 - DNA, 122 bp, Homo sapiens; identical to SEQ ID NO: 1285

SEQ ID NO: 1329 - DNA, 201 bp, Homo sapiens; identical to SEQ ID NO: 1265

SEQ ID NO: 1330 - DNA, 201 bp, Homo sapiens; identical to SEQ ID NO: 1275

SEQ ID NO: 1331 - DNA, 201 bp, Homo sapiens; identical to SEQ ID NO: 1287

SEQ ID NO: 1332 - DNA, 201 bp, Homo sapiens; identical to SEQ ID NO: 1276

SEQ ID NO: 1333 - DNA, 201 bp, Homo sapiens; identical to SEQ ID NO: 1267

SEQ ID NO: 1334 - DNA, 201 bp, Homo sapiens; identical to SEQ ID NO: 1268

SEQ ID NO: 1335 - DNA, 201 bp, Homo sapiens; identical to SEQ ID NO: 1279

SEQ ID NO: 1336 - DNA, 201 bp, Homo sapiens; identical to SEQ ID NO: 1269

SEQ ID NO: 1337 - DNA, 201 bp, Homo sapiens; identical to SEQ ID NO: 1280

SEQ ID NO: 1338 - DNA, 201 bp, Homo sapiens; identical to SEQ ID NO: 1281

SEQ ID NO: 1339 - DNA, 201 bp, Homo sapiens; identical to SEQ ID NO: 1282

SEQ ID NO: 1340 - DNA, 201 bp, Homo sapiens; identical to SEQ ID NO: 1283

SEQ ID NO: 1341 - DNA, 201 bp, Homo sapiens; identical to SEQ ID NO: 1284

SEQ ID NO: 1342 - DNA, 201 bp, Homo sapiens; identical to SEQ ID NO: 1270

SEQ ID NO: 1343 - DNA, 201 bp, Homo sapiens; identical to SEQ ID NO: 1271

SEQ ID NO: 1344 - DNA, 201 bp, Homo sapiens
ccgggccagagagagaaccacacgattcagaaaagcagtgcccttcagcagcctctccaccgtctgggctccccaaaggcagagcgggacgctggaaatgwgtgcgcgctgtggtatgggtgtgcaagtgtgcgaaggcggcgtgttgtgtgagcgagagggtagcggatgtgtgtgtgcgtgtgcgcgcgtggctccggg

SEQ ID NO: 1345 - DNA, 201 bp, Homo sapiens
tcctagcttgggaagcttccgcttagaggtcctggcgcctcggcacagctgccacgggctctcctgggcttatggccggtcacagcctcagtgtgactccrcagtggcccctgtagccgggcaagcaggagcaggtctctctgcatctgttctctgaggaactcaagtttggttgccagaaaaatgtgcttcattcccccc

SEQ ID NO: 1346 - DNA, 201 bp, Homo sapiens
cttaaaaatatatgaatacatgcgcaatacacagctacagacacacattctgttgacaagggaaaaccttcaaagcatgtttctttccctcaccacaacakaacatgcagtactaaagcaatatatttgtgattccccatgtaattcttcaatgttaaacagtgcagtcctctttcgaaagctaagatgaccatgcgccct

SEQ ID NO: 1347 - DNA, 201 bp, Homo sapiens
gttgtgtgagcgagagggtagcggatgtgtgtgtgcgtgtgcgcgcgtggctccgggtgtgcgccgctgcgatagcgggtcctttcccggggcgggcgackggcgggctgggaaggtctcctcccctcaccacattgagaaatctcagtgagtcaccgagtggttctgcatattaatgagctcgctcgctgcgagggcagg

SEQ ID NO: 1348 - DNA, 201 bp, Homo sapiens
aaggcggcgtgttgtgtgagcgagagggtagcggatgtgtgtgtgcgtgtgcgcgcgtggctccgggtgtgcgccgctgcgatagcgggtcctttcccggrgcgggcgacgggcgggctgggaaggtctcctcccctcaccacattgagaaatctcagtgagtcaccgagtggttctgcatattaatgagctcgctcgctg

SEQ ID NO: 1349 - DNA, 188 bp, Homo sapiens
ggcccagcaggggcccttgggggtcaggcctgcaggcactcacacttggcacctgctccaaaaccctttcaggtctttgaggatctgrgccctgggcctgggtctcccgccggctcggaaaagctggcctgccgggccagagagagaaccacacgattcagaaaagcagtgcccttcagcagcctctc

SEQ ID NO: 1350 - DNA, 201 bp, Homo sapiens
aaaaaatgcttttttgtatttgtccatacgtcactatacatctgagctttataagcgcccgggaggaacaatgagcttggtggacacatttcattgcagtrttgctccattcctagcttgggaagcttccgcttagaggtcctggcgcctcggcacagctgccacgggctctcctgggcttatggccggtcacagcctcag

SEQ ID NO: 1351 - DNA, 201 bp, Homo sapiens
ccaggtaccgaggtcaggagcactgcctgcaccccaagctgcagagcaccaagcgcttcatcaagtggtacaacgcctggaacgagaagcgcagggtctaygaagaatagggtgaaaaacctcagaagggaaaactccaaaccagttgggagacttgtgcaaaggactttgcagattaaaaaaaaaaaaaaaaaaaagcct

SEQ ID NO: 1352 - DNA, 201 bp, Homo sapiens; identical to SEQ ID NO: 1344

SEQ ID NO: 1353 - DNA, 201 bp, Homo sapiens; identical to SEQ ID NO: 1345

SEQ ID NO: 1354 - DNA, 201 bp, Homo sapiens; identical to SEQ ID NO: 1347

SEQ ID NO: 1355 - DNA, 201 bp, Homo sapiens; identical to SEQ ID NO: 1346

SEQ ID NO: 1356 - DNA, 201 bp, Homo sapiens; identical to SEQ ID NO: 1348

SEQ ID NO: 1357 - DNA, 188 bp, Homo sapiens; identical to SEQ ID NO: 1349

SEQ ID NO: 1358 - DNA, 201 bp, Homo sapiens; identical to SEQ ID NO: 1350

SEQ ID NO: 1359 - DNA, 201 bp, Homo sapiens
ccaggtaccgaggtcaggagcactgcctgcaccccaagctgcagagcaccaagcgcttcatcaagtggtacaacgcctggaacgagaagcgcagggtctaygaagaatagggtgaaaaacctcagaagggaaaactccaaaccagttgggagacttgtgcaaaggactttgcagattaaaaaaaaaaaaaaaaaaaatgaa

SEQ ID NO: 1360 - DNA, 201 bp, Homo sapiens
ggaagctgccacctcagtatgccctggagctcctgacggtctatgcttgggagcgagggagcatgaaaacacatttcaacacagcccagggatttcggacrgtcttggaattagtcataaactaccagcaactctgcatctactggacaaagtattatgactttaaaaaccccattattgaaaagtacctgagaaggcagc

SEQ ID NO: 1361 - DNA, 201 bp, Homo sapiens
tgcctgcctttgatgccctgggtcagttgactggcggctataaacctaacccccaaatctatgtcaagctcatcgaggagtgcaccgacctgcagaaagasggcgagttctccacctgcttcacagaactacagagagacttcctgaagcagcgccccaccaagctcaagagcctcatccgcctagtcaagcactggtacc

SEQ ID NO: 1362 - DNA, 201 bp, Homo sapiens
ggagagttcatccaggaaattaggagacagctggaagcctgtcaaagagagagagcattttccgtgaagtttgaggtccaggctccacgctggggcaaccsccgtgcgctcagcttcgtactgagttcgctccagctcggggagggggtggagttcgatgtgctgcctgcctttgatgccctgggtcagttgactggcggc

SEQ ID NO: 1363 - DNA, 201 bp, Homo sapiens
ggagttcgatgtgctgcctgcctttgatgccctgggtcagttgactggcggctataaacctaacccccaaatctatgtcaagctcatcgaggagtgcacckacctgcagaaagagggcgagttctccacctgcttcacagaactacagagagacttcctgaagcagcgccccaccaagctcaagagcctcatccgcctagt

SEQ ID NO: 1364 - DNA, 201 bp, Homo sapiens
tctcctgtcaatgatggatctcagaaataccccagccaaatctctggacaagttcattgaagactatctcttgccagacacgtgtttccgcatgcaaatcraccatgccattgacatcatctgtgggttcctgaaggaaaggtgcttccgaggtagctcctaccctgtgtgtgtgtccaaggtggtaaagggtggctcctc

SEQ ID NO: 1365 - DNA, 201 bp, Homo sapiens
tgtgatcctggacccggcggaccctacaggaaacttgggtggtggagacccaaagggttggaggcagctggcacaagaggctgaggcctggctgaattacycatgctttaagaattgggatgggtccccagtgagctcctggattctgctgaaagcaacagtacagacgatgagaccgacgatcccaggacgtatcagaaa

SEQ ID NO: 1366 - DNA, 149 bp, Homo sapiens
gtacagacgatgagaccgacgatcccaggacgtatcagaaatatggttacattggaacacatgagtaccctcatttctctcatagacccagcacactccargcagcatccaccccacaggcagaagaggactggacctgcaccatcctc

SEQ ID NO: 1367 - DNA, 201 bp, Homo sapiens
cctcagtcctctcaccacttttcaggatcagttaaatcgccggggagagttcatccaggaaattaggagacagctggaagcctgtcaaagagagagagcaytttccgtgaagtttgaggtccaggctccacgctggggcaacccccgtgcgctcagcttcgtactgagttcgctccagctcggggagggggtggagttcga

SEQ ID NO: 1368 - DNA, 201 bp, Homo sapiens
gctgaattacccatgctttaagaattgggatgggtccccagtgagctcctggattctgctgaaagcaacagtacagacgatgagaccgacgatcccaggasgtatcagaaatatggttacattggaacacatgagtaccctcatttctctcatagacccagcacactccaggcagcatccaccccacaggcagaagaggac

SEQ ID NO: 1369 - DNA, 201 bp, Homo sapiens
acacatttcaacacagcccagggatttcggacggtcttggaattagtcataaactaccagcaactctgcatctactggacaaagtattatgactttaaaamccccattattgaaaagtacctgagaaggcagctcacgaaacccaggcctgtgatcctggacccggcggaccctacaggaaacttgggtggtggagaccca

SEQ ID NO: 1370 - DNA, 201 bp, Homo sapiens
ggcagctggcacaagaggctgaggcctggctgaattacccatgctttaagaattgggatgggtccccagtgagctcctggattctgctgaaagcaacagtrcagacgatgagaccgacgatcccaggacgtatcagaaatatggttacattggaacacatgagtaccctcatttctctcatagacccagcacactccaggc

SEQ ID NO: 1371 - DNA, 201 bp, Homo sapiens
cccaaagggttggaggcagctggcacaagaggctgaggcctggctgaattacccatgctttaagaattgggatgggtccccagtgagctcctggattctgrtgaaagcaacagtacagacgatgagaccgacgatcccaggacgtatcagaaatatggttacattggaacacatgagtaccctcatttctctcatagaccc

SEQ ID NO: 1372 - DNA, 201 bp, Homo sapiens
cccccgtgcgctcagcttcgtactgagttcgctccagctcggggagggggtggagttcgatgtgctgcctgcctttgatgccctgggtcagttgactggcrgctataaacctaacccccaaatctatgtcaagctcatcgaggagtgcaccgacctgcagaaagagggcgagttctccacctgcttcacagaactacagag

SEQ ID NO: 1373 - DNA, 201 bp, Homo sapiens
tcgccggggagagttcatccaggaaattaggagacagctggaagcctgtcaaagagagagagcattttccgtgaagtttgaggtccaggctccacgctggsgcaacccccgtgcgctcagcttcgtactgagttcgctccagctcggggagggggtggagttcgatgtgctgcctgcctttgatgccctgggtcagttgac

SEQ ID NO: 1374 - DNA, 201 bp, Homo sapiens
cagaggccgatctgacgctgacctggttgtcttcctcagtcctctcaccacttttcaggatcagttaaatcgccggggagagttcatccaggaaattaggrgacagctggaagcctgtcaaagagagagagcattttccgtgaagtttgaggtccaggctccacgctggggcaacccccgtgcgctcagcttcgtactgag

SEQ ID NO: 1375 - DNA, 201 bp, Homo sapiens; identical to SEQ ID NO: 1360

SEQ ID NO: 1376 - DNA, 201 bp, Homo sapiens; identical to SEQ ID NO: 1361

SEQ ID NO: 1377 - DNA, 201 bp, Homo sapiens; identical to SEQ ID NO: 1362

SEQ ID NO: 1378 - DNA, 201 bp, Homo sapiens; identical to SEQ ID NO: 1363

SEQ ID NO: 1379 - DNA, 201 bp, Homo sapiens; identical to SEQ ID NO: 1364

SEQ ID NO: 1380 - DNA, 201 bp, Homo sapiens
tgtgatcctggacccggcggaccctacaggaaacttgggtggtggagacccaaagggttggaggcagctggcacaagaggctgaggcctggctgaattacycatgctttaagaattgggatgggtccccagtgagctcctggattctgctgacccagcacactccaggcagcatccaccccacaggcagaagaggactgga

SEQ ID NO: 1381 - DNA, 201 bp, Homo sapiens
gctggcacaagaggctgaggcctggctgaattacccatgctttaagaattgggatgggtccccagtgagctcctggattctgctgacccagcacactccargcagcatccaccccacaggcagaagaggactggacctgcaccatcctctgaatgccagtgcatcttgggggaaagggctccagtgttatctggaccagtt

SEQ ID NO: 1382 - DNA, 201 bp, Homo sapiens; identical to SEQ ID NO: 1367

SEQ ID NO: 1383 - DNA, 201 bp, Homo sapiens; identical to SEQ ID NO: 1369

SEQ ID NO: 1384 - DNA, 201 bp, Homo sapiens; identical to SEQ ID NO: 1372

SEQ ID NO: 1385 - DNA, 154 bp, Homo sapiens
cctgcaccatcctctgaatgccagtgcatcttgggggaaagggctccagtgttatctggaccagttccttcattttcaggtgggactcttgatccagagargacaaagctcctcagtgagctggtgtataatccaggacagaacccaggtctcc

SEQ ID NO: 1386 - DNA, 201 bp, Homo sapiens; identical to SEQ ID NO: 1373

SEQ ID NO: 1387 - DNA, 201 bp, Homo sapiens; identical to SEQ ID NO: 1374

SEQ ID NO: 1388 - DNA, 201 bp, Homo sapiens; identical to SEQ ID NO: 1360

SEQ ID NO: 1389 - DNA, 201 bp, Homo sapiens; identical to SEQ ID NO: 1361

SEQ ID NO: 1390 - DNA, 201 bp, Homo sapiens; identical to SEQ ID NO: 1362

SEQ ID NO: 1391 - DNA, 195 bp, Homo sapiens
tattttacagtcattttggtcacaatcgagggtttctggaattttcacatcccttgtccagaattcattcccctaagagtaataataaataatctctaacmccatttattgactgtctgcttcgggctcaggttctgtcctaagccctttaatatgcactctctcattaaatagtcacaacaatcccatgaggca

SEQ ID NO: 1392 - DNA, 201 bp, Homo sapiens; identical to SEQ ID NO: 1363

SEQ ID NO: 1393 - DNA, 201 bp, Homo sapiens; identical to SEQ ID NO: 1364

SEQ ID NO: 1394 - DNA, 201 bp, Homo sapiens
tgtgatcctggacccggcggaccctacaggaaacttgggtggtggagacccaaagggttggaggcagctggcacaagaggctgaggcctggctgaattacycatgctttaagaattgggatgggtccccagtgagctcctggattctgctggtgagacctcctgcttcctccctgccattcatccctgcccctctccatga

SEQ ID NO: 1395 - DNA, 201 bp, Homo sapiens; identical to SEQ ID NO: 1367

SEQ ID NO: 1396 - DNA, 201 bp, Homo sapiens; identical to SEQ ID NO: 1369

SEQ ID NO: 1397 - DNA, 201 bp, Homo sapiens; identical to SEQ ID NO: 1372

SEQ ID NO: 1398 - DNA, 201 bp, Homo sapiens; identical to SEQ ID NO: 1373

SEQ ID NO: 1399 - DNA, 201 bp, Homo sapiens; identical to SEQ ID NO: 1374

SEQ ID NO: 1400 - DNA, 201 bp, Homo sapiens; identical to SEQ ID NO: 1360

SEQ ID NO: 1401 - DNA, 201 bp, Homo sapiens; identical to SEQ ID NO: 1361

SEQ ID NO: 1402 - DNA, 201 bp, Homo sapiens; identical to SEQ ID NO: 1362

SEQ ID NO: 1403 - DNA, 201 bp, Homo sapiens; identical to SEQ ID NO: 1363

SEQ ID NO: 1404 - DNA, 201 bp, Homo sapiens; identical to SEQ ID NO: 1364

SEQ ID NO: 1405 - DNA, 201 bp, Homo sapiens
tgtgatcctggacccggcggaccctacaggaaacttgggtggtggagacccaaagggttggaggcagctggcacaagaggctgaggcctggctgaattacycatgctttaagaattgggatgggtccccagtgagctcctggattctgctgctgaaagcaacagtacagacgatgagaccgacgatcccaggacgtatcag

SEQ ID NO: 1406 - DNA, 201 bp, Homo sapiens
gtacagacgatgagaccgacgatcccaggacgtatcagaaatatggttacattggaacacatgagtaccctcatttctctcatagacccagcacactccargcagcatccaccccacaggcagaagaggactggacctgcaccatcctctgaatgccagtgcatcttgggggaaagggctccagtgttatctggaccagtt

SEQ ID NO: 1407 - DNA, 201 bp, Homo sapiens; identical to SEQ ID NO: 1369

SEQ ID NO: 1408 - DNA, 201 bp, Homo sapiens; identical to SEQ ID NO: 1367

SEQ ID NO: 1409 - DNA, 201 bp, Homo sapiens
gaattacccatgctttaagaattgggatgggtccccagtgagctcctggattctgctgctgaaagcaacagtacagacgatgagaccgacgatcccaggasgtatcagaaatatggttacattggaacacatgagtaccctcatttctctcatagacccagcacactccaggcagcatccaccccacaggcagaagaggac

SEQ ID NO: 1410 - DNA, 201 bp, Homo sapiens
agctggcacaagaggctgaggcctggctgaattacccatgctttaagaattgggatgggtccccagtgagctcctggattctgctgctgaaagcaacagtrcagacgatgagaccgacgatcccaggacgtatcagaaatatggttacattggaacacatgagtaccctcatttctctcatagacccagcacactccaggc

SEQ ID NO: 1411 - DNA, 201 bp, Homo sapiens
aaagggttggaggcagctggcacaagaggctgaggcctggctgaattacccatgctttaagaattgggatgggtccccagtgagctcctggattctgctgrtgaaagcaacagtacagacgatgagaccgacgatcccaggacgtatcagaaatatggttacattggaacacatgagtaccctcatttctctcatagaccc

SEQ ID NO: 1412 - DNA, 201 bp, Homo sapiens; identical to SEQ ID NO: 1372

SEQ ID NO: 1413 - DNA, 201 bp, Homo sapiens
cctgcaccatcctctgaatgccagtgcatcttgggggaaagggctccagtgttatctggaccagttccttcattttcaggtgggactcttgatccagagargacaaagctcctcagtgagctggtgtataatccaggacagaacccaggtctcctgactcctggccttctatgccctctatcctatcatagataacattct

SEQ ID NO: 1414 - DNA, 201 bp, Homo sapiens; identical to SEQ ID NO: 1373

SEQ ID NO: 1415 - DNA, 201 bp, Homo sapiens; identical to SEQ ID NO: 1374

SEQ ID NO: 1416 - DNA, 201 bp, Homo sapiens; identical to SEQ ID NO: 1360

SEQ ID NO: 1417 - DNA, 201 bp, Homo sapiens; identical to SEQ ID NO: 1361

SEQ ID NO: 1418 - DNA, 201 bp, Homo sapiens; identical to SEQ ID NO: 1362

SEQ ID NO: 1419 - DNA, 201 bp, Homo sapiens; identical to SEQ ID NO: 1363

SEQ ID NO: 1420 - DNA, 201 bp, Homo sapiens; identical to SEQ ID NO: 1405

SEQ ID NO: 1421 - DNA, 201 bp, Homo sapiens; identical to SEQ ID NO: 1406

SEQ ID NO: 1422 - DNA, 201 bp, Homo sapiens
tctcctgtcaatgatggatctcagaaataccccagccaaatctctggacaagttcattgaagactatctcttgccagacacgtgtttccgcatgcaaatcraccatgccattgacatcatctgtgggttcctgaaggaaaggtgcttccgaggtagctcctaccctgtgtgtgtgtccaaggtggtaaagtcctctcacca

SEQ ID NO: 1423 - DNA, 201 bp, Homo sapiens; identical to SEQ ID NO: 1369

SEQ ID NO: 1424 - DNA, 201 bp, Homo sapiens; identical to SEQ ID NO: 1409

SEQ ID NO: 1425 - DNA, 201 bp, Homo sapiens
gtaaagtcctctcaccacttttcaggatcagttaaatcgccggggagagttcatccaggaaattaggagacagctggaagcctgtcaaagagagagagcaytttccgtgaagtttgaggtccaggctccacgctggggcaacccccgtgcgctcagcttcgtactgagttcgctccagctcggggagggggtggagttcga

SEQ ID NO: 1426 - DNA, 201 bp, Homo sapiens; identical to SEQ ID NO: 1410

SEQ ID NO: 1427 - DNA, 201 bp, Homo sapiens; identical to SEQ ID NO: 1411

SEQ ID NO: 1428 - DNA, 201 bp, Homo sapiens; identical to SEQ ID NO: 1372

SEQ ID NO: 1429 - DNA, 201 bp, Homo sapiens; identical to SEQ ID NO: 1413

SEQ ID NO: 1430 - DNA, 201 bp, Homo sapiens; identical to SEQ ID NO: 1373

SEQ ID NO: 1431 - DNA, 201 bp, Homo sapiens
ggtagctcctaccctgtgtgtgtgtccaaggtggtaaagtcctctcaccacttttcaggatcagttaaatcgccggggagagttcatccaggaaattaggrgacagctggaagcctgtcaaagagagagagcattttccgtgaagtttgaggtccaggctccacgctggggcaacccccgtgcgctcagcttcgtactgag

SEQ ID NO: 1432 - DNA, 201 bp, Homo sapiens
actttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccag

SEQ ID NO: 1433 - DNA, 201 bp, Homo sapiens
aagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatg

SEQ ID NO: 1434 - DNA, 201 bp, Homo sapiens
cgtctgctgtgactgggatcaccaccagcatcgtggagcactcatacacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatcc

SEQ ID NO: 1435 - DNA, 201 bp, Homo sapiens
agaaacgctttactgaagaggccaccaaatacttccgggagagagtcagcccagtgcatctgcaaatcctgctgactaacaatgaagcctggaagagattygtgactgcggctgaattgcccagggatgaggcagatgctctctacgaagctctgaagaagcttagaacatatgcagctattgaggacgaatatgtgcagc

SEQ ID NO: 1436 - DNA, 201 bp, Homo sapiens
ttacagcagggacgagtctggcccttactgcagctggggtagggctgggagcagcgtctgctgtgactgggatcaccaccagcatcgtggagcactcatayacatcatcagcagaagctgaagccagcaggctgactgcaaccagcattgaccgattgaaggtatttaaggaagttatgcgtgacatcacacccaacttac

SEQ ID NO: 1437 - DNA, 201 bp, Homo sapiens
tggcatcatgtcccttgctggtcttgttttggcaccatttacagcagggacgagtctggcccttactgcagctggggtagggctgggagcagcgtctgctrtgactgggatcaccaccagcatcgtggagcactcatacacatcatcagcagaagctgaagccagcaggctgactgcaaccagcattgaccgattgaaggt

SEQ ID NO: 1438 - DNA, 201 bp, Homo sapiens
aaataccagctggctggggcccaggagattaaaaaacaccgggctagggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccag

SEQ ID NO: 1439 - DNA, 201 bp, Homo sapiens
ggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacacagctcagaacagctggatcttgctcacactctttcaagagaagct

SEQ ID NO: 1440 - DNA, 201 bp, Homo sapiens
tgtgactttcactttcccttttgggttccagggtatatctcagagactggagaacgtgtctggttattatgcagatgcacggctggaggtgggatccacayagctcagaacagctggatcttgctcacactctttcaagagaagcttccttggacaaaaggaccctgccttggtgtgagagtgagggcagagggagctgga

SEQ ID NO: 1441 - DNA, 201 bp, Homo sapiens
agtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcag

SEQ ID NO: 1442 - DNA, 201 bp, Homo sapiens; identical to SEQ ID NO: 1432

SEQ ID NO: 1443 - DNA, 201 bp, Homo sapiens; identical to SEQ ID NO: 1433

SEQ ID NO: 1444 - DNA, 201 bp, Homo sapiens; identical to SEQ ID NO: 1434

SEQ ID NO: 1445 - DNA, 201 bp, Homo sapiens; identical to SEQ ID NO: 1435

SEQ ID NO: 1446 - DNA, 201 bp, Homo sapiens; identical to SEQ ID NO: 1436

SEQ ID NO: 1447 - DNA, 201 bp, Homo sapiens; identical to SEQ ID NO: 1437

SEQ ID NO: 1448 - DNA, 201 bp, Homo sapiens
cagaacagctggatcttgctcacactctttcaagagaagcttccttgggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccag

SEQ ID NO: 1449 - DNA, 201 bp, Homo sapiens; identical to SEQ ID NO: 1439

SEQ ID NO: 1450 - DNA, 201 bp, Homo sapiens
tgtgactttcactttcccttttgggttccagggtatatctcagagactggagaacgtgtctggttattatgcagatgcacggctggaggtgggatccacayagctcagaacagctggatcttgctcacactctttcaagagaagcttccttgggttaagaaaaaaaacgaacccttccagtcaggtcagtgactggagagc

SEQ ID NO: 1451 - DNA, 201 bp, Homo sapiens; identical to SEQ ID NO: 1441

SEQ ID NO: 1452 - DNA, 201 bp, Homo sapiens; identical to SEQ ID NO: 1432

SEQ ID NO: 1453 - DNA, 201 bp, Homo sapiens; identical to SEQ ID NO: 1433

SEQ ID NO: 1454 - DNA, 201 bp, Homo sapiens; identical to SEQ ID NO: 1434

SEQ ID NO: 1455 - DNA, 201 bp, Homo sapiens; identical to SEQ ID NO: 1435

SEQ ID NO: 1456 - DNA, 201 bp, Homo sapiens; identical to SEQ ID NO: 1436

SEQ ID NO: 1457 - DNA, 201 bp, Homo sapiens; identical to SEQ ID NO: 1439

SEQ ID NO: 1458 - DNA, 201 bp, Homo sapiens; identical to SEQ ID NO: 1437

SEQ ID NO: 1459 - DNA, 201 bp, Homo sapiens
tgtgactttcactttcccttttgggttccagggtatatctcagagactggagaacgtgtctggttattatgcagatgcacggctggaggtgggatccacayagctcagaacagctggatcttgctcacactctttcaagagaagcttccttgaaaagaaacgctttactgaagaggccaccaaatacttccgggagagagt

SEQ ID NO: 1460 - DNA, 201 bp, Homo sapiens; identical to SEQ ID NO: 1441

SEQ ID NO: 1461 - DNA, 201 bp, Homo sapiens; identical to SEQ ID NO: 1432

SEQ ID NO: 1462 - DNA, 201 bp, Homo sapiens; identical to SEQ ID NO: 1433

SEQ ID NO: 1463 - DNA, 201 bp, Homo sapiens; identical to SEQ ID NO: 1434

SEQ ID NO: 1464 - DNA, 201 bp, Homo sapiens; identical to SEQ ID NO: 1435

SEQ ID NO: 1465 - DNA, 201 bp, Homo sapiens; identical to SEQ ID NO: 1436

SEQ ID NO: 1466 - DNA, 201 bp, Homo sapiens; identical to SEQ ID NO: 1437

SEQ ID NO: 1467 - DNA, 201 bp, Homo sapiens
acaggtggctcacattcagtcccacaatttgctttctcctcctcaagggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccag

SEQ ID NO: 1468 - DNA, 201 bp, Homo sapiens; identical to SEQ ID NO: 1439

SEQ ID NO: 1469 - DNA, 201 bp, Homo sapiens; identical to SEQ ID NO: 1440

SEQ ID NO: 1470 - DNA, 201 bp, Homo sapiens; identical to SEQ ID NO: 1441

SEQ ID NO: 1471 - DNA, 109 bp, Homo sapiens
tacagcccygccgagagcgtgaactatcgctgcggaggggcagacctggaccggtggaaggccgggcggaagtgcgcgcctggggccgccttggttaccgcgttttccg

SEQ ID NO: 1472 - DNA, 156 bp, Homo sapiens
aggtggaagcttacacatctccctcagcctctggtttttcagcacttgggattggggttaaacctttaaaaacggctgtcaggtttgatctcagtgtaacracatggccagtgcctgttccccactcccttgccccaaaaggatctggaacacagg

SEQ ID NO: 1473 - DNA, 201 bp, Homo sapiens
gaacagagctggattccttgtgcctcatatgccccaatgctggtctcagtaaaacactgaggtggaagcttacacatctccctcagcctctggtttttcascacttgggattggggttaaacctttaaaaacggctgtcaggtttgatctcagtgtaacaacatggccagtgcctgttccccactcccttgccccaaaagg

SEQ ID NO: 1474 - DNA, 201 bp, Homo sapiens
cctggggccgccttggttaccgcgttttccgctcctcgctacgtcatcgttgtgagcccgctatcagcggccagcgcgggcgcggccggagaccgtggggmccccggttgccgccccctcgggagccaccatgttggtgataccccccggactgagcgaggaagaggaggctctgcagaagaaattcaacaagctcaagaa

SEQ ID NO: 1475 - DNA, 195 bp, Homo sapiens
tgcctcatatgccccaatgctggtctcagtaaaacactgaggtggaagcttacacatctccctcagcctctggtttttcagcacttgggattggggttaarcctttaaaaacggctgtcaggtttgatctcagtgtaacaacatggccagtgcctgttccccactcccttgccccaaaaggatctggaacacagg

SEQ ID NO: 1476 - DNA, 201 bp, Homo sapiens
gagcgggatcgagaccgagaccgagagggtcctttccgcaggtcggattcattccctgaacggcgagcccctaggaaagggaatactctctatgtatatgkagaagacatgacacccacccttctccgtggggccttctctccttttggaaacatcattgacctctccatggacccacccagaaactgtgccttcgtcacc

SEQ ID NO: 1477 - DNA, 201 bp, Homo sapiens
tggaccggtggaaggccgggcggaagtgcgcgcctggggccgccttggttaccgcgttttccgctcctcgctacgtcatcgttgtgagcccgctatcagcrgccagcgcgggcgcggccggagaccgtggggcccccggttgccgccccctcgggagccaccatgttggtgataccccccggactgagcgaggaagaggag

SEQ ID NO: 1478 - DNA, 201 bp, Homo sapiens
accgcagccatgagaggaaccgggacagagaccgagatcgggagcgggatcgagaccgggatcgagacagagacagagagcgggacagggatcgggatcgrgatcgagatcgagaccgggaacgggacagggatcgggagcgggatcgagaccgagaccgagagggtcctttccgcaggtcggattcattccctgaacggc

SEQ ID NO: 1479 - DNA, 183 bp, Homo sapiens
cccaatgctggtctcagtaaaacactgaggtggaagcttacacatctccctcagcctctggtttttcagcacttgggattggggttaaacctttaaaaacrgctgtcaggtttgatctcagtgtaacaacatggccagtgcctgttccccactcccttgccccaaaaggatctggaacacagg

SEQ ID NO: 1480 - DNA, 109 bp, Homo sapiens; identical to SEQ ID NO: 1471

SEQ ID NO: 1481 - DNA, 155 bp, Homo sapiens
aggtggaagcttacacatctccctcagcctctggtttttcagcacttgggattggggttaaacctttaaaaacggctgtcaggtttgatctcagtgtaacracatggccagtgcctgttccccactcccttgccccaaaaggatctggaacacag

SEQ ID NO: 1482 - DNA, 201 bp, Homo sapiens; identical to SEQ ID NO: 1473

SEQ ID NO: 1483 - DNA, 201 bp, Homo sapiens; identical to SEQ ID NO: 1474

SEQ ID NO: 1484 - DNA, 194 bp, Homo sapiens
tgcctcatatgccccaatgctggtctcagtaaaacactgaggtggaagcttacacatctccctcagcctctggtttttcagcacttgggattggggttaarcctttaaaaacggctgtcaggtttgatctcagtgtaacaacatggccagtgcctgttccccactcccttgccccaaaaggatctggaacacag

SEQ ID NO: 1485 - DNA, 201 bp, Homo sapiens; identical to SEQ ID NO: 1476

SEQ ID NO: 1486 - DNA, 201 bp, Homo sapiens; identical to SEQ ID NO: 1477

SEQ ID NO: 1487 - DNA, 201 bp, Homo sapiens; identical to SEQ ID NO: 1478

SEQ ID NO: 1488 - DNA, 182 bp, Homo sapiens
cccaatgctggtctcagtaaaacactgaggtggaagcttacacatctccctcagcctctggtttttcagcacttgggattggggttaaacctttaaaaacrgctgtcaggtttgatctcagtgtaacaacatggccagtgcctgttccccactcccttgccccaaaaggatctggaacacag

SEQ ID NO: 1489 - DNA, 109 bp, Homo sapiens; identical to SEQ ID NO: 1471

SEQ ID NO: 1490 - DNA, 155 bp, Homo sapiens; identical to SEQ ID NO: 1481

SEQ ID NO: 1491 - DNA, 201 bp, Homo sapiens; identical to SEQ ID NO: 1473

SEQ ID NO: 1492 - DNA, 201 bp, Homo sapiens; identical to SEQ ID NO: 1474

SEQ ID NO: 1493 - DNA, 194 bp, Homo sapiens; identical to SEQ ID NO: 1484

SEQ ID NO: 1494 - DNA, 201 bp, Homo sapiens; identical to SEQ ID NO: 1476

SEQ ID NO: 1495 - DNA, 201 bp, Homo sapiens; identical to SEQ ID NO: 1477

SEQ ID NO: 1496 - DNA, 182 bp, Homo sapiens; identical to SEQ ID NO: 1488

SEQ ID NO: 1497 - DNA, 201 bp, Homo sapiens
cggaaaacgcggtaaccaaggcggccccaggcgcgcacttccgcccggccttccaccggtccaggtctgcccctccgcagcgatagttcacgctctcggcrgggctgtaccggaagttgcctctacttccgcccgttccggggcggggcttacttcgcagcgactacttgccgcacttccgggctgccaggcagctgctgt

SEQ ID NO: 1498 - DNA, 201 bp, Homo sapiens
aggcggccccaggcgcgcacttccgcccggccttccaccggtccaggtctgcccctccgcagcgatagttcacgctctcggcggggctgtaccggaagttscctctacttccgcccgttccggggcggggcttacttcgcagcgactacttgccgcacttccgggctgccaggcagctgctgtggctccaggatgatggag

SEQ ID NO: 1499 - DNA, 201 bp, Homo sapiens
tccaggaactgctgcgtctggctcaggcccacccagccggacctcccaccctcgaccctgtcaatgacctgcagctcaaagatatgtcagttgtagagggygggcactgtgaagctggcagggcgggtggcttgtgccatgagcagccatgagttgctcctcactgagctcatgtttgacaatgcactgagcaccctgcgg

SEQ ID NO: 1500 - DNA, 201 bp, Homo sapiens
ttcagaaacaggccatcctgcacttggaacggcatgactctgtctttgtcgcagctcacacatctgcaggaaaaacagttgtggctgaatatgccattgcyctggcccagaaacacatgacacgcaccatctacacttcgcccatcaaggccctgagcaaccagaagttccgggacttccgaaacacattcggggatgtgg

SEQ ID NO: 1501 - DNA, 201 bp, Homo sapiens
cgcagagcaacgcaaagaggaagaacagagaaacggctatgagaaaaagggccgaagagtgagaagcagagggccttacccgagggggcggcaaccggggkccccacggtctccggccgcgcccgcgctggccgctgatagcgggctcacaacgatgacgtagcgaggagcggaaaacgcggtaaccaaggcggccccagg

SEQ ID NO: 1502 - DNA, 201 bp, Homo sapiens
ctcccctgttggtgatttctatcgcctcattccccagccagccttccagtgggcatttgagccagatgtgtttcagaaacaggccatcctgcacttggaayggcatgactctgtctttgtcgcagctcacacatctgcaggaaaaacagttgtggctgaatatgccattgccctggcccagaaacacatgacacgcaccat

SEQ ID NO: 1503 - DNA, 120 bp, Homo sapiens
cgtagcgcccgcagagcaaygcaaagaggaagaacagagaaacggctatgagaaaaagggccgaagagtgagaagcagagggccttacccgagggggcggcaaccgggggccccacggtc

SEQ ID NO: 1504 - DNA, 201 bp, Homo sapiens
acggctatgagaaaaagggccgaagagtgagaagcagagggccttacccgagggggcggcaaccgggggccccacggtctccggccgcgcccgcgctggcygctgatagcgggctcacaacgatgacgtagcgaggagcggaaaacgcggtaaccaaggcggccccaggcgcgcacttccgcccggccttccaccggtcca

SEQ ID NO: 1505 - DNA, 201 bp, Homo sapiens
gaaagatcttcttactattccacctggtttcaagaaaggcatggactttgcaccaaaagattgtccaactccagctcctggactactaagccttagctgtmtgttggagcctctggatttgggtgggggtgacgaggatgagaatgaggcagtgggacagccaggaggtcccagaggggacactgtttcagcctctccctg

SEQ ID NO: 1506 - DNA, 201 bp, Homo sapiens
gacttcagcaagaggcagcagccaaaattcaagtcagagatgctagggaggcccttctcctccagaggggcacgtagaggcagggaggggcagtggtctgsgagtttcctccagcctgagggagaccatgaagtggtggggttgtagtgagggggctcccccagcctaagggagactgtgaagtggaggttgtagtaagag

SEQ ID NO: 1507 - DNA, 201 bp, Homo sapiens
gagccccagtcccatccgacctacaggcccaaagacacccaaccacaggccagatactgggttacaaagaggtcttgctggagaacacaaatctctcggcyacaacctccttgtctcttcgccggcctccagggccagcctcccagtccttatggggaaatccaactcagtatcccttctggccaggggggatggatgaac

SEQ ID NO: 1508 - DNA, 201 bp, Homo sapiens
gaagtggtggggttgtagtgagggggctcccccagcctaagggagactgtgaagtggaggttgtagtaagagggcttccacagcctgagggaggcttctgkgggagagaagatcttaccccagatcttaagatctgctccctcttcaggaaggatcctccccttgcagccgtgaccactgctgtccaggaactgctgcgtc

SEQ ID NO: 1509 - DNA, 201 bp, Homo sapiens
accagaagttccgggacttccgaaacacattcggggatgtggggctgctcaccggggatgtacagctgcatccggaggcctcctgcctcatcatgaccacrgagatccttcgctccatgctgtacagtggctcagatgttattcgggacctggagtgggtcatctttgatgaggttcactatatcaacgatgtcgagcgtg

SEQ ID NO: 1510 - DNA, 201 bp, Homo sapiens
caacgcattgggagtgatcctacaggtctcctcgaactccaccagcagagtattcacaaccctggtcttgtgtgataagcccttgtcccaggacccacagracagggggccagccactgcagaggtgccctatccagatgacctcgtgggattcaagctgttcctgcctgaagggccttgtgaccacaccgtggtcaagct

SEQ ID NO: 1511 - DNA, 201 bp, Homo sapiens
cagggcggaggggcctggaccccacaggcaccgttatcctgctctgcaagggccgagtgcccgagatggcagacctgcaccgcatgatgatggggaagccrtcccagctgcagtcccagttccgcctcacgtacactatgatcctcaacttgctgcgagtggatgccctcagggtggaggacatgatgaagaggagcttct

SEQ ID NO: 1512 - DNA, 201 bp, Homo sapiens
ccctggggacgctggggatcagctcccaaacaccctcaagcagggaatagaacgtgtccgggctgtggccaagcggattggtgaggtccaggtggcttgtsgcctgaaccagacggtggaggaatttgtgggggagctgaattttgggctggttgaggttgtatatgagtgggcccggggcatgcccttctccgagttggc

SEQ ID NO: 1513 - DNA, 201 bp, Homo sapiens
gaggtcttgctggagaacacaaatctctcggctacaacctccttgtctcttcgccggcctccagggccagcctcccagtccttatggggaaatccaactcrgtatcccttctggccaggggggatggatgaacccaccataacagatctgaacacacgggaggaggctgaggaggagatagactttgagaaagatcttctt

SEQ ID NO: 1514 - DNA, 201 bp, Homo sapiens
ctggggacgctggggatcagctcccaaacaccctcaagcagggaatagaacgtgtccgggctgtggccaagcggattggtgaggtccaggtggcttgtggsctgaaccagacggtggaggaatttgtgggggagctgaattttgggctggttgaggttgtatatgagtgggcccggggcatgcccttctccgagttggcag

SEQ ID NO: 1515 - DNA, 201 bp, Homo sapiens
ggacccacaggacagggggccagccactgcagaggtgccctatccagatgacctcgtgggattcaagctgttcctgcctgaagggccttgtgaccacaccrtggtcaagctccagccaggagatatggctgccatcaccaccaaggtgctccgggtgaatggggagaagatcttggaggacttcagcaagaggcagcagcc

SEQ ID NO: 1516 - DNA, 201 bp, Homo sapiens
gaatgccccatgtaaaaacatgatgataaaacagcaaagcactgttgtgtgcttgagttgctggacagggatgactcagctaagaagacagcgagagaacytcttagaaatatgcttttattatctgcacacagagatatgactgcctccctctaaagcattactatttgggagagggagtcttggggggtgatgggaggt

SEQ ID NO: 1517 - DNA, 201 bp, Homo sapiens
gagatgtgtcgctcactgcggggggcagcccgcctggtaggagagcctgtgctgggtgccaagatggagacagcggctaccttgctacggcgggacatcgkatttgcggccagcctctacacccagtgaatgccccatgtaaaaacatgatgataaaacagcaaagcactgttgtgtgcttgagttgctggacagggatga

SEQ ID NO: 1518 - DNA, 201 bp, Homo sapiens
atgccccatgtaaaaacatgatgataaaacagcaaagcactgttgtgtgcttgagttgctggacagggatgactcagctaagaagacagcgagagaacctyttagaaatatgcttttattatctgcacacagagatatgactgcctccctctaaagcattactatttgggagagggagtcttggggggtgatgggaggtcc

SEQ ID NO: 1519 - DNA, 201 bp, Homo sapiens
gcggccagcctctacacccagtgaatgccccatgtaaaaacatgatgataaaacagcaaagcactgttgtgtgcttgagttgctggacagggatgactcasctaagaagacagcgagagaacctcttagaaatatgcttttattatctgcacacagagatatgactgcctccctctaaagcattactatttgggagaggga

SEQ ID NO: 1520 - DNA, 201 bp, Homo sapiens
acggggcactgggagctgctgaacttgcctggagctccagagagtagccttccccatggcctccctccttgtgccccagatctgcagcaagaagcagaacrgttgtttctgtcatccccagcctggctgcctctgcatggtgtggagcactcagcccgaaaatggcagaggaagacggatccctggtctcttttggctgtc

SEQ ID NO: 1521 - DNA, 201 bp, Homo sapiens
tgtgctgggtgccaagatggagacagcggctaccttgctacggcgggacatcgtatttgcggccagcctctacacccagtgaatgccccatgtaaaaacaygatgataaaacagcaaagcactgttgtgtgcttgagttgctggacagggatgactcagctaagaagacagcgagagaacctcttagaaatatgcttttat

SEQ ID NO: 1522 - DNA, 201 bp, Homo sapiens; identical to SEQ ID NO: 1497

SEQ ID NO: 1523 - DNA, 201 bp, Homo sapiens; identical to SEQ ID NO: 1498

SEQ ID NO: 1524 - DNA, 201 bp, Homo sapiens
gagcggctgcgcttcctactgtcggatcagtcattgctgctgcttcctgagtaccatcagcgagtagaggtgctccgaaccctgggttacgtggacgaggygggcactgtgaagctggcagggcgggtggcttgtgccatgagcagccatgagttgctcctcactgagctcatgtttgacaatgcactgagcaccctgcgg

SEQ ID NO: 1525 - DNA, 201 bp, Homo sapiens; identical to SEQ ID NO: 1500

SEQ ID NO: 1526 - DNA, 201 bp, Homo sapiens; identical to SEQ ID NO: 1501

SEQ ID NO: 1527 - DNA, 201 bp, Homo sapiens; identical to SEQ ID NO: 1502

SEQ ID NO: 1528 - DNA, 120 bp, Homo sapiens; identical to SEQ ID NO: 1503

SEQ ID NO: 1529 - DNA, 201 bp, Homo sapiens; identical to SEQ ID NO: 1504

SEQ ID NO: 1530 - DNA, 201 bp, Homo sapiens; identical to SEQ ID NO: 1505

SEQ ID NO: 1531 - DNA, 201 bp, Homo sapiens; identical to SEQ ID NO: 1506

SEQ ID NO: 1532 - DNA, 201 bp, Homo sapiens; identical to SEQ ID NO: 1507

SEQ ID NO: 1533 - DNA, 201 bp, Homo sapiens; identical to SEQ ID NO: 1508

SEQ ID NO: 1534 - DNA, 201 bp, Homo sapiens; identical to SEQ ID NO: 1509

SEQ ID NO: 1535 - DNA, 201 bp, Homo sapiens
agatggagcggctgcgcttcctactgtcggatcagtcattgctgctgcttcctgagtaccatcagcgagtagaggtgctccgaaccctgggttacgtggaygaggcgggcactgtgaagctggcagggcgggtggcttgtgccatgagcagccatgagttgctcctcactgagctcatgtttgacaatgcactgagcaccc

SEQ ID NO: 1536 - DNA, 201 bp, Homo sapiens; identical to SEQ ID NO: 1510

SEQ ID NO: 1537 - DNA, 201 bp, Homo sapiens; identical to SEQ ID NO: 1511

SEQ ID NO: 1538 - DNA, 201 bp, Homo sapiens; identical to SEQ ID NO: 1512

SEQ ID NO: 1539 - DNA, 201 bp, Homo sapiens; identical to SEQ ID NO: 1513

SEQ ID NO: 1540 - DNA, 201 bp, Homo sapiens
agaaggagatggagcggctgcgcttcctactgtcggatcagtcattgctgctgcttcctgagtaccatcagcgagtagaggtgctccgaaccctgggttaygtggacgaggcgggcactgtgaagctggcagggcgggtggcttgtgccatgagcagccatgagttgctcctcactgagctcatgtttgacaatgcactga

SEQ ID NO: 1541 - DNA, 201 bp, Homo sapiens; identical to SEQ ID NO: 1514

SEQ ID NO: 1542 - DNA, 201 bp, Homo sapiens; identical to SEQ ID NO: 1515

SEQ ID NO: 1543 - DNA, 201 bp, Homo sapiens; identical to SEQ ID NO: 1516

SEQ ID NO: 1544 - DNA, 201 bp, Homo sapiens; identical to SEQ ID NO: 1517

SEQ ID NO: 1545 - DNA, 201 bp, Homo sapiens; identical to SEQ ID NO: 1518

SEQ ID NO: 1546 - DNA, 201 bp, Homo sapiens; identical to SEQ ID NO: 1519

SEQ ID NO: 1547 - DNA, 201 bp, Homo sapiens; identical to SEQ ID NO: 1520

SEQ ID NO: 1548 - DNA, 201 bp, Homo sapiens; identical to SEQ ID NO: 1521

SEQ ID NO: 1549 - DNA, 201 bp, Homo sapiens; identical to SEQ ID NO: 1497

SEQ ID NO: 1550 - DNA, 201 bp, Homo sapiens; identical to SEQ ID NO: 1524

SEQ ID NO: 1551 - DNA, 201 bp, Homo sapiens; identical to SEQ ID NO: 1498

SEQ ID NO: 1552 - DNA, 201 bp, Homo sapiens; identical to SEQ ID NO: 1500

SEQ ID NO: 1553 - DNA, 201 bp, Homo sapiens; identical to SEQ ID NO: 1501

SEQ ID NO: 1554 - DNA, 201 bp, Homo sapiens; identical to SEQ ID NO: 1502

SEQ ID NO: 1555 - DNA, 120 bp, Homo sapiens; identical to SEQ ID NO: 1503

SEQ ID NO: 1556 - DNA, 201 bp, Homo sapiens; identical to SEQ ID NO: 1504

SEQ ID NO: 1557 - DNA, 201 bp, Homo sapiens; identical to SEQ ID NO: 1505

SEQ ID NO: 1558 - DNA, 201 bp, Homo sapiens; identical to SEQ ID NO: 1507

SEQ ID NO: 1559 - DNA, 201 bp, Homo sapiens; identical to SEQ ID NO: 1535

SEQ ID NO: 1560 - DNA, 201 bp, Homo sapiens; identical to SEQ ID NO: 1509

SEQ ID NO: 1561 - DNA, 201 bp, Homo sapiens; identical to SEQ ID NO: 1510

SEQ ID NO: 1562 - DNA, 201 bp, Homo sapiens; identical to SEQ ID NO: 1511

SEQ ID NO: 1563 - DNA, 201 bp, Homo sapiens
ccctggggacgctggggatcagctcccaaacaccctcaagcagggaatagaacgtgtccgggctgtggccaagcggattggtgaggtccaggtggcttgtsgcctgaaccagacggtggaggaatttgtgggggagctgaattttgggctggttgaggttgtatatgagtgggcccggggcatggtgagtacctgaggttt

SEQ ID NO: 1564 - DNA, 201 bp, Homo sapiens; identical to SEQ ID NO: 1513

SEQ ID NO: 1565 - DNA, 201 bp, Homo sapiens; identical to SEQ ID NO: 1540

SEQ ID NO: 1566 - DNA, 201 bp, Homo sapiens
ctggggacgctggggatcagctcccaaacaccctcaagcagggaatagaacgtgtccgggctgtggccaagcggattggtgaggtccaggtggcttgtggsctgaaccagacggtggaggaatttgtgggggagctgaattttgggctggttgaggttgtatatgagtgggcccggggcatggtgagtacctgaggtttgg

SEQ ID NO: 1567 - DNA, 201 bp, Homo sapiens; identical to SEQ ID NO: 1515

SEQ ID NO: 1568 - DNA, 201 bp, Homo sapiens; identical to SEQ ID NO: 1516

SEQ ID NO: 1569 - DNA, 201 bp, Homo sapiens; identical to SEQ ID NO: 1517

SEQ ID NO: 1570 - DNA, 201 bp, Homo sapiens; identical to SEQ ID NO: 1518

SEQ ID NO: 1571 - DNA, 201 bp, Homo sapiens; identical to SEQ ID NO: 1519

SEQ ID NO: 1572 - DNA, 201 bp, Homo sapiens; identical to SEQ ID NO: 1520

SEQ ID NO: 1573 - DNA, 201 bp, Homo sapiens; identical to SEQ ID NO: 1521

SEQ ID NO: 1574 - DNA, 201 bp, Homo sapiens; identical to SEQ ID NO: 1497

SEQ ID NO: 1575 - DNA, 201 bp, Homo sapiens; identical to SEQ ID NO: 1524

SEQ ID NO: 1576 - DNA, 201 bp, Homo sapiens; identical to SEQ ID NO: 1498

SEQ ID NO: 1577 - DNA, 201 bp, Homo sapiens; identical to SEQ ID NO: 1500

SEQ ID NO: 1578 - DNA, 201 bp, Homo sapiens; identical to SEQ ID NO: 1501

SEQ ID NO: 1579 - DNA, 201 bp, Homo sapiens; identical to SEQ ID NO: 1502

SEQ ID NO: 1580 - DNA, 120 bp, Homo sapiens; identical to SEQ ID NO: 1503

SEQ ID NO: 1581 - DNA, 201 bp, Homo sapiens; identical to SEQ ID NO: 1504

SEQ ID NO: 1582 - DNA, 201 bp, Homo sapiens; identical to SEQ ID NO: 1505

SEQ ID NO: 1583 - DNA, 201 bp, Homo sapiens; identical to SEQ ID NO: 1507

SEQ ID NO: 1584 - DNA, 201 bp, Homo sapiens; identical to SEQ ID NO: 1535

SEQ ID NO: 1585 - DNA, 201 bp, Homo sapiens; identical to SEQ ID NO: 1509

SEQ ID NO: 1586 - DNA, 201 bp, Homo sapiens; identical to SEQ ID NO: 1510

SEQ ID NO: 1587 - DNA, 201 bp, Homo sapiens; identical to SEQ ID NO: 1511

SEQ ID NO: 1588 - DNA, 201 bp, Homo sapiens; identical to SEQ ID NO: 1512

SEQ ID NO: 1589 - DNA, 201 bp, Homo sapiens; identical to SEQ ID NO: 1513

SEQ ID NO: 1590 - DNA, 201 bp, Homo sapiens; identical to SEQ ID NO: 1540

SEQ ID NO: 1591 - DNA, 201 bp, Homo sapiens; identical to SEQ ID NO: 1514

SEQ ID NO: 1592 - DNA, 201 bp, Homo sapiens; identical to SEQ ID NO: 1515

SEQ ID NO: 1593 - DNA, 201 bp, Homo sapiens; identical to SEQ ID NO: 1516

SEQ ID NO: 1594 - DNA, 201 bp, Homo sapiens; identical to SEQ ID NO: 1517

SEQ ID NO: 1595 - DNA, 201 bp, Homo sapiens; identical to SEQ ID NO: 1518

SEQ ID NO: 1596 - DNA, 201 bp, Homo sapiens; identical to SEQ ID NO: 1519

SEQ ID NO: 1597 - DNA, 201 bp, Homo sapiens; identical to SEQ ID NO: 1520

SEQ ID NO: 1598 - DNA, 201 bp, Homo sapiens; identical to SEQ ID NO: 1521

SEQ ID NO: 1599 - DNA, 201 bp, Homo sapiens
ctctgctcttctcaggggaggtagactgcacagacccccaagccccatccacacagcccccaacctgctatgtggagctcaagacctccaaggagatgcahagccctggccaatggaggagtttctacagacacaagctcctgaaatggtgggctcagtcattcctcccaggggtcccgaatgttgttgctggcttccgta

SEQ ID NO: 1600 - DNA, 201 bp, Homo sapiens
ccacagaccctgccctctactctgggccctttcctttctaccggcgcccttcggaactgggctgcttctccctggatgctcaacgccagtaccatggagawgcccgagccctgcgctactatagcccaccccccactaacggtccaggccccaactttgacctcagagacggatacccggatcgataccagccccgggacg

SEQ ID NO: 1601 - DNA, 201 bp, Homo sapiens
ggggagctttgaggacctcatggatcccagggggaccaagagaggagctgagaagacagaggtagctgagcctcggaacaaactacctcgtccagcacctwctctgcccacagaccctgccctctactctgggccctttcctttctaccggcgcccttcggaactgggctgcttctccctggatgctcaacgccagtacca

SEQ ID NO: 1602 - DNA, 201 bp, Homo sapiens
ccttctgctctgtgctacgcagccgcctgggaagccaccctctgctcttctcaggggaggtagactgcacagacccccaagccccatccacacagcccccracctgctatgtggagctcaagacctccaaggagatgcacagccctggccaatggaggagtttctacagacacaagctcctgaaatggtgggctcagtcat

SEQ ID NO: 1603 - DNA, 201 bp, Homo sapiens
cccacagaccctgccctctactctgggccctttcctttctaccggcgcccttcggaactgggctgcttctccctggatgctcaacgccagtaccatggagwtgcccgagccctgcgctactatagcccaccccccactaacggtccaggccccaactttgacctcagagacggatacccggatcgataccagccccgggac

SEQ ID NO: 1604 - DNA, 201 bp, Homo sapiens
atcacctccgccaggccgggccccacgccggccgcggattggctccctccaagggcacgcacgcccggggactcgttggcggcgtggaggggcgccggtgkccacgttggtgtcaacctccttcgtgaagctcacacctcccccgccccgggaggggtttgcccgccactgtcgctgaatgattgcatcatcgaaagcaga

SEQ ID NO: 1605 - DNA, 107 bp, Homo sapiens
acctcccatcaccccccaagactccctctcccaaatagtaatgctttagagggaggcagtcatatctctgtgtgcagataataaaagcatatttctaagargttctc

SEQ ID NO: 1606 - DNA, 201 bp, Homo sapiens
ccagggggaccaagagaggagctgagaagacagaggtagctgagcctcggaacaaactacctcgtccagcaccttctctgcccacagaccctgccctctaytctgggccctttcctttctaccggcgcccttcggaactgggctgcttctccctggatgctcaacgccagtaccatggagatgcccgagccctgcgctact

SEQ ID NO: 1607 - DNA, 201 bp, Homo sapiens
ctggctcctggaacaccgaggccggttggaggggggtccaggctggctggcagaggccatagtgacgtggcgggggcacctgacaaaactgctgacgacaycgtatgagcggcaggagggctggcagctggcagcctcccggttccagggaacactatacctgagtgaagtggagacaccgaacgctcgggcccagaggct

SEQ ID NO: 1608 - DNA, 109 bp, Homo sapiens
ggacctcccatcaccccccaagactccctctcccaaatagtaatgctttagagggaggcagtcatatctctgtgtgcagataataaaagcatatttctaaraggttctc

SEQ ID NO: 1609 - DNA, 201 bp, Homo sapiens; identical to SEQ ID NO: 1599

SEQ ID NO: 1610 - DNA, 201 bp, Homo sapiens; identical to SEQ ID NO: 1600

SEQ ID NO: 1611 - DNA, 201 bp, Homo sapiens
ctgcttgtcttaggacctcatggatcccagggggaccaagagaggagctgagaagacagaggtagctgagcctcggaacaaactacctcgtccagcacctwctctgcccacagaccctgccctctactctgggccctttcctttctaccggcgcccttcggaactgggctgcttctccctggatgctcaacgccagtacca

SEQ ID NO: 1612 - DNA, 201 bp, Homo sapiens; identical to SEQ ID NO: 1602

SEQ ID NO: 1613 - DNA, 201 bp, Homo sapiens; identical to SEQ ID NO: 1603

SEQ ID NO: 1614 - DNA, 201 bp, Homo sapiens
ggcaaggaaagaggcaggatgagagcttggccgcggtggcgtctgaggggcctgaatgtttcaaggccagagcctggcgatcaggtggctcgcttagtcckaaaccagtcatccttctccaggcctcctctgtagaatggaaactctgtacccctgcttgtcttaggacctcatggatcccagggggaccaagagaggagc

SEQ ID NO: 1615 - DNA, 201 bp, Homo sapiens; identical to SEQ ID NO: 1604

SEQ ID NO: 1616 - DNA, 201 bp, Homo sapiens; identical to SEQ ID NO: 1606

SEQ ID NO: 1617 - DNA, 107 bp, Homo sapiens; identical to SEQ ID NO: 1605

SEQ ID NO: 1618 - DNA, 201 bp, Homo sapiens; identical to SEQ ID NO: 1607

SEQ ID NO: 1619 - DNA, 109 bp, Homo sapiens; identical to SEQ ID NO: 1608

SEQ ID NO: 1620 - DNA, 201 bp, Homo sapiens
gaatgttgttgctggcttccgtaacccagacggttttgtctcttccctcaagacctttcctaccatgaagatgtttgaatatgtcagggtaagggaacgaygttgcagctcccacccgtatccccaaacaccaagaccacaggtctagcatccagggcaacagcctgccttctctcctcccaccacccccactgcccatct

SEQ ID NO: 1621 - DNA, 201 bp, Homo sapiens; identical to SEQ ID NO: 1601

SEQ ID NO: 1622 - DNA, 201 bp, Homo sapiens
ctctgctcttctcaggggaggtagactgcacagacccccaagccccatccacacagcccccaacctgctatgtggagctcaagacctccaaggagatgcahagccctggccaatggaggagtttctacaggttcaggatcggggtgggcagggcgagagcttaggcttgaaggctgggaaagggacttggggaggagggtg

SEQ ID NO: 1623 - DNA, 201 bp, Homo sapiens
ccttctgctctgtgctacgcagccgcctgggaagccaccctctgctcttctcaggggaggtagactgcacagacccccaagccccatccacacagcccccracctgctatgtggagctcaagacctccaaggagatgcacagccctggccaatggaggagtttctacaggttcaggatcggggtgggcagggcgagagctt

SEQ ID NO: 1624 - DNA, 201 bp, Homo sapiens; identical to SEQ ID NO: 1606

SEQ ID NO: 1625 - DNA, 201 bp, Homo sapiens; identical to SEQ ID NO: 1607

SEQ ID NO: 1626 - DNA, 201 bp, Homo sapiens
ccaacctgctatgtggagctcaagacctccaaggagatgcacagccctggccaatggaggagtttctacaggttcaggatcggggtgggcagggcgagagsttaggcttgaaggctgggaaagggacttggggaggagggtgaaggcagaatggagggtgcacgaggggtcccactgatcccttgcttttcctgtcagaca

SEQ ID NO: 1627 - DNA, 201 bp, Homo sapiens
ttgtctcttccctcaagacctttcctaccatgaagatgtttgaatatgtcagggtaagggaacgatgttgcagctcccacccgtatccccaaacaccaagrccacaggtctagcatccagggcaacagcctgccttctctcctcccaccacccccactgcccatcttctgcctcctcctctgcctgctccagaatgaccgt

SEQ ID NO: 1628 - DNA, 201 bp, Homo sapiens
tttgtctcttccctcaagacctttcctaccatgaagatgtttgaatatgtcagggtaagggaacgatgttgcagctcccacccgtatccccaaacaccaasaccacaggtctagcatccagggcaacagcctgccttctctcctcccaccacccccactgcccatcttctgcctcctcctctgcctgctccagaatgaccg

SEQ ID NO: 1629 - DNA, 201 bp, Homo sapiens
cccaacctgctatgtggagctcaagacctccaaggagatgcacagccctggccaatggaggagtttctacaggttcaggatcggggtgggcagggcgagascttaggcttgaaggctgggaaagggacttggggaggagggtgaaggcagaatggagggtgcacgaggggtcccactgatcccttgcttttcctgtcagac

SEQ ID NO: 1630 - DNA, 201 bp, Homo sapiens
cttatgtacatgggatacaaatttgagcagtacatgtgtgcaggtgagttgcccctgcttcatagcccccttccccttcccagaggttgagagccccccamgcctgctgctgcttctctccttgtgcagacaaacctggaagctccccagacccctctggggaggttaacaccaacgtggccttctgctctgtgctacgca

SEQ ID NO: 1631 - DNA, 201 bp, Homo sapiens
ggagcttatgtacatgggatacaaatttgagcagtacatgtgtgcaggtgagttgcccctgcttcatagcccccttccccttcccagaggttgagagcccsccacgcctgctgctgcttctctccttgtgcagacaaacctggaagctccccagacccctctggggaggttaacaccaacgtggccttctgctctgtgcta

SEQ ID NO: 1632 - DNA, 201 bp, Homo sapiens
ttatgtacatgggatacaaatttgagcagtacatgtgtgcaggtgagttgcccctgcttcatagcccccttccccttcccagaggttgagagccccccackcctgctgctgcttctctccttgtgcagacaaacctggaagctccccagacccctctggggaggttaacaccaacgtggccttctgctctgtgctacgcag

SEQ ID NO: 1633 - DNA, 201 bp, Homo sapiens; identical to SEQ ID NO: 1600

SEQ ID NO: 1634 - DNA, 201 bp, Homo sapiens; identical to SEQ ID NO: 1603

SEQ ID NO: 1635 - DNA, 201 bp, Homo sapiens; identical to SEQ ID NO: 1604

SEQ ID NO: 1636 - DNA, 104 bp, Homo sapiens
acctcccatcaccccccaagactccctctcccaaatagtaatgctttagagggaggcagtcatatctctgtgtgcagataataaaagcatatttctaagargtt

SEQ ID NO: 1637 - DNA, 106 bp, Homo sapiens
ggacctcccatcaccccccaagactccctctcccaaatagtaatgctttagagggaggcagtcatatctctgtgtgcagataataaaagcatatttctaaraggtt

SEQ ID NO: 1638 - DNA, 201 bp, Homo sapiens; identical to SEQ ID NO: 1600

SEQ ID NO: 1639 - DNA, 201 bp, Homo sapiens; identical to SEQ ID NO: 1611

SEQ ID NO: 1640 - DNA, 201 bp, Homo sapiens; identical to SEQ ID NO: 1603

SEQ ID NO: 1641 - DNA, 201 bp, Homo sapiens; identical to SEQ ID NO: 1614

SEQ ID NO: 1642 - DNA, 201 bp, Homo sapiens; identical to SEQ ID NO: 1604

SEQ ID NO: 1643 - DNA, 201 bp, Homo sapiens; identical to SEQ ID NO: 1606

SEQ ID NO: 1644 - DNA, 104 bp, Homo sapiens; identical to SEQ ID NO: 1636

SEQ ID NO: 1645 - DNA, 201 bp, Homo sapiens; identical to SEQ ID NO: 1607

SEQ ID NO: 1646 - DNA, 106 bp, Homo sapiens; identical to SEQ ID NO: 1637

SEQ ID NO: 1647 - DNA, 201 bp, Homo sapiens; identical to SEQ ID NO: 1600

SEQ ID NO: 1648 - DNA, 201 bp, Homo sapiens; identical to SEQ ID NO: 1601

SEQ ID NO: 1649 - DNA, 201 bp, Homo sapiens; identical to SEQ ID NO: 1603

SEQ ID NO: 1650 - DNA, 201 bp, Homo sapiens; identical to SEQ ID NO: 1604

SEQ ID NO: 1651 - DNA, 201 bp, Homo sapiens; identical to SEQ ID NO: 1606

SEQ ID NO: 1652 - DNA, 104 bp, Homo sapiens; identical to SEQ ID NO: 1636

SEQ ID NO: 1653 - DNA, 201 bp, Homo sapiens; identical to SEQ ID NO: 1607

SEQ ID NO: 1654 - DNA, 106 bp, Homo sapiens; identical to SEQ ID NO: 1637

SEQ ID NO: 1655 - DNA, 201 bp, Homo sapiens
gtggccggacaaaattcatccagcctactgacacagtcatgatccgcccattgcctgttaagcccaagaccaaggttaagcagagggtgagggtgaagacmgtgccttctctcttccaggccaagctggacaccttcctgtggtcgtgagaacagtgagtctgaccaatggccagacacatgcctgcaacttgtaggtcaa

SEQ ID NO: 1656 - DNA, 201 bp, Homo sapiens
gtaggtcaaggactgtccaggcaggggttttgtggacagagccccactttcgggaccagcctgaggtgtaagggcagacaaacaggtgagggtgagtgtgrcacccagagactgctcttcctgccctcaccctgccccactcctacgactgggagctgacatgaccagcccactgatcctgtcagcaggtcctgctcctgt

SEQ ID NO: 1657 - DNA, 201 bp, Homo sapiens
cctgtggtcgtgagaacagtgagtctgaccaatggccagacacatgcctgcaacttgtaggtcaaggactgtccaggcaggggttttgtggacagagcccyactttcgggaccagcctgaggtgtaagggcagacaaacaggtgagggtgagtgtgacacccagagactgctcttcctgccctcaccctgccccactccta

SEQ ID NO: 1658 - DNA, 201 bp, Homo sapiens
cccaggattctctacggcctcggggccgctaagccccgcccatagttccgcccatccgagaatttgtccaatccaggcgaagtattcacgctccgcccaargttttgtgttgtcacttccggcccgctccaggaagtcgtgctgcggagccaaatttgaagcaagcggaggcgcgggggcgcgtctacgaagccggacctg

SEQ ID NO: 1659 - DNA, 201 bp, Homo sapiens; identical to SEQ ID NO: 1656

SEQ ID NO: 1660 - DNA, 201 bp, Homo sapiens; identical to SEQ ID NO: 1657

SEQ ID NO: 1661 - DNA, 201 bp, Homo sapiens; identical to SEQ ID NO: 1655

SEQ ID NO: 1662 - DNA, 105314 bp, Homo sapiens
cagtttgctgatatcacaggagatctgctatttgatcattttgcctgccaacttggatgtctgtctcagcaggaaaccatttaaagaaaataaatgaattctcagcacttgacattttctggaggacctgagtcctttccaagtgagctcatatcaagcacagttggtaagacagagacgggaaaatgtgctttctccctgttaagaggacagcctcgctgaagcatcttgggcagggcagtattaagtgacttttccttgttgatgaggggtcctctcacctttgggagagaggtggccctccaccctggaggggctgcaggaagtggaagcaggttccatagctggggggtgttacaagtgagctgaaggagaagtagcatggaattcctcctcattttctctcccgagtccaccctgcctcctccttcccaacagcttgtttattacagcatggtgacttggggcaacgtgattatatgagatggtttttttctcccttctctgtcctccctcctgggcacagtgtatatagtatgagagctactgtaatgaaaggtgcacaggcctttttaggaaagtgattgcaggtgaggccaactcagccaggaaaatctcctgttgcttcctaggatgggtcaggggaaaaggagagggactttaaaacatggatacttcagacctggctgcacactggactcaccaaggggattaaagaaaaacaatgcttgggcctcacctccagagattcagatttaattgatctagggagtggctggggtatcaggatttttaaatctccccaggtgatgctaacatgcagccagatgtaaagatggtaggtttagagggagagaatgcaatggttttcactgttgtactgcagggtgatgatatggggcagggcaggagcctattccagcccctacacctgtggacacttgcgttagaggtgtccacacttctaccttgaagctgcagcactggaatacttcctccacactgctggtgctctggagcctttgactagccagggggccgctgagtaacaaaccttcccactgtctccttccaccatggaccaggggcagccatcacacttcctcatgttttttagtgacattacttatcatttaccttaaagtaaatgataaataaaggtggacctaggggtctctcttgtttttcctttctttctttctttctttctttctttctttctttctttctttctttctttctttctttctttctttctttcttctttctttcttatttttctttcttttctttcttttccttctttccttctttcttttgatggagtctcactctgtcgcccaggctggagtgcagtggcacaatcttggctcactgtaagctccacctcccgggttcatgccattctcctgcctcagcctcccgagtagctgggactacaggcgcccgccaccatgccaggctaattttttgtatttttagtagagatggggtttcaccgtgttagccaggatggtctcgatctcctgacctcgtgattcacccgcctcagcctcccagagtgctgggattacaaattcctttcttttttaagagacagggtcttgctatcactctcttccaggctggagtgcagtggcgagatcatagctcactgcatgctcaaacccctggcctcaagcaatcctcccgcctaggcctcccaaatagctgggactgcaggtgcacaccaccatgcccagcttcctcttattttcataaaagaataatttgtgtgtgcacatctttctttggaatcttggattgatcaaaggaggtatagttattacatgtgtcctacatgctgaagttgaaagacaaaactagagaagaaaaatgcctagtttctgtgggagtgattataacaaaatagctaatatttttgagatactatttatgaagtaatcaattaagccattacaataattctgtgagctaagtaccaatagtatccccatttggctcaccgtaataatacgtaattggctcaatgaaataataatgcgtccagggatctgagatacacacttgagaaaattagtggtgagtcaacataattgccaaattatatgatattattataaagcaaagctttgggtgtaatattaaggcctatgtctctttctgtaaatggttaaactgaggcaccgagcagcctgcttaatcgaaatcagagcacaaaagaggggaggaggtacaatcctctaaaacacatactgtcatcaacctcttcatcttgaaatattcaattaaatgttatccaaacccaaagttactaatgaatttggaaatgagctggctgtgactgtgagtatggaaattggtggagaggagaaactccagagactggggaggagccacaggctgcctggcttcagagttgttaggtagaagagaaagcagacctggaaagaaagatacagggagggaaagaaggaaaagggagataaaaattacagaaccattgaaggaaactgctccacagtttcccctctgcctttgggcaggagaatgtctcaagagcgttcccaagcttcatgtgcacaggaatcagtggggtcctgtgaaagacgacttccattcagcaggtctggggcagggcctggcactctgcatttccaacgctctctcctaagtgatgcctatgctgctgctggcccatggacctccctgtgagcagatgggtccactgggatcctctggggagagggtgattgaaaccccctggaatccttctcccatacctctgacactcagacccatggtctcccacccccgtcattgctacagtggccccggtaactggccagttttgtacttattggagtctgggggagtgtcatgggaaccacgggacaacatgagcaagggagagtgagcaaactggcagctggaaggcaggcaggctaagttacccaaatgacagaaggaagagaaggacaagaaggcagagtctgctcactcactcaagtcaaggtgattaatctctctatgcctcagtttccaccctgcaaaatggggatactattggtacttagctcacagaattattgtaatggcttaattgattacttgataaatagtatctcaaaaatattagctattttgttataatcactcccacagctagatgtcagcccttgcatgaaatcaagcattcggcaaacatctatgcagcgtggactctgctgggccccagctgggtccctgagcagagggtctggattggccatacctcatttatattgagatgaatgaactccttgttctttgtactgagagcctggaacacccctgataggaragaagggggaaaggcatccttttaaagacaattcctttaccaagtttgtttcccagcgaccaaagggccttccagtggagcctgtggggaagctgctccatctggtggtaaacaaggactttcatcaagggcggcgatgggactctcatcaagggcgggctgaaggtgaacttctctgaacggatggaggcatccagtcctgtagcaagccagtggtcacctaagccagtcagccggccagcagctcctggagccaaagcaacgcccctatcttaaccttctggggggtacagggcccttgaaatccataggccccagaaaaaaagcacacgcacgtaaagttttgcatgaatctgaaagttgttagtctcgcccttgtaggaaggtgccgtgggtgctgtcagaggacagagtggcacaggagagcgtgccagcactgagctgggggctgggtctaccgcatggtgtagtgacctgagtgcacctgagcaagtcactgccctcttggggcctcagcctcctcaccttcagaagacgaggtcgagccaatcagccctggcttcacttgagaatctctcgggtagctttaataatacaacccaaagcggggtgggggaccatcactggacacaagaaatggaagagacccaacaaccaaacatggtgactgggtcttgtgtggatcctgagtcaaccaagcaactgtaaaaaggtggcctggaagacttgggcatgaaccgggcactagagaatgttgagggtttgctgagaatttcgttaggtgtgcaaatggtatgaagatgatgctaaaaacaagtctatcagctggagatactcagatgaatggacagagtttctgagatctgctattaaattatttagggggaaaatgtatgtgttgcgggagcacaagggaaaagttagcaagatggtaattgttgaggttgggtgtaaaggtctggaaacacctggcgaatttgcgtaactcccaatgctgtgtgccacccctgagattctaacagaattggtcaactgtgcagcctggtcatcagcatttctttaggcacccctggagattgtaatgtacagcgaagtttgagaagtgctgatgtggagtgcatgggaacctattatgattctttatatctaactggagggttgacattcttacaataaaaagttaaaataatactgcagcaaagctccatccttggtaattctaaaagttctccaggcaaatctaatgtgaggatgccagagtggatggtgttaagcctaaagggtcttcaccctaatattcctctactataagaaaagctgaggcactcccaccccccgttctgggaaggattacacctgggtggtttagaaagggaaagagcaatggagagaagagaaactagcaaatctcattatttctagggtcagctctgaccaccctgtaagtctaataacagattctgtttcaggaggggtctttctagaatgcacctctcactagctaccagtaaccccttagggaaagccggcttcctggcttgatatactagaccctttggggcctgctggtctgtctctgattttctctcatcattccttaatcaacacatactcattgattgtccagaaattacggctctcctggagcttagagtctagaggggctgtgcttcaggcaagtaattagtgttctattaccaaagaagcagagggagctatcatgctgataaccaagggtcacagccctcacctttttattttaatttaatttaattttattatttatttatttatttatttatttatttatttatttatttatatttttgagatggagtctcccactgttgcccaggctggagtgcagtggcaaatctcagctcactgcaacctccacctcccaggttcaaggggttctcctgcctcagcctcccgagtagctgggattacaggtgcataccaccacatttgactaattttttgtatttttagtagagacaaagtttcgctatgagctggtctcgagctcctgacctcacgatccaactgcctcaacctcccaaagtgctgggattacaggcgtgagccactgtgcccagccccctgccttttttttttttttaatcaagtattcatacctcgaagtggcctatggaacacagattagaaaataccaagcaggacaaaatggaaatgcggggccccctgctcctaagttgtgaagactttcaagatggaaacgccagaacattaaaccaagcacgaggcacccttgagggcacgggtcctttggcacctgcacacagggcatgtcctcatagccactccagtactgagttacaggccctggacatgcttcactcagcctcaccttcaaaaccacctttgaggggcaggatggctatgacaataaactgcaaacactgaagcgcacgggcacataatccctctctatttgtggtgtaacaaatcttatttgagataactgggtcaatgtctagggcttacagggcggggaaggggggaggaagggggactgagactctcctgtttctatatgctatgatgggatttgacctgcaattgaacctttcctcaaacacaaggcacaaacctgccccagcccatcatcctcccacagaggcactgtgaatgtataaagaaaggcgatgctaagaaacrtgctgcaggggaggctggcacattctgctccttagctaaccgcacaggcccatgggtccacacacatcagaccatggctctctgtggtctatctttgccattactttaaccaggctgtttctcatgcgctcatggagggtgactgaagatgccaccccgaggtgcaccctcagcctcgctggacacttacggctcgcattctccagccggaccaggcagttgaggaagtcatcgaagtccagctggagctcctcatccgcatacctgagcacaatcagctgcaggaggtggctgctcagctgaaagcctgtggggacaaaggaggagacccaggactcgctgtatccgagccccgaggtgagtctgcacctttgagggagctcccaggcagctgaggagagggctcagaagaggaagccactgtttcactcctcaaagckggggtccccagacccagtgggactgctgcccttggtgtgaatgcagcgtgagagtgtgaatctgtggtgcaggggcgagtgtgcgggggactctcaggcgtgctttctgtgtttaatggcttctgagtttagcgagtttgtgatcttaattttgatgctaacatcacccatagagtctcgctgactttacaggaagctttgtttgggggaacttaacactgggtggtgtctgagccccaagttcattcctacaccagcctcccctcgygttctatgtctcaggtcacttccagctgtggccctagaaagtttcttggaggggatgctgctgcccacggagaatgatactctgccagggcccattcctacacatccacgatgggggaagaatgacaggctatagccaggaggcttggatctgagccctggcactgctccagccgtggcatatgggttcagttctctgggctttggtttcctcattgtcaaatgaggagtttagacaaagtgaacttccttctggatttgatatttagatttttttttttgagatggagtttcactcttgttgcccaggctggagtgcagtggtgcaatctcggctcagtgcaacttctgccttctgatttcaagtgattcttctgctgcagcctcctgagtagctgggactacaggcacctgccaccacaactggttaattttgtatttttagtagaggcggggtttcatcatgttggccaggctgatctcaaactcctgacctcatgatccacccacctaggcctcccaaagtgctagcattacaggtgtgagccaccacacctggccagtgctttgatttctaattagtgcccttagaagtgatttctttccccctttcatttttgtctacatgttcactttctaggaggtgttcacaggattgttcagaaatccacccagggtctttctgcttcttcctaattccagcagaggagcaggcaggtcagacacagagcacagagtcyctggagcctgcacggcagtgctggctgccagccttggccagaatcctgatgtttggggctagaggagggggatgaggggcgattctccccacaccacgtcagggtaggaaagacacagccatgcccctcctctctgagtgctccctttgtcccctgctcagttcctcctcctaccatggaaacagagtcatcatcccctaagaaaatcaggcgccccttctcagcctggcactttgctcatttataaatcatctgattttcttctccctcacataggacccgagatggtcctggctgtgtatacttcatccttttatcaggcctgagcctggacatgtttccagattttgctttccctgggagrgaaccactttaaaaggttcaggaggcccctatctgtgaggtgtgcttggtgagaagcgcaggcagcccggcaggcgggaggtctgcagagcgctygtggaaactacggttgtgtgtgcaggacatgggaccacagagatgccgacagccatccagcaccggacaagagtgggaaatgccacctggagcccagcctttgggtaagggagcagggtataaactatgatgcagtcatccattttggattcagagtctgatgctgataaaacccgggacagggccacaggtggcagagggacgtgcggaccccaaaccatgggtgctgcatgctctgtctcatccacgataacaaccatctgagagcagaaatgagaagtttggaatcactgcagcttgccaccaaagagccatgtgttaagtactgggccagaaaacatggtcagaggctatgaggcctccagagggcaggccaagttcatttttagcagatacatttaaaaagtttctaccaatgttcacagtggtttaaaatgagggccctggtgtcaggaagtgagtcctgggtctgaaccctggtgccaccactccaagggccrtgaccttaagaatcaccaactgggctcagaggcccacctcctgggcagcagagagaagacctgccatctgctcaggttgcccacaggcagtacctggcatgcagtcagccacctgtactccagtcttttctttacctgcagctttcagtgcagtccgtagttcataggtagayatggtgccggacttgtcagcatcaaaccgaaggaaaaggttctaaagggtggagagcagaagccttgagaaggagcgtgcctgaaaggcatcgctgrtggcagtaaatggrtgacagccagcccgggggagctaccctctaggggccgcagaggccacagttggactgggccttccaaaagaagtcggtctcccttttgtcttccttttcgtcttgggtggaagcacggtggtactcccgtaagyatcggaatagcatgatgctgttttcccttctcccctgtccraatacaattcctctagcctatagcctgcagcctgctgcaccattttaaatcccctctgctctaggttcactgggtcccccagaggccaagccctgctccaggttacatacaatccactgcttcagcttgtcccagaacactttgaattcatcaaactccagcttcccattgccgctggtctgtgccatgtgggttaagggagacatgagcagtgtttcaacctgaggctcctcgtgggacctcagctctgggactgcagagggggagggccgatgggctggcctgggtgcacaggtttggggccctggggaagtggttttaatgattaaaccacaaatctctgaagaggggaaacggcagaagtggaatgggggtggtccyggaaagttcacaaaaacagaactctgttcccttggatgggatcccaaagtggcaagaagacccccaagtcccttcaaaagctccccacccccaccactrggcagtcttgtgcatcttgattctgatccaatttcagcatgggggtcccccagctttgggttattttctgtgaagaagactattctgctggctaaggatgtcatgttcttggagagtctgcactattgaagattactctactgtgcttaaagcccaggatccatgtctatttctgctcaaatatttggaaggatacgtccatcagggaaatgatgtttttacaggagatcaggcttagcttcttgaatttgatgtccttttctgaaattgcacatgaaagctgaattcagttgacccgataagataaacctatgtacccatctgctgaaagcccaataatgtggctaaatccagggctgttgggggctgtgatgtggctactctcttatgatgctggtaggagtagaagttaacatgacctttcagaaggaaaattggctaaatgtgaaaaaagcaataaaagtgggaatacgccttcatccatttattctagttctaagaaccccgagcaaagaatwacatatgaagatttttgtcatcatattatttatagtggcaaaaatttggaagtgaaataatgaccaatagagaggcatggtcaataccttaggctatgtctatataatgaagtattatacgacccttaggaatcatgtttttgcagcatatttaatggcaggatttaaatttgttggagaaatttgtactcccatactgctgctggtgaaaatgtgaaatagtcactttagaaaacagttggatagtttttaaaaacattaaacatagagttaagcaatcctcttaactaaacatataattaagaggatggttatgccaccatgtaaccatagactgttgcattgtgatggaaccatcctcataactatatacccaggagaagtaaaaacacatgcccacccaaaaaacttgtataggagtgtttacagttgcattattcataatgaccaaaaaccggtaacaacccacgtggccaccaatagatgaatgaataaacagaacagggcccatccatacgatggaatgttgtctggctgtaagaaggaatgagacattgatacatgctacagcatggatggacctggaaaacatcacaccatgtgagaaaagccagtcagaaaggaccacatattgtatgattcctttttttccccctgaaacggagtattgctctgttgcccagcctggagtgcaacggtgtgatcttggttcactgcaaactccacctcccaggtttaagcaattctcctgccacagcttcccgagcagctgggattacaggtgcccacaaccacacctggctgattgtgtgtgtgtgtgtttatttttagtagagatggggtttcaccatgttgaccaggctggtcttgaactcctgacctaggtgatccgcctgtctcggcctcccaaagtgctgggattacaggcgtgagccaccrcacccggcctatgattccttttatataaaatattcagaatatgtaaatagaatctatagagaaartagatgagtggttgcctggggctgggggaaatgggtacagggttaacactgttaatgggtaaagggtttcttgttggagtgatgaaacattctaacattatatgtctacgcatatgacacacatgtacatacatgcagatacacatatgttaagagtggttatttatggtggtgagatcatttgtgactatctttgtcattaggcttttctgcatttttaagaattttctactataaacctgcatcgtttttggaatcaggaaaacaaacaatgaaagctatttttaaagtctacctacaaatcagccctgggaagcagatctgcggctcggaggagcagggaggggacccaggcagtgtggtcgcttgtccctccataggtgccccaggacccygatggggttggcacttactcttttgcagcacagcatttaaaacatactcaagttcctctgctgtcacctccatgtcctgttgaagtggagacaattgtttkttatagcccttggcaccttcttttatagtttatttttgttttaaatcagttctgagcttcatttggctccagtgacagaccagccttcaggaccctgctgtgggcagatgtacctatctcctgtgtagctgcagctatgtgtctcatatgtcacatgttttagggrcatgccagcccaactaggagagagcctaacttgagagacatcccaacccaggaaagcgcatgaaaagctgggcagggcaaggcagtggtttcccagcttccctgagggtcagaaccaactcctggaattgtcctaagctcctcagatgattcctatgttggaggcagtttgggaaaaccagactgagtcttcctctgtacagtagaaccacctgcagagctttaaaatagtcccgcatctggggcttaccccagggaatcttgaaatcagaggacctgagaatatggtcctatttttaagacctaggagttgatttagaattaagaataagggtgaatttcagaatcatggatctaaggcactccaggaaatctcagcagcccccaccccagaagctggttagaaatggagagtctcagaccttgccctgagactcaggctttttttttttttttttttttttttttgatacagggtcttgctctgtcatccagattggagtattagtggtgtgaccacagctgactgcagcctcaatttcccatgctcaagcaatcctcctacctcagcctcccaagtagctgggactataggcatgcaccaccatgctgggctgattatttttgcagagatgggctctccctatgttgcccaggatgctcttgacctattgatgaggaatctgtgttttttttcccaggatgcccaggtgactttatgcacatgtgtgtttgagtagcactgacatagacctcattttagtcagggttttgcgctagccgtgtgttatgctgtggagtgcttctaacacatgtccgtcctgaagcctctgggcctggggaatgggggtttgggatgtttggtgttggtaagaaagcactgccccagccaggcccccactgaaagaggaggaaagagaaatggagccatgtgcccaagtcatccaactacttggaagaaaagcaggacatgagtcaaggagggctgaactctagaggtactttttggttgttaataaaggtcgactgaaactcctgcaacattcaccgcttcccttccaaactctggatctccatctgacaacttctgcgcacccgcatgaacctctttaactcctctgagcctgtcttgctgggtctgacccagcatgctccagatagcacctggagcagggaggtcaccactgccttcccccctcaccatgctctgtcccgcccagggctrcgctcagccaccttcctgctgtgctttaagcagtcacatgagcccccattttctccatccgatcctgtggtcccctaatctccctgycttgcctgtttattgcagtgcctaatatactaccatcagacagcccctaggtttagatatcacccctccaggtgacccctttcataattcaggaaccccagtttggggaaacacatgaagctaatagagtcattagcaccttgacatgaattagttcatcagctcattgtatttatggctccaagagagcacctctggggcagtttctagaaagacttccctcccctgaccccagcaggtggaggaagagcctggatctgtgtgaggctccatccagtgtccctaaaaaggaagctgagcagtggaaagagctaggatagggtgggggacaggaagttgcaattgaatagggacctccttgaacatgatcccctttactacagcaaacagagtattctaatggcagtgattttcaggcagagttcaaaggagtcacctcttcaaggcttgctctagcctcccaaagaaagcacctggggccaggcgtggtagctcatgactgtaatcccagcactttgggaggctgaggccagaggattgcttgagcctaggagtttgagaccagcctgggcaacatagcaagactctttattatttatttttttaattagctaagcatgatggcatgtgcctatagtcccggctactcaggaagctgaggtgataggatctcttgagcccatgagtttgaggctgcagtgagctaggcttatrccactgcactccagccagggtaaaagagtgagactctgtctaaagcaaaacagaactaaaaaacaaagcgtctgggcctattccaagcttctttgggctcactggccccatccacagccgcagactgtgtaagtaaatgttgtaaacagggtggtctttgggccttgaatgatcagtgctggtcttactttgcaacaagctccatcatgcctcaggatgacgttgctgaccaaccccacgactgcaaccctttgctaggaagcaggtccaggccctcagsctggtggggagatggaagtggggcatgtcctacctcaccagcgacttgttcaaacagagcccgaaaccrctgctcctcctctgtctcctggtcaggtggagttggctttggaggctaaaaaacagccaaagaaacttgcacaaaatgatccacaaaaaagaaacatgacaaaaatagcaggaaagaagccaggascctgtgtgcccagccccatgtcaccctcctgaggcrgtgtgcacaagctgcgtcctgtagcgtgaggaacattttctcatgaaggctcttttagaaggtgagactagaaggactttattagctggacctgtggagcccttctgccttacagacgaggaggccaaaggaccttgacccgtgcctaagttaggtcctggccattggattttcatgcttcctgcccttcctctggcttacttcttaccaccctggactggaatgacttacttcatcatctgttttgatagctggtaaaatcgttgaaggcaagagtctgtttctaccactaagctctgggcttggtatatagaaagagctcagtaaatgttttgggtgatttttggtttctttggttttttagcaccattaataagctgtgccccagcatggaacagcaaattccctcctaaaagcagatctctgctgtccctggacgtgtcagactatttccagctatagtatctcagggcctcttgcgagtcctccagcccttggacgagggtaaagccacccccatgtcaccccttccacaccacataacataggggagatgtaatrtgttcccctgagtccacagtaaaaaacatctccctgcctctctggttttcttttcattgattagatttcttaaaatacaattaaaagtctacccacttcagaagcggcagccttctctcaggtggagttggtagtgtgaaagttattgagtcaaaatgaagtcactaatgttaagaaaaccctgacaaatagagctcgggaaggccagaaggttctcatgcttatttgcctgataacaaaaatatcacaaaaggctgcaaaacccacaacctttcacagaggccctcgcaaccatacacaaaaatacttctacctctgcctagcaactgcctgtccaacatcagactggcttcacttttgttattgatctttgtagccaaggataattatttcaaaacaattatgtaatccttctcattttttctttaaaaacctttgtcctcctttacctccccaaataggtgcatagtttactatggcatgcaccttcccattgcagtgctttatccctaaataaatagcttttcttttagagagtgtctctgtgtttgttatttcagttgacagtagcacagaggaagatgacatsgaacagaactttataccaagcacccacctcactcccatgccaggtccttgtggactagaagagcacagactagaacacacacatcttggtctccaggaggttagaatcatagatgcttacttgattgcatgtaaccatccctgaactgcagagttttacatgatgctgtgattagaaggaaggtttccagaaccatcacctgaatcccatactccatagcaacatcagaagactcacctcaggaaggtcaatgtctacatttccatccatatccctgtaggggcagaaaaacacactgcctcaattgtggattaacttcccattgggatctgcagagctgaagagcccagagcctgggaaggttctgtccctttgaatcccttattgttcagtgctgtttacatttcacagagtttgcagaccccatgcattgacacccccacccttagtcactcagaccttgctcagaatgtaaataagagggacagccattgtgttagaccattcttgcatggctatagagaaataacagagactaggtaatttataaagaaaagagatttgattggctcatggttctacaggctttacaggagcacagtgctggcatccgttctgcttctaaggaggcctcaggaaacttacaattattgcagaaggtgaagggggagcaggcaagtcacatggaaaaagcaggagcagggtggtatgggggagttgccaaatacccttaaacaaccagatctcgtgcaaactcactatcgtgaagacagcaccaagccatgagagatccgcccccatgacccaaacacctcccatcaagccccacccctaacactggggattacaattcaacatcagatttggtggggacacatattcaaactctatcattctgctatgggccctcaaatctcatgtccttctcacactgcaaaatataattatgccttcccaataacccccaaagtcttaagtcattccagcattaactcaaaattccaaagtccaaagtctcayctgagataaggcaagtcccatcacctatgagcctgtcaaatcaaaatcaagttccaagatatacaaattccattttatacttccaaaatacaatgggagtataggcattgggtaaacattcccattccaaaaggccaaaagaaaggggctacaggccccatgcaagtttgaaacccagcagggcagtcattaaatcttaaagctccaaagtgatctcctttgactccatgtcctacatccagggaacactggtacaaagggtgggatcccaaggccttgggaagctctgtccctgtgactttggctgctgtcatgggttgttgagtacctgtggcttttccaggctcaaggtgcaagctgccagtggatccaccattcttgggtctggaggatgatgrccgccttcccacagttccactaggcagtaccccagtggggactctgtgcgagaccttgaacctcacatttccccatctgcatagccctagtagaagttctctgtgagggctctgtccctgcagcargcttttgcctaggcatgcaggcttttccatacatcctctgaaatctaggtggaggctgccaagcctcattcagtcttgcactctgtgtgcctgcaggcttaacaccatatggaagctgtcaaggcttatggcttgcactcttgcaccctctgaagcagtagcccaaactgtatctggtgcctttgagcagagactggagctggagcagctgggatgcaggtaacagtgtcctgaggctgcatagagcagtggggccctaggcctggcccatgaagccatttttttcctcttaggcctctcggcctgtgatgggaggaggtgctgctgcaaaggtctctaaaatgcctttgaggccttttccccattgtcttggttatagcacttggctctttttagttatgtaaatatctctagcaagtggttgctccatagcctgcttgaattcctctctcgaaaaagctttttctttctctgctatatagccaggctgcaaattttccaaatttttatgccctgcttcccttttaaatgtatatattccagctttaastcatatctttgctcccatatctgagtataggttgttagaagcagccaggtcacatcctgaatgctttgctgcttagacatttcttcttccagataccctaaatcatcactatgacgttcaaacttccacagatccctagggcatggacacaattcagccaagttctttgctagggcataacacacataacctttgcttcagttcccaatgagttcctcctttccatctgagacctcggcagcctgaacttcactgttcatatcactgtcaacagttaggccataactatttaaccagcctctaagaagttataaacttttcctcatcttcctgtcttcttctgaggccttcaaactcttccaacctctgcctgttatctacttccaaagtcacttccacattttcagttatctttataacaatgccccactcttctgtaccaattttctgtattaggctgttcttgtactgctataaagaaatacctaasactaatttacaaagaaaagaggttcaattggctttacaaagaagcatggtgtattccctagaagttaacttaactccttgacttctagggagacctaggaaactacaatcatggcagaagggggaagagtcatgtcacatggcaaaagcaggagcaggggtggggcaggtgccacatactattaaccacatctcacaagaattcactcagtatcacgaggatagcaccaagccatgagggatccacacccatgacccaaacatctcccaccaggctccacctccaacattggggattacaattcaacttcagatttgatggggacacatattcaaactaaatcagccatcaccaagaacttgtgaattctggatttatgaaactaaaagaagttaagccagcagtcactccttatttctttaatgtactttaacaagggcaactgataaagtgttttgtagaatagcagcacctccaaagacgcataaacagtgcagttgcattacacattcactctccatgaactttgcatcttcaaaggagatacatatctgttggagaccattcagcctattgagtggtaggcactggggagggggtgcattttaaaagattacaaagttgaatcagaaccaaaaaaaccaccwttttttttagacggagtctcactctgtggcacaggctggagtgcaatggcatgatctcggctcactgcaacctctgcctcctgggttttaagtgattctcctgcctcagcctcccaattagctgggattacaggcacgtgccaccatgcccagctaattttgtatttttagtagagatagggtttctctgtgttggccaggctggtctcaaactcctgacttcaggtgatcctcctgcctcggcctcccaaagtgctgggattacaggcatgagccaccgtgcctggcctaaagaycaccttttgaagctgcatccctaactcctgcctctcatcacagatgtaaattcctgattccactggtggggttggggagggatgggtgtctctgtgcttatgttagggaaaaagaggaaaaatgatgcaatcatgtttttttgctattcacatatttagggggacttgtaatatttggatagtagtaatattaagaggaggagcaggcttcagcttttgatgatgctaaaaacatttggaagaatacagtctcatagactaaaacttgaagggctctcaaagaaaaactgatacaaagtcaaagggaatacaaataaacattaacatcaattgggggtagtcctccctttcctcctcatcccctgggcatccataacataaccctttcagaacttctgtttgtttaatcaggagtctgtctgagagctaaaccaatgcraacacagctcagtgtgaatttttgttaccaagctacagagctgattcttatactcaatatcatagcagattaaagaatcttgttcagagcaagattgagtatggagttttttgccatgtacaagtcaccttatgcatgtcagtgactctgagctcaccccactaataagatagagaacaagaggcatggcattggcataacttgggtctctcttgttcttgccacccataagagatgtcaatctgcatggatctcatacagggtacttttgtgtgaacagatactaggatattcatccccatcttgtactagtatctgggagaaggctggagaaaaattctctggtagagtgtttaaaaattaaagacttttctgcatctatttagccaagagaaagaaccatgccttttgtaatcagcttgggaaaccccactagacttcataattgagagtcttttcaatgcatgccaccaatctaattctctctcactaaacgaaagatgaaactagagtgagtcatgtattcacagctgtctctcttgttaactctgtgcagattgatcttttgttggagacttatctagcttaaatacagaattagcagattttagcgttctccttaatctttagaatattgtcatcgggaaaagaaatggattcctctgtcttgaaccatttttccccctgtgccacagagcaaccaatggtgaatgggcagtaatgggaaacattttccatagaagtaactgatataaagtaatttcgctaagacactgtgaggaaaatgtggtggaatattgggtatgtaaaatgagaggcagatttgccaacatttatttaaattggagctgaaagaacatgtcattcttgaaatttgcaatagccacccccttcatcatgcccagaaatgtctagcatccctgcatgtggctcttatccaagaagcttcttggtaatagggtctgaaaaatgaaggtctccacccaagaatgtcttgtgagcatgactctgggaccagtagaaaacagcaacttttcaatggtttgcttgagggagcgaggagcagagctagaagggatatgtgccttgccttgcagataagctaagaaagtgtcctgcagcctggcgtggtggctcactcctgtaatcccagcactttgggaggctgaggcgggtggatcacctaaggtcaggagttcgagaccagcctggctaacatggtgaaaccccgtctctactaaaaatacaaaaaaaattagccgggtgtggtggtgggtgcctgtaatccttgctactcgggaggatgagccaggagaattgcttgaacctgggaggtggaggttgcagtgagctgagatggcaccattgcactccagcctgggcaacaagagtgaaacttcatttcaaaaaaaaaaattaataataaataaaagaaaagaaagaaaccatcctgccttgtttctcaggtacacatgggaaagggaagaatggagtcttggctccagcagttcccaggtgacttctgtgtgaataaaccactaaaagaagtgggattctggaagctgttcctctgactcaccgggtaatggcttttttctctgaaaagattctcagacagaaatcagcttcctggtggggctcaaaagtgctgggaatcmggatgtactccccagggggcagcttgaaccggtcggagacttctctcaggttgatgaacgtcttgcttctggcccgagaagcgtggtatctgaagaagtctttgttcaggtgttcrtctttgtcagggcactgcaatgggcaagaaagggaggggtttcctagggaagttcctcttggcttttcggacacaattcatggactcttggttgagtctcgggtgtgagaccgaggaggagccgcgaatttagaactcagatggagaactctgaaatgcagtgtggttcccacctacctcataaatggcatagccgattgtcagcacattggcaccaaatctcttgagtttccttctatctttctgcatcagggctacaaggaaactacactcctcctgcccctcatctttctcagtcagagacaattttatttgtggattggtccaaaaggtatctgtcatttgggagaggtagattattttccccttttaaaaaacaacccacaaagaccacacacacacacacacacacacacacacacacacgcacatacacctatctgccctcattatatgtcctaccaaacatgagaaagtaataccttctctccctgttcaataagtcctcctaccctacttttgataatccccaacgggaatgcaaaatatcctctctttcatttccaccttctcttcaaccatttcctatgcagtttcttaaggacattcttctgggtctagtctgctaaagcttgttctatcagttttttttccacttagtatttcaaaggagagtgcagtggacttctggttgtccccctggcatctacttgatggtgggccgtttgagtaggattgacctcgagcactgctccagcatgaattctgattggtctgtgccagtcctttttgccaccgaggattggacaaagccaatcaatgcatagcattcactggacaatattagttcaaggaatttccaattagagggaagttgagggcttttttttgatacccccaggagctcttgctgttcgtgtgaatgagggctcaggaagccctggatactgctgccagccctcctgtgattataaagaaagccagacagagaaagaagtcaacacataaaagagggcagaacagtgaattacaagcaaatggaaccagggccctgatagaactgtgcctgaagcccaccctacttttcctctgagctcttcaattatgtgagataacaaatcctttctattgctaaactggcatgagtcatgctttccattacttgtaatggaaaataacctaagtggtaaaacaaaggaggtttccccaaacaattcttatccaactaaatctttgcagccttttttccccagtcacttttgaaaccttactatgtttcaggctttctctgaggacccggcccttatcctttggtgtcctgagttggaagggacacttgggagtggcagagagagtgacaggcagcctacctacccaggaaattgcggcagcccccagccgtggagccgcgaacccagcttccctgatggaccgtcacctcccatttgtggatcgcgtcttcctycagggcatcgggagtgaggttgcagatctccactttatcaaaktgggccttgaagtcctkaaatgccatcctgcagcaaagckgagagacacgatgcacaggagggcaagagtgagggcatcatccattcactcattcattaaatcattcacttattcattaaatcatcttgttcctgtccgcaaggagtggggggactgcaaagtgtggggagatggaaaattttttaaaagtaaaataaaggttaaaaaggtaaaaaccaggctaaaaatatagattgattgtagatgttaagtgctacagagaaaaaccaaattgggctgaaggatgggagcgtaggggtgggatgctattttaaacagggaggtaagagaagcccttactgatggggcacattctgagtggagacctgaactaccaggtcctgggcagggcagctctctgggggtctaggcagatggacagcaaggccccgaggcagagaggtgcttgaggtgctcacagaacaccaggaaggcacgaggtgtctgtaaggaataagatcaagagatcatagtacgtcaaataggtatagggattttggctttgactctgagaagatggagagcttttagaaggcagtaaacagaggagtcacatgctccatggctgctgtgttgagaacagactttggggacacaagtggaagcagagaggcagctaggaagttagtgccggtgtccaagtgagagacaagggtggcttggtccaggctgatggtatgggaggtgatgaacagtggccagatttgagacacattccaaaggtaaattttataggatttgctaatggactggatgtggggaaggagcgaatgaaaggaatcaggatgtttgatttgagtgactggaaggatggagatggggaaggctgtggtggggcagtttgagagagaagctcaggaggtcaggtttgggcacgtgaatgtgagatgtctattatacattcaaggagagatgttaaagtagaccattgaatatgtgactctggaatcctggggaaaggagctgaagatagaaacctgagaattagtgtaaagatagtttttaaagtcaagagaccagacgagacgcctaaagagtgggaatagacagccaggagggggaccatggatggggtcctgggacacctcagtgctaacaggttagggagatgagagggggccaggacaggatgttgagaaggagctcaggtaggaggaggaccaccagggcgtgtggtcccccgcaatccagcacgtcaagggctcctgatggatcaagataatctgatcgagcaaagtgagagtcggtggcgtccctggcaagatcagggtkagtggggtggtggggcacactcatagctgagtggagtcgagagagtaagggagaagaggaactggcgggcttgctgtagaggacaggagagagctgggttggtcacttgagtgggtcaagagaggctttttttttctttgcaggtaggagaaatgatagtgttggagtgctaaggggaatgattcagaagaaggggggaattcatacgtaaggggagagaagagagttgcaggaggtacatcctagagcyggtgaagaatggaaagaggctacacagggcttcagagtcaggattccaggaggaagggctccacgcacagagtgcatgatttaacaccacccatcaccttgggcaggctcagcccwggtgttggggctgctccttcaagaggggcagggcaatggatcactcacatggacgctcttctttgtggagcytcctgctgtgaatttccgagtttcctctgcccggcttctcccaccgtctgcaycagaccttctttccactagcctgacctcaggtagcctctcaaactctggtttctacctcctgctcatatgcagcaattactgtgatgktactaattccagaactcagctttcttcctgcagtttttgctcctctcttgtaaccccctaactcaaagtcccctgtacttcaaaattcaaagtttatctgtaatttctaatttgacagcttgggaatctctcaagcaccctgcatgtgttccacaaatctggggaacctaaaccctcatggttcccgaggcagagatggctggcagtcatcagcacaggaccaagactgcaccccactccttccatttgggagtagaatgtgagccgtgacgcatttacttctgagtcaagatttttagaaagtgagagtgtctttttcaatgttttattttattcttctcttctgctggctatgtgcagatgatgacgtgaccytagaagatggcagagccacacaatagaaggcgtttgggttcctgaatcactgtatgaacagagccacccacagaatatgaacatcctccctggactgtcataatgagtgaggaaaaaactttactgtgtttgagcctttatatatttggggtctattcactactgcagctagtgttaccttgagtcattggtgccttgaattacagaactgccacaacgaaattctaaaatatgttagcagttgagcaagagggatcatggaactgttcgagctggaaaatggttatctatgttatgcagtggcaaaacattgggtaaatctgttgcatgttgttatggactgaatgtttgtggtctcccctaaattcatatgttgaatcctaaccctcgaagtagtagtgtcaggaggtggggcctttgggaggtgactaggttgtgagggtggagccctcatggatggggttagtgccattataaaagaggccccagagagctgccttgccctctttctaccatgtgaggacagagtgagaaggatccatctataaatcagaaacagggccctccacagatacaggtactgcctgtgtcatcttcttggacttcctggtatctagaactgtgagaaataaattcctgttctttgtaagccactcagtctatggtatttttttatagccacccaaatagactaagacaactataaaaatacagaaggcagaacaaatcactactgaggctgtgttctatgggaaaagaatgaaaaaggctggaatagtcatggttttgggttgtagtattttttttttttttttttgagatggagtatcactctgttgtccaggctagagtgcagtgatgcaatctcggctcactgcaagctccacctcctgggttcacgccattctcctgcctcagcctcccaagtagctgggactataggcactcaccaccacccctggctaattttttgtatttttagcaggggtggggtttcactgtgttagccaggatggtttcaatctcctgacctcgtgatccacccgccttggcctcccaaagtgctgggattacaggcgtgagccaccgtgccctgctgttgtattttaaaagctgttacaagaaagagatgagctcaggcaagacttgattggttggagcacatgaaagggaatagagccagaaaccagaaatttgtggtctcacagggttagaagggccaacttctagaacccaaacaggaagaaataagactgaaaaagattctagagatgaaggcccaatacaaatgttcaattaaacaaagagattcaggccaagggaaagtccagagtagaaatgtttacttcctacgtaggtcgatatctttagatgctctcagggcagctgccttcaaaggtacctctcatcaagatgggtgtggagggaatggatcctgtgagcagtagggctgcctgtcttcaaattcactgtgtaaacctggatgacaaagagtgccaaggaggtgtgtcaggctagagaccagaggctcttcctctattggattgcaggaaccccctgaagactcttcaacaaaccgagagctggggtgagcccccaccaagacaggagggagattaaatttccctctaatctgggtgtatatgaggagtctgagacagatgaatttgatttgccaaaaatggagagagaaggctgggcgtggtrgctcatacctgtaattccagcactttgggaggccaaggtgggtggtttctctgaggtcaggggttcgagactagcctggccaacacggtgaaaccccatctctactamagatacaaaatgagtcgggcgtggtggcgcatgcctgtactctcagctgcttgggaggctgargcaggagtatcacttgaacctgggaggcagaggttgcagtgagacgagatcgcaccactgcactccagcctgggcaataagaacaaaactccgtctcaaaaaaaaaaaaaaaaaaagaaagaaagaaagaaaaaggaaagcgagagagaagcacagtgctccttacgccccagggccatgggacttgctcgtatctgcagttaacacaggaacaagcacggtaccagaattccccatcatccagagcagtgtgacacagacgyttctgctcagctggaccaacagaacgccactccggagaactaggagtaaacaaaattggtgttcaggcagaggtcatgatgaagagcaacaatggccttgatgtggaacccacagtgtgcggttatggaggaaataagacctgcttagtaactactcactgggtcccaaaaatgcacccagggatgtagcggcaggtgagccactggcccccaaataagagggctggtcagaaagtacatctccaagtgttgctgatggataaaatacccctgaggatgatctgaaccaccgacatggaagattatcttgggatagtcacaaggcattgcatgcccgtggggtagcagaagagcccggctggaagccacaagtctgctgactttcgtgcttggcctccaacttgccatgtgacctggagcagtacttggcccttccttaatggacaagctgacacttggaaaggtgataatgccttacacctgcccatgcttgatgttgtctgtacccggcaccttttgtatgtgacctcgctggcaagccaggtggggttctgtgagctaggtgtgcccgtcctgcagataagagggctcaggtaggcccatggaaacactctcagggaagagtaggggtaggaatggctgcctgtcactctccaaactcaggatttgtgactccaagttcattgcattttctgtgactcccacagccgcctccaaatagttcaaagtaggtcaccactgttgcggtgctacagccaacgtggcagctccctctcatcctgtgatctcaactcaacctcaggggagtgctcaggtgatccaaggggaggatcagccgggacctgtctccaggtgctcgggccagggtcagaagagtggaactggcagccattattttcttttggagccattatcctaagtggctcacacccagataattggcctgacaggctggccatgcggtgccttcaaccctactcacatgtcaccagcagcacagcraagtcagggartcgggayggcgcctgcccctcccatcacccatggaggctgcatgagtggaagacaaattttattccagccttggctctcagtcmctttcttgatttctacctctgtgagtcccagaaaatgggagacaatggcccattttccctttataggctacgatctcaaagttgaggggcactgcacatcttacaacgtgacgcagtctcactaattttggtttcagtagttctctgtgctttccatttctgccaggagagggaggccaatctctttcctcctcaacccatctcagctcatctctgccaatgcttcttggttctcagaaggcggcagccaaggccagagcagaggatggtgggacgagagcctccatggggacmatgacagcctggaaagcacaggcctgtgtgccctgccctcacgctggggtctggctaatacagcagcggctgcaccatgtctggygacctggtagctgtgtctggactgaagacaaacactggctcagttttaaccaagttctagactagcttcagatttccccagaagctcaggggccatggatgtggcaggaaagggcttcaggagcccaacaagcagcggacgagcaacagcytcaggcaggccctgccacgcacccacacaaacatccctggttcttagtcacctggtccacttcccaagggaccagagctggaggagctgtggggacacacacagaaaaggcagacctttcttgataactgggggccaaaactctggttaacagctctgtaatagataaaattccaattccatgtcctctattttttttcctttaaaaaaaaaaaaaaaaagagatggggtcaacatgctctgttgcccaggctggaatgcagtggtgcaatcatagctccctgcagcctcaatctctcatactcaagtgatcctcccacctcggcttgctgacgtgttggaattataggcatgagccaccatgctcagcctcacttctatttctctgctgggctattgggcctctgccatggtcagtgaccatcagagagaatcctatagttacatgctaggtaatatttcagggattccgacactccaaatacacacacacacacaaacacacacgcayttatgcatatgcacactgcttactggagttactcacaactacagataaagcttttcaccatatcactgggttataaacatcaccatgggaggtaacacatttatgtattgacataaatacaattcgtgaaagttagagtgctgttgtaaaagtctttcttgagaatcaaccttgatgcaaggtgggcctgagggctgaaaggggaggaagaaggggcacctcagaatcrggacaggatcctgagtcagagcccgggaggatagtagacaggccactccttcacatgtctgcacaagccagctytggccccacacgccccgggaaccagccagagaggcaggatagggtgactgacctgtcgctccaygacccgttccactcaacctggccccaagggttccggattcggatgagctcgattctctggcctcggaagcttacctagaagggaaaagcatgagggaagtgtgaaatgataaatatggtggaggtttggccacattcatctatgagctccaggtggaccagctccatccagaactggttctgttgaaagtctcttgcctaaaatgctgctgaaggtatgtagaagttcgccagttcttaaccagcccttggaaccttctaattcctattgaataattgctactattgccaatgatattatattaagcaccaaaatgcttatgccacatctgggaagtaaagtagaattgcaattaacaagaaattagtccatatgaatctaaaaatgggtttctctctagacttggatctccctagaggcaggagccaagtcttaggcatcttcagcatctagcagartgaatggtaaagagtagtcctcaaaggtgctcatggaactattactgaactttcttcatcctagcatcccatgcacagatgaatgataagaaaataagcacatgttggggatttaaacacaacaataaacaaaaacagcttttaygtcttctagacccaatattctccttatttcaggtgtctgtgaggattcctgctgttcacctcaatcacccttgagcctgtgtgccctcaggctctgcctgggagcagggacaagggccaatgcatttgagaagggttttagaggagagagrgtgaaagtaaaagacttctagttatcractaaccagaaactgtagcagtcagaatgttttatcctcatgcatttggcataaattatattttggatgtgtaaaaattcaagtaacatcaactcttcrgagtccaagatgtggcttgtggctcaccattaaaggggctcatttaatttgaaaggttcagggcaggtgagttccttgtaggggggagaggaagcaaaatcaagcaaaccaagatgatgagaggtttctgttgttacgtggaatacgtagaagatctaacctagaaacatcacatgccygcttgagtgagcaatctgcaagtcatctatggatggtgaaggaggacaaaggagccaacacaaatagctaacattctaaagaatcccaaagagtccaayggcgtctcacaccttggctccagtgaggaggaagggcagrgtctcccttcagtgttctttactccccacgcattcagaggatgtcactcaaaaggtgggtggctacagaagaccaggtgcatctgcaccttctaagtactgggcttgagactggtccagggaggcatggagtgggcaaggcaggctgctgggctttgctgagcttgagtctggcagagtgatacctttggcttcttgtcctcctctttcattcaattctttcttwctcttccccttgtgcccctcaaggatctctcctcctaaccaacagctcccttgaagtcagggtggtgctgtgtggagtctgggtgtcccccaggatcagttccaccctgggctacagctacaagaatgggactcgtggtgattaattttatgtgtcaacttgactgggccatggggtgcccagatatttgctttaaggttattctggttgtgtctgcaagggtgcttctgggtgacatgaaatttaagttgattgagtaaaacagattgccctccccagtgtaggtgggcctcatctcatctgtgaagacctgaccwgaacaaaaaggcagaggaagggggaattcactctctcttcctgggtgcctgagctgggacatccgtctctcctgccctcagactgggacttttaccattggtgttcctggtggctaggccttcctttcagactcagaccagaactacaccactggctttcttgggcctccagtttgcagagagcagatcgtgggacttcttactcttcacaattgcatgagccaatgccttacaataaatcgtattacaggtgatcctggaacaatgtcaggggttggggtgccaaccctcctgcattgtcaaaaaatcttgtattccctaaagctgaactccgaatagcctaccattgaccagaagtcttatcgataacrtaaagaaccaattaacatgttttataattatttatattatatactgtattcttacaataaataagccagagaaaagaaatgttatcaagaaaatcatagggaagaggaaatacatttactatttattaagtggaactgggtmattgtaaaggtcttcatccttattatcttcaygttgagtaggctgagaaggaggaggaggagttggtcttgctgtctcaggggtggtagagatggaagaaaatccccatataagttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaattgggaaagaaaggaaattaaaaataaacaaagaccaggcgcttacagctgctaaacgagttttgtgctgcggtggaatcacatggtttctctctttcctggcttgccgttttgaattccagcctgcctctttaggtgacataatctctgaaatgcctgaaaggcagacatttaaactgcaatgcactgaataaatgcctaagggattagcattgtcacatgtctccccatagcctgcagttggagttcaagtcgcctacctggtcaattcccgttacactgtaggcatgacccttaataagaccaaacggcgtccgggcctcagattctgcagyacttctggtctaaaacatggraaragcagmgtcacacccaccgtctaagtcaagcctcccctgctggatcagacccagctacatgcctggcccrgtcacaacctccagccccttctgctgccccaggtgcaggccatgtgcgtgggctatgcacggggctcccctaggatgtttagcagtgacatgaagcaagttccagtctcttcccaggatggggaggcgctcgcttccagtgtggactccaaagaacagttcactattttgtccccaaacagaacaacttgtcaccttcatgtagtatagtgtgagagagaagacacaatcacatacatcccagagacgaaaagaagaatataacaacaggacacacagctctgcgtcacaaacctgaaagtgcagaggaactggctaattcattagcaaaaaacagaccccaaggctaatctaagaggaaacagaaaactagaattgattaaaaaaaatacatagtgtcatagcagtccataaaaaacaacaaaaagttttaaaaagatgagataaaattataagtgtgtgtgtttgtatgcatagagaaaattttaaaaaatatcattagacttctatctgctatttttttcatagtacatgaaatgaaaaaaaaaaaacaaatttcagaaaactagatagraagatcccrtttcagtaaaatcaaaccaactgaccttgatgtttgtgtgtggaagtgtgtgcctgtttgtacgagcagatagagagctgggaaggatacaggccaggtgatcccagtcccagggtggagctggagaacagaggcagctgagaaacgggtgggagggaggtaaaaatgcgcctgtatgggcctcaagattgttccatctgatacagcaagtacatcttacctttgttatttgacgactattaaataaaaacttgtgttttatttgttatttatttattagagacagggtcttgatctgtcacccagcctggagagcagtgacacgatcatagttcactgcggcctcaaactcctgggctcaagggatcctcctgcctcagactccagacacacaccaccatgcttggttaaaacttgtgttttatttatttatttttattttattttattttattttttatttatttatttatttatttatttatttatttatttatttattatwctttaagttttagggtacatgtgcacaacgtgcaggtttgttacatatgtatacctgtgccatgttggtgtgctgcacccattaactagtcatttagcactaggtatatctcctaatgctatccctcccacctccccccaaaacttgtgttttaattagcaggaataaacactgcccccaagagttatgcccctccttgggtgtggctggggtacctggtacagccccagcatagtgcctggaatgcactatgcagccycagcatagtgcctggaatgggagcccatgagcaacttacatcartgaagcagcccagcagggagcctctcttcaaagccttctctagaatctcatagaagttctcgggggcctctttagtttggaaggtctctgccacacccccrgtgaagtcttccatggcctcgatggcgctgcctcccttcagagcttcatagctcccatttagcctgcaagggtggcaagagagagaggagagagtcagggacctagggaggccacyrgggcaccctgctttcagagcttttctaactaagcctgaagcatctcccagggcttgccctggctgggtggtgtggaaggaagacgggaagcaagttatcagggtttgtttggagcttcgaggaagccaaagatcctgaccttcctgcaagggaggcagtgtggtgtggtggtatagagcagcagctctggtgcctgagtggccgcaggttcaaatcctggttctacgacttaccatctgaatgaccaagtcgctagtgccttcattttcttatatgcaaaatgggggagagagttgtgctctcccttctaggactgctgtgaggttcaaatcgtgtgtctcactctctaacctcccatggaacggggcctggctatgtggatagagagaggccctttcccttcttctctggtctcacatactcctaaccatttttgtcatagtcatctcttttattcatatgcattttacatatatgtgctctgcttgatttttaaataagcttttcaatttagaattttagaatctggtgggaggtgactgaattatggaggcgggtctttcctgcactgttcttgtgatagtgaatgagtctcatcagatctgatggttttaaaaatgggaatttccctgcccaagccctctttgcctgccaccatccatgtaagatgtgacttgctcctccttgtcttctgccattattgtgaatccttcccagccacgtggaactgtgagtccaattgaatgtctttcttttgtaaattgcccagtctagggtatgtttttatcagcagtgtgaaaacagacttaatacaatagcttatttgggcttctttagtttttacctaatgtcctttttctgttccagaatcccacccaggaccccacactgcactgagtcctcacatatccttaggctttttgtggctgtgacagtttataagactgtccttgtttttgatgaccttgacggttttgaggagtcctgggcaggcatactgcaggattagaatttgtctaatgttttttctcctggtaagactagggctattaaagaaatgataaatgcttgaggtgataagtatctcaattaccctgatttgatcatcgcacattgtgcgcttgtaatcagaatatcaaatgtgccccatcaatatgtatactattatgcactattatgcatccataaaaataaaaaatgaaacattttttaaaaattaaaaaaatagctgggtgtggtggttggtgcctgtaatcccagcatttcgggaggctgaggcaggagaatcacttgagcccaggagttgcaggctgcagtgagctattacggtgccactgcactctagtctgggtgagagagcaagaccctgtctccaaaaaaaagtaaataataataaaaaaaagagtggggctattggttagtggaaggaagaccggagaggtaaagctsccctctcatctcatsatatcaagagtacctgccgtccacatgccttaccacagctgatgctggccttgatcacctggctaaggtagtgttagtcaggtgtctccactggaaagttgctccttctctcccctttccatgctgaactctttggaaggaatcattatgtgaaggccgcatgaaaaaatcagggagttatactccacctcctcaaggatggaatataaacataatttatttggaattattctacacaggatatatgttccttcttccacatttatttatacaatcatttattcaaattagtatgaacccattgatatttattttctacttgggtttattttgtgtttttttgttttgttttgtttttgtttttgagatggagtcttgctctgttgcccaggctggagtgcagtggcatgatctcggcttactgcaacctctacctcctgggttcaagtggttctgctgccttagcctcccgagtagttgggattacaagcatgcaccaccatgcctggctaatttgtgtatttttagtagagactgagtttcatcatgttggccaggctggtctcgaactcctgacctcaggtgatccacctacttcggcctcccaaagtgctgggattacaggtgtgagtcactgcacccagcttctacttgggttcataatccagtactgctttgtctatttcgttggttgaattcttctagctttggctgtttggagctccttcagtatgctcttgtgcccttttggcataacctcatttgtgtgtgtgtgtgtgtgtgtgtgtgtgtgtgtgtgtgtgtgtgtgtcttgcatgtgttctcattttctggcactataagatgatctaggttcattttatgtatgtatgtatatatgtatgtgtatatatatgtatgtatgtgtgtatgccccagtcctagaatcagccttatctccaagaagccccagttcctttgattgaagaatgatcttagaaaccaagacttgagacataggtgtgcttgttgctacaggattgtcattgcttctagttcctctcactgacaaagcaaggaaatacatatgtgtatgataacccaagtatagatcaatatatatgtgtatgataacccatgtacagatccatgtatctctacataaccatctctgttaagctaaatctaagttcattctggaatctccaactctaatctgcatggatcattctggcctcctccccttgcctatctgtaacctctcaatccaacagtgagaaactcggctcccgccatccaccatccgttcactcgattgttcagctcaatatacatgtataattagatcaatttttcatttgtactcctacaagaaacaattttagcaactagagcatagcactcacgtacagtttcttttgcctttaatcttacagactccactgatttccaaagttacttaggtcagcacctttctctccaaccccttcaatgaggttatttcatacgtttgaaattggctctcatagttacggacgccaagaaatctcacaatctgccatttgcaaactggagaaccaggaaagctggtggtatcattcagtttgagtccaaaggcctgagaattggggggttgatgatgtaagtccaagtttgagtccaaaggtttgagaacgaggagctccaatgtccaagagcaggggaatatggatgtcccagttcaagtagggaaagggaattcacccttcctttgtcrttttcttttatttggatctttagcaaactgaataatgctcgtccacattggtggcagcaatcctctttactcagtctactgattcaaaagctattttctccagaaacactctcacagacacacccagaaataatgcttcaccagctatctgggcatcccttggcccaatcaagttgacacataaaactaaccataacaccatctatacagtttttttttggtgagctgttctgccaaccatttttggcctttttaartgaccccaataaatcttttttatgtttagaaactagatggcacacagttkctgttgccttgcttgcatcctgatgtggggggcactcaccaaggggcagaggtgggcttgggtcccacccactggacttggaaacagtgccctttgtccccttaagcctgtctggtggcactgatggtgtttgcacagacctgggtgggacagagggcaagcgtgggcatctttggttcttatttgatggctttaattctgtcctgctgatttcaggattaatttaaccacagtatgmctcccctctattttgccacttttatgtcccacttggaggtagaagcaagaccatccttgcttctgtctctggggatagtattctcatggcttgaagatccaggctgaacctgaaagtggctcccaggagctctgccatcatctgtggatcaaattcaggctgttgtggcctttcactaacgagctagtgggctggaaattgagagcctgaggaaactgaggccatttggctggtgattaaaaatgaatttcttggttccacttatatgaggttcctagactagataaatcataaaaacagaaagtagagtggtgttgccaggggctgggggaagggaggaataggaagttatttgttaatagggacagaatttcagttttgcaagatgaaaaagtgctggagatagatcgtggtgatagctgcacaacaacatggatgtacttaatgctactcaactgmacacttaaaaatggtaaaatttatgtcatatacattttatcatatacgattatttatcgatatgtcatatacgaytttttaaaaataaaaaagaagcatcccgtaggacggacaattgatgtctctatatcmacgtgcgtaatagcccagatgtttgagccatgccagtgtccgagggaagtgtgaagcactaagtgctgtcggcacagccagaattcccctccgcttgccttcccagctcttccaaaggccagattcatggcccagggagaaaaagggtcatgaatgtagcsactgctcccaaagatgggcacatctaggctacgacaggaaaaccacctccaaccccgcttgagccctgagagggttgggtcctgccgagcctcacctgcaaacccagagccctgattttttcccagcccttagatgctcactacaaagactagtrtagagactcctgtcgggaggctgcytgagctggggaagctgtcactcacttggcgtaggctttttccagcaaggcgctccagaactcrttgtggtcggcagagtggaggaaaaccaagcggtccctgaaggtgggcaggcggtcatcgatcaccacgtccagccactcactgtgctgccagaactgttgcccaggaaaaagacagaaatgatgygagtcagctacatgggagctccaggccctgtttgtaaatgttgatcctgttgcttttttcccctctgaccaagctacccatagacagctttgaaaatcacacacgggttccaaggtagggcacctgggctttgtccwccaagttacaagctgagtattccacccagcactaaccattgacatcagctgaaagactcagggtcaacccatcaaagccgcaggcgatgcagggggcaggacaggactcacaagtagacactctacggtgctctgaattagtttttcttcttcacaagaaagttgtttttgtgggggagggagaatggtaacgtggggtttgggtttgctgttttgtagcccagttctctgttattctctcccatccagtttcagggtctagctccaattttccttaaccttgctccctcctcgcccataagtggagcccctaagactgatttgttggccattcacataggaggcaggtggactcagtaatccctgcgtgccagtgaggagacatgagtggagtgtgggtgtgtgtgaatgcatgtgcgcacacatgtgtatacatgtgcatacaggcaggcatgacaggtatgtgcactgtttgtggtttatttatacattgcatgtgtgaaagcrtgtgtttgctcacatgtgtgcatgtgtgtgcatgtatgtgtgcaygcatgtgtttgcaagtgcttctacacacgtgtgtgtttgagcacatgtatgcatgtgtatgagcttgtgtgtggtctgctgggaacaggaagggaggttggaacgagtcaaggaccatggtagtttctctgtgtatcctgcagtgacccacctcctacccgttccttctggttcagttggcctgagagcgatcctaaggtaacctctaagagtaaraagaaaagggttgaaagaggagggtaggcacagtggttttgggagccatttatttacagctttgctgtgtcatcctgagcatcttgctgcatcagtgattcaatcccaatcagaagagttggccacgatgtggctgagggtgtctgtgtgtgtgtgtgtgttttaaggaagattcttgtcacctgctccagctggacctcccctccagggcttcccgcttttggggctatccacagcttcaggtgggactgaggcacagttgggttaggtgtttaaagttcgggcctgggccttggggttcctgagcaggggagcagtggggaggagcctcagggctggctttccttgcagaggggctggctcagggggcctgtgagtcaggagagattatctgccagcccagagagctctgctaacttcctagcacgcacacctgcactgtggctgaggagtggaagaggagtgtgaaggaggtggatttatttccaaagctctgcttcctagaaggccaaggaggggagcgggcggagtattgttattgcgggactgacaggcatcaacagggtcactccccacccccacatgatccctggcagcacaaaaggatgctggatccagaactcctgagttctaggtctggcttggctacttattgttttgtgaccctggatcaaccacttccactccctgggactcagtgtcctcgggagttaatgagaggactgggtcaggggattgccaaggctcctcccagctgtgacattcaagggacaagaacactgttccttttgggagcccaagaggtggtggttctggttctggtttagaggcagtagttctgctggttctggttctggtttagaggcagtagttctgctggattttctgagcttaaccacccccaacactgccaccctggtgtgtttaagaggactggggaaagaccggctcctgggggcgccatcaaaccaagactgtggtctcagcagaagtcacaggatgggaagggagacagccaggtggtggcaggtctgtgagagagcaggggtagagtttccctgggacccaaagtggctctgtccccagccggcgcaggaggcctgacccctgggaattgcatgctccctgagctacatgtgacctgctcactctctttgcctttgaaacacttctgtgctattggtgacagggcttgagagtacctctgcttatcagattgcaggcytcagggacagaagaaacgggctggccctgagtggtggcctgtgagtcaggagaaggtgacactgtctggggtggaaggtcaaggaatgcctactcggtgcctggctctgtgccrgctcctgtgtgtgatgccatttagctctacrggaagcctgcagggaactgtcagtctctccttttttcagacgagtgtagaaaggtttaatgtcactaagaaaattgtctgaggtcacccacctaagtaagaacaaggggcaagtttcagtatctggtcgaaccctatataaggacaggggtggaggagagactggagggatagaaagtgaggtgaagcagcaggaaaccatctcctgggggcaagcctctcctgatgtgcacctcggctgagggtctgcgggtcacacgggactccagcagatgttgtctgtatttttctcagtttttattttttaaaatccctcaagatctccaaatttacaattcttccataaagagaacctctctgtttatgagaaatcaaccagtttcctggaggtataattggtttagtcaatttgtgcttaaagcacaagaaattccaaataataaaacccttaacagatggacctccagatttgccaaaacatcacttatagttttaaatgtatgctccataaggattcaccgtgcaatgccgttaatgttcttctgaggcatttagctgttattccatgataaaatgtggctttagcatggtttaggaccatatgtcacacagatctgatgacatttttttctagggttaccaggcagtgtggaaatgcacctgccctcatgcygggccccagagaggtaaacccactggcycagggctccctcttacctggaaatggaatatcccggcataaccagggccaaakctttggtcctgggggatgactctggccagtgctttttgattaagcgtaagggaggcgatgrcggctaatagccagcagtctcctgcaaaatggaagccataaatcacaattttcattgctatttcacagcaaataggaaaactctgtgtcagaaggggatgtggggagtttcagatgtggccacatcttttctacctgtttaaaaacagacaggacaccaacaaataactctctcctccccttctgcctcccttgcctgctcttctctgcccgtctatcataaacagctgttgccttcttggcactgttataggacatgcttacttgggtttcagacatatggctgcctgatgcatcagctctgtraattccagcaactccctttccagaggwccaagwctgcatacatcagtgtcagcaygggctgggcgagcagacatttcatagctgccacccaagtggttcggcagtacttgggagggtggttagaaatctccctgcagccccaaccragacwcagcttaattacagataatggtatctccgtggtggctccatttgctttaaattatcttgcattttcaagatttattgactgacctactgaacttcccagctgtgtcttcatgttaacacacatctggaggaaaactaaaaagtgaagtcaaacatcaaacatgattttatctgtgctatctgtgctgttccagactcctggaggcattcctttgcccacactgagtgtgggctgtgtctggtgtgtgcctcacagtgtctcagatgccgcctgtgtaagcagatatctgggaggatccatttatccgaatcacctttatccagattcacttgttttcagtagacaacatcaacgtcatcagaacmtaaragcccatcacactcagcttggcagtttctgagttcacatttctggaaagcaccgtatgtcactgggcttgggacattgtaatatggccytttctggctgtttgacacaggcaagagagactcgccagggcygaacatcgggaaagctaattccgaatcgccctggttctggctttctgagaggtgtcaccagcagagtacaagccacccccagccttagctggagcacagaaggattggtttctaatgcatctgctggtctttgggagcctcaggtcagctttgggagatgctactaggaagtgacatggctggaacctgcaggatcgtttgttcagcaaactttaccaagtgcctctagggtggcagaccttgtgccacgcagaagatgcaaagataaggagagacttggtgtctgctttcagcttcagggcggccaggccaacaggagtctaatagagtgacctctgctgtgggctgacctttcccagctctcctccaagtttcaactttgcccagttgaggaaaatgagtgttttccggcctgagaactcaacacctcacgtgttttcagccagaaatgctctgagcttttggcggggagattgagaagccaaaacaagattgcttttctctctcttgggcctgggcagatggatggggctggccacccagctgtgcctggaagaagtgccctctgtgggtcagcgtgttgctcggctatctgggtggtgcagagcagagggcactatgggaggagcaggctggagtgaagtggcaccatctcggctcactgcagggggaacgctgtgcctcttgggttctcagggaccccatactgcagtcgctcttgatccagcaatccaacctccctctcgccatgctccatcccctcacactcacccagctccacccctacccccaccccctgcagataacagcatgccttgatgctgttccaagtgtgttctagttttttttttttttttgatagagatgtggtcttgctatgttgcccaggctagtctaaaactcctgggctcaagagatcttcccacctccccctcccaaagcgctgygattacaggtgtgagcactctacatgaccagatgttctagttcttattgtgggtggcaacagatcacggctgttcattttcttgttattctttataacatatatatgccatgtacagtactttggtgtagtaaaagtgttacaaaataatctttagaatcaaccatccactaaggtaaaatataaggttgtaactccaaatatatgtttatgccaatgtgacaaaccaaaactttgaaaaacaaaggagccagtagaatgatttcctattggatagcaatggaggactacggggtcgaggggaagggaggcagaggaagagggggasaggtgggcagcggcagggaggatctcctggagaaggaccacctgaatgtaaaccttttgaaaagtctacattgtatctagaatatggcatacatgggggattggttccaggacccctgtgtataccaaaatctgtgcatactcaagtcccacagtaagccctgtggaatctgcctataccaagtcagccctctgtatatgcgggtttcaaatcctggaatagtatattttctccyttccttccttccttccttccttccttccttccttccttccttccttccttccttccatcctccctccctcccttcctccctctctcccttccttctttccttcctttttttcctttttgtttgtttgagacagtgtcttactctgttgtccaggctggagtgcagtggcatgatctcagctcactgcagcctcaacttcccaggctcaagcaatcctcccatctcagcctaccaagtagctggaactatggtcatgcaccaccaagcctggctaatttttcaattttaatttttagtagaggcgagccctcactatgttgcccagactggtcttgaactcctcggctcaagcgattctcctgcctcggcctcccaaagtgctgggattacaagtgtgagccatcacgctcagcctggaacacggtattttctgtctgtgtttggttgaaaaaaaatccacttagaagtggtcctgcactgttcaaactcatgttgttaaagggtcaactgtaattccgtctatcatccatcatctatctatacccatccatccatgtatttacccacctaccttcctatcattatttactaccatctatctattattatatatttattttgtatggtctatcagtcaatcaatcaacctatcaacctatttatctatctaattatgcatccgttttctacctatcatctattacttattatctatgtttctatctatctatccatttgcttctctctctctctctctctctcaattgtctctctgtctagctaattaactaacatcagtctaggtttgtgactttggatcttgtgtttaggatagctcagttgctcagcatggaggttccagcatggcctttcttaaccaatagaccacagtgacaacctcagctagaaataagtcagggtccacacaagcttgcagtggtttgttctctaggctgatttcactggtattttttaaaagaaagtctctcgctctctcactytctctgtctttcatagatagaacaaaggtaaacccagcccagttggattaagtcctaaaatgcaggacccaatttgagtgacttgaggtgcactcaggttcattgcaggagggagactggattgctggggagcggctccccagggtgtgtataatggttagcagtaagggctctgctgctggagtgtctgggttcaaatcctgattgcctgtctaccacctctgtgaccttggacaagttacttagccttcctcagcctccatttcctcatctgtgacgttaggagggtgggttgtgaagatggaatgaggcaatgtgtgctggggagagtacctcgcaggtgactgagttcatgtgtgcaggtgttagctactgtggtggtgtaggagagcccgaccaacgctgctgggtgtcactttcctctgtaaactccggggctgtgagccccacatcacaggcatgtctgactctagaggaacrgaggtgcaggggcttgaggccactggactccattcagagggagtgaggaagcagaggccraagcagtgttgttcccccagccccrtgcctcttgggtcctcagggaccccatgctgcagttgcttgcctgtcccagtgactcaacctccctytygccatgctccatccacttacactcacccagctctccctggcagatatcagtcctggtggcccctccaagaatgaattctgggtttttcacgatttcctggaggaatgagagtgttattaggctgaggcctgccatgctgcaagccactatgaaagggtaggctcagggtctctctgctttcttggggcagagggctttccctgtgcttgattcttttccctgaggagggccacgtggatgtaaaaggctgccacctctctatgctctggataaggctgggctcatctttggtaaatctcctccgccggggagaggtcctgcctcctgagctgcactcagcaccaatctctggccagaaacacaggccacacccggccacaaagctggacatcagccacacactgaggattcctgtgctcactcaggcactgggctaggagtccagggctatcccagctgtgagctctgtgacctctgtgggcttcaaggagctgagtaatgcatgtaccacaggctggggccttggactaaacatactccctacccacccakcttctccatttctttctttatataatccttcccccacaaagtggattccaaatatatataggtttagagacagaatcttgctgtgtcacccaggctggagtgcagtgacatgatcatagctcactacagccttgaccttctgggctcaagcaatcctyccacctcagcctcccaagtaactgggactacagacgtgagtcaccacgcccagccactttttaatttttttttttttttttgtggagatgggggtctcgctatgttgcccaggctggtctcaaactcctggcctcaagtgatcctcccgccttggattcccaaggtattgaggttacagacacatgccaccctgctcagtgtttctttttacagagatgcrcttaggtaaaatttcatgtatctataccatataaagagagatatgcacacatctctcatattgtttcaccgaagtgcattatatatatatattattctatattacacataagcacatacactatgtgtattaatgtaatcattaatacatattaatatatacatatacaatatggaggggtatttataaaacatgaacaaaaaagtgtagaaagcaatcttatgatatgcatatattcttccactctttgagttgctgggctccattcctgacattggacgacaacaaagagagagggaaagcccctgccctggtggagctgccctggacgcggagggcggtgctctcggaagccccgccccttcccagcctcctgccccgcccctcccccagcctgcctcagccctggcctcacccacggcgcccactgtgcctgcagctgccaccacctcccagaagctgttgtttcgttcaggagagttttgcaaattgcatttgaggaagagacaaaccataaaccaggagagaaaagagcgaggatggagagggaaggggtgggatggggcaaggstagctacagcagtcagcaggggaggcgtctctgggggaagcagaggagcacagacctaaacaaagggagggagggagggagggagggagraagccgggccggtcycgggagaggtaacagccaawcctgtggcagcgaggcmcgttctggctcaccctgcaggggtggtgagttaactgggccggggcctgcagaggagtgaaggatttttcccacctcttcccacttttccaggcaccaggactgaggaggggcctgggctggaggtggaaggttccagcagtgtctgggcggacgccaygtggggagctcaagctgcgccgccttccccgagagacctctgctttgaattgtcttcctcaggcttctcagcaccctgcttctcctctcatcttgtgtcccaaagaatcaaaggcaggacagagatttctttgaagtcaaggggattatcaggaccaagagcagaagcttcaaatgctggtgctctctctgcattccccaggatgtgacaacctggaggagtgacagacaccaggggcgcctgcccagggagagctatgtgtggcattagtgtctaaaatactcaagaaagcttggccaggagaattkctgaagaacacggggtgtttttagatgcgccaaaaccccaggcccggcagaagtaaggacctcccaaatgctggcctgtcctctgccaggtctcacacgtctttgcattcccacccccagctccaggtagctttggcgccatttcattaaatgactctgatctccgtggtggctggaaagggagtgaaggtggggggcagctgctcagttctggggtcctggcttggcttgcctgtgcggacccctctcatctgtaggaagcrcactgctcttcttcctcctccaccttggctagcgcaggagtttgcaggtggctctgagctgagcccagaaggacaatgcaaaccaggaccatgtcagtgggcctcaatagagtcccaggaatagcctgcccsgctcagcagtagggttcagggtgggccatttaacttctcacggctgcatcctcatctgtcaccagcttagacattctgggcttgytgcagaatgtgcctgcccgaagggaaacccaggagtcccccaagccctccctgtcttgattgcccagcccctgccaggggatagccmtggcaagcaatgcccccactgccaatgctactcactcctcaagtggacataaaatgtactccaaaagccacagatccctgcccagcaggctgtgctagctcctggggcagggctgttcccggatgcccgcctccttcccatcctccctgcccctcccctcccccagccttctgcaggcctggccccgccaaccgtaccaactgtgcctgcagctgccaccgcctcccagctcctatcttgcaattggttgttttgttcaggagaggtctgtttttgtttttgttttaaaccaratcgcacccaatgaggagaaaaatacaaaaggaaaaaactcagaaactctccaagtaaacacaaattagccatcgggtataaattggggaggtgtctggatgtgtgaccgactcctctgtgggtcagtgyttctggkaattggtgtgcacacgtgccagtcacagggggttctgcggacgcatgtgtggaaggggcagctaggcggtgggcctgggttagatgcctgggagtggtgtgtatgctgacggcccacatgcccacatgtgcaaggtgcctgtgacttgccttgttgtrtgtgcccaggtgtggtacacgtgtgtgcttgtgcatgctccacatgtatgctggttgcatgtgcacttgggagcattgtctacgtgtgagtgtcctgcatgtgcgtgtcgatcctggatgtacatttgttcctgtgaaatgttgcttgggaggccatgaggaaggggttacctgaagctacagtcctgtgataggacgatcagaggtgtctcaattgcaggggtcttgacaaacctgaagtgaacctagactgctgcctgaagccccgagggaggcacgcagacccctccccctccccctcccctcccccaccccacagccctaccaccaggtggttttcctggagcactaagggccaagcaccctggaatgtttgctttcagggactgttctgtttaccttgtacatcatcggggctcagccgaagacacactttcctctactaagcacagtgaataattcacaaagggaaaagccacccttctttctttctctttctttctttctttctttctttctttctttctttctttctttctttctttctttctttgtttctttcttctttctttctttctcttcttcctttctttttttctatctttctttctctttctctccttccttccttctttccttccttcctcccttcctcccttcccttccttccctttccctctctctcttcctctccttctctctttttctctttctttctctctttctttttcattcattctgtctttcacatggccttccagtgaagaaaagccacatttccagcaaggtctggagatgccagacgctgctgttcatagctatgtgccgatccctgtcatgtgcccagcactgtggaggccatggggcctttggggctgtcccagaacaactgacaacccctcctgggggtcaggggagcagcacagggaacggcaagctcaccgtgcaggagaggctgtggtcacatgccacgctgtgcacaggtctgccacaggggttgttcacatgggctagaggggtgtgggcactttcggggaggtgtcctggatttacactgagaattggtgggggggaattgcctggccaaaaataaatgggtacaggcagacaaggagggatggactgcatggtggctgttccccatcaggctgggagacctcacccgatactccctcctcctctttctgtgcacccacttccactcaggtccacagtcccttgcatgagacctgggggtgatctcaccttctctccaggttgagcctatcaccctctctgcctcccagcccctcccagccagttccctgagtcaccctcagtgcactccttgccctgggctcccttgagggcaagcctggctgtccactgccctccaatgtccccttggctttgtgctctgcccaccctccccaagyacagctgtgtttgacaagaaggtggtgctgaggaggagggccgtccagccccacggtcccacgggctgctgagaygtgcaccgtgtaatgctgagtccyactgcaaatgatgcccaagccacagaggtctgcagggaacctggcaatgcttgtgatttccctatggcccgctaccccccggctccctgcgactctatgctgcaaraagagtctccatgctcatcctcagcccttttgttcctgattttacagaaatctgtaagatatgatgtaaagctyctaactcccctaaataagaaacagataggggtacgrgaatgaggaccagaccaaagggacaatcttcagttgcagacaaaggaaaaggcagaacagattctgaaaatgagtctgtgggaacgacagcaacacagtagacctgggttaagatcaataaagggtctgccgtaggtggagacagtgggatgaagaagggacagagggctggtacaggggcatgggctgggtggcaggtcggggtgcatcttggcaggggcttgtgtgtatcaagggccctggcctgtggatgaaggcctcacccagcgtttggggcaatgccagaggagataatactaaggaagacagccccttggagcagagatctgggactctagagtcgctgggsaggccttggtggccctggtcccaggagggragacttctgaagggggagacaaagatgccctccatgctggtttgtgcgtccagcttttatctyggagaattctaactttgacaaaaagtaagtgagttgtagagtacagattacactttaaactagatgatgtcaatatagactgcaaggatgggggccctcctagagtcaggagacgatggtgttaggttacaatgacagcagtagaaataacaaggaccagcactgattctttacacaccaggctctttgctaagtgctctactcatggtaacgcagctgaccctcatgaggaccccataagttgcattattgtccccattttaaggaagagaaaaagtgcttccaaccttttcatatcaagtgcctgtagagaacatgagcatctgtatgaaaccctggatcaaacagaaagagccgctgcttctggccaggggctctgctcaccaggggcccaggaaatcaatttctctaactctatttcccagggctcctgacatcaactgcagggaaatctctgcccacagttaaaaatgcacccacagcctgcagcctgggcagctgcccacgcgcccatttgttcatgcgccgaggccggaaataagcccagggagacctaatggtcgtgggcggtgcccctcagagggtcactcttttatgtcttgtaacttctgcttttttagtttggaaatgtcctttttcttacttagcagagcatgacctactaatcctgtctgtaaagtgcaaccccacgtgatctgccagtrccgtgacctcacactgcaattggccatatgcagagaaccaaaaacaatcacagcgtggcttcggtgaggaaggtgcctgggagctttcaccccaactccgatagggccactgaatgctcactgtgatttccccatgaacatggcaccttgtgggatcaattacctggcaggtgaagatcaaagcacctgtgtgcctatgcatgcagtcacccaccccccacatacacgcctatgcatatccacacacatgtgcacacagtcacacacatgcacatacacagtcaaattcctacacacacaagtgcgtgcacacacatacaccccacactgcctactgcaggaaatagcaataaaacccttaccacttcggaaacacccacttaggttcactttggccctgcccctgaagagcccagaagttttgtgaatgtgcgttaaaaaaaattgtttttaatcatcaacattattttaatgttgggagatagtgaggaggtagttatgatgagtcctttgctactcatatgtaagatgagaytcagagctaataatcattgtaatgatgataataatagtatcagtaatagtaataatgtgacaatagctgtaatgtactggaaaccttctgtgtgctagacattggcctgcrttagccattattgttcccattttacaggtgaggagactgaggctcagggaaatgaagtgatatgactatatgcatgagacaaattgtcaggataagacrggcactcaggatctcacttgtaggaccagcatcccttgtactgcccctccttgcccaaaagcaaccggaccccacaggagccactcccaggcccgtacmcacctggagggaatggaagccagcccagctggcgccgggtcagaggtagagccctgactaatccagcaccgcaaatattgacatggcgtcccaggcacaagctagcacctcttgggacccagtgaccagctggtgcctcttgggacgacacctccagactgtcagaggtggggcactgttcaccctgatctctgggaatggggggtgcatggttctygggagaagattcctgcttcccttgtattccatctgtcacccggttgctgagaccttgctgagccaaacatccatccacactgagcaccctcagctctgggccagaagccacagaacactgtgcataacgtgatctcagtgttaccacacacagggtgggggcctgtccttgtggataaggttttgattcgtgcctatcacctgctgacaagacccactctgactccaggtcctcagcctcggtrggagtcagacagcttggagccggggagcgggtacaaccagatgccccsggtccccaccgcagagcatcccaggcctgtacattattttctgcctccaaactgcaaagctttccacggtagactgggatgatgcamctcagttgcactgagcgtagccggcccctccccagcacccctgtttccacttcctgcgggggctgctgarcctcggcctcatctrtgctccttcccctgctcrccccactcacccctggtcgtttccacacaaaggggatctgcggcctctcactgtagaacagggaggaattgctggctgggaagtctgcatcctcaaacagggtgcctctctgcaggcactcctgcctcatttgctcaaagctctggcctgaggagtgggtgatccgggcgtccttgggaaccgggtgtgcctgaggccctggggcccggtagaggtaaggcatggctgctccctggaaggctggcttgggtccggcagtggatggaaaagaaagtgaagaagcgagctgtgtgtgccggtcaagaaggaacagctcagagggccactgggctgagtggccctcacctccacctattttctgggcacctccctgttagactgagatgggacacrccctgatggaaaacagcagagagagccctctgcccactctgcactcctgcagactcagaggcagctctggggcctggcacattccactcagaggcggcacctctgcttagtgcgctcagggggcctmatgggagagagaggattgcttcagaaggaaaaggagcaagaaacccaastggtccaggaggtggctttacggagaagtgcacggtgtggycttgagtcccatctcctgcatcagagaatggcagagttttgtagtcggaagggagsttggtgaatgaaagcaggatgcattatgtgaacacagctggcacagctcctgcacaggcaatcccatagtgattcagcactggggtcagcaaaccttttctgtaaaggcccagaccatgaatattttcagctttgtgggccacgcaaagtctgtgctgcaactactcaacttwgctgttgtagtgacaaagcagccgtagatgtgacacagatgaatgggtgtggctgtgttccaataaaactttatttacaaaggcaggtgggggttagatttcatccaacctgacccctgatagaggagaactcacagaggacatcggctcttcctctagggcacatgtgcctctttcrttctctagacatcatattaataaagttccttgttgttatagtcctacaaataggatctcacgtctgagaaaaaacaaatgttagaggatggaggtggtttgataaatgtgtttgcccatagaaatgattatacaggctgggtgtggtggctcacacctgtaatcccagcactttgggaggccgaggagggttgatcacccraggtcaggagatcaagaccagtctggccaacatcatgaaaccctgtctctactaaaaatacaaaaaattagcccggtgtggtggcggatgcttgtaatcccagctacttgggaggctgaggcaggagaatcccttgaacctgggaggtggaggttgcagtgaactgaggtcgtgccactgccctctagcctgggtgacagagagagactctgtcaaaaaaaaaaaaaaaaaaaargaaaaaagagagagagagagaaagaaaagagagagagagaaggaaagaagaaaagaaatgataaatactggaggggatagatagcctaaataccccaactcgatatcacacattctgcacatgtaacaaaatagcacatgtaccccatcaatacrtacaaatattatgtatcaataaaaataagtcaataaaagtattagtcaccacgtgaaaactctgatgttctaagcactttataatgatttctgtgtgattctctaactagtcaaagttgaggtttggagacaaggggtcttgagttaatgggtacagttaaaaggccatgatgtgaatttttatataagctcacagttcccaggagtgtgcactcagtctgacacacgttctgtctagtagatcctgcatatggttttacaggggaggtctagacattagagttggggatatttgggttttactctgctatggcctgattgcttgtattccgcaccacccccccgaccccgccaaaatttgtatgttgaacccataccctgcaaggtaatggtattagaaagtggggcctctaaggggtgattaggtcagaagagtggagccctcatgaatgggattggtgtcattatgaaagattaggtcacagagggccccctcctcccttccaccatgtgaggacacaggaaccagaaagtagaccctcaccaggcatggaatctgccagtgccttgatcttggacttccagcttccagaactgtgagcaacacatttctgttgtttataagccaccctgtctgtgctgttttgttatagaagcctgaatgaactaagacaaattcccagttttccctggggtgatcttgggcgagttatccatgctgtctgtccctgcttccaagctgtgaatcaggataatcggtgctgcctgctagaggcatggcgggtttgtggaarcaaagccacttgcaaagtctggcacatggaggggatcaggagctgctgattcctccctttcccctatcctctctgcaccccctgccmctcccacagatgctgctgaatttcatggtctccttctgagcctgacttgcctcaamttgcaaggcatctcttttgtctctttgtttgcacaatgaaggactttggaactggggtcctctggctgggaccagagtgcagttctggccagtccaaatgattcttggctagagatgatggagctgcccaggagtgtcccattgcccactgccctggcagacggctctgtttcgaagtgattaaggagggcaacctagggagacaggtgtggcaatgtgagggccatccatttctggtgacacctcggcagggaaatgattaccagcccagatctctgggagcatccccttcaaatgccccagcaactgagaaaggaccttgaagtaaatttcagcactgaccagaactgtaaagggtttgctcagcaccagacccactcccagcttcagggatttacgttctcattctcctcccgatacaaacacctctccaggctggggtcttgtccttccacctgggacttatctatgtattggaagaacctgcctttttctttagagtcttagtatagttgctaggtaattggagaattgcatcatcattgtgagtaaaacaaacatgcctcagagtaggaaacacaccaaaaaggtttaacaatcctccagaaccacagctggaattcctcctgccccctaacactctgggactctgagaatgtctgcgggagggagtgcattctcaggatttacagcctcatcattcttcctgcccaatgtctgcccacagagccctgggtccatctttcctgcagagctcatggcacyggacttctccatgactttgtcttagcgtctaatcctgctcccagctcagcccagtgcagggcaggagcacgatgcacatttgctgagtaaacattgaaccaatgcctcaagaaagcagatggcattcttgggtgtcttcatttagttttccaaaccttcacttctcaggatgaacaatagttacagaaactgcagccatgcartctaaggtctaccaggccttgcacacttcctcacccacactgggaaatgccctgagtggctcagagggaaagggctctgagcttgggcagagaatcatgtgcactgtttttaataagctctgccagcttgtcgctagcctagagatgcaatcagctttgagccaagcgggggccatgcatcatgttaagtgtattttcttctctttagcagagcaatctgctgaagtgatttctacatgaaatgaacctgacctggcatctggggccttcctggcctctcttttctgtgctgttctttctctgtctcctccacactcaggcctstggcgaactccctttgtttctcttcttcttgttcatcttgaagggcagcaggaggtgaacatagtgcctgsgtggctctgggatgccatggggcaaaaccccaaggacaaatgctcrgaagcttcacatgggtgcagggagatgacctctaggaccccacccggtccaggccttacagcagggcctgggttttgagggatatgccaaacagcctggatcctgcagagggatctcagccctatgatgggctgagagtgagcccacccggctgcgacatttgtagccccttggcttgcagtgtggaggatggggtgggctggcgaggagggtggagagtggagaggcaggggacctgcacaggtgtccaggtgagaggggctgaggctaactccagatgtaaccagagtgaaggcaggaagggacagattcttctagaagtactgtcagggcgttctgctggggtgcaagggtggaggtgtaaaggtggcgtcctgccttcagacttgagcaaatgggtgatggtggtgacagaaggaggagaggcagacttggaagaaaagttgaacactttgggtatgttaagagtaagacgactgcgtgcaatggctcacacctgtaatcccagcactttgggaggctgagacagatgggtcacctgaagtcaggagttcaagaccagcctggccaacatggtaaaaccttgactctactaaaaatacaaaaaatgagtcaggcgtggtgggggtgcctgtaatcccagctacttgggaggctgaggcaggagaattgcttgaacccgggagtcagaggctgcagtgagccgagatcsagccacggcactccagcctgggcgaggagcgagactccatctcaaaaagaaaaagtaaaacacccccctacttgctgaagggagtgtaaattggtgtctcctttttggagaactatttatgaatacctctcagagctaccaatgcacccactctgatccagctgtttcccttctagaaatttatctttatcctgatgatagagccgcaccccgaaaagtgaaaggtataccagcttgytcatttcatggtggcattgtttacattaaaaaaggttggaaagcacttagtgccctctgttgggggaatggtraagaaaattatggtccagctaatcatgaagtggaacagtgtacagccataaaacggaacaaggaaactctgcatacactgatgtgggaaggtccctgggatacagtgttcaactgaaaagtcaaagtggccgggtgcagtggctcacgcctgtaatcccagcactttgggaggctaaggcaggcggatcatgaggtcaggagttcaagaccagccttgccaacatagtgaaaccctgtctctattagaaatacagaaaattagccaggcatagtggtgggcacctgtaatcccagctacttgggaggcagaggtaggagaattgcttgaacccgggaggtggaggttgcagtgagccgagatggtgctactgcactccagcctgggtgacagtgcgagactctgtctcaaaaagaaaaagaaaaaagaaaattcaaagtgcagaatggcatgtagagtatgccagcatttgtggagaaagaaggcaaaaaatatttatttatatctgcataaaaatttctcggaaactacacaaagatctactcataatagtggttctgttttctgggggtaggtggagtagatgggggtagaggaatgtggggagacttttctatatgccttttatatttttttagctttaaccctatagatttacctggttgaattttttaaaattttattttagagtcggagtcttgctctgtcactcaggctggagtgcagtgacatgatcatagctcactgaaggcttgaactcctgggctcaagagatcctcctacctcagcctccccagtggctgggactacaggtgtacaccacaacactagccttaactgttgtcgacttttaaaagcctagtttgaaacttaaagcccacaatgatgttttggcctaggtgggctctgccttccctcccccgtgtatctctcctcgcaagatgtctgtacatttgcaaaggagcttatctgtcctgagggccacccccatttcctagaagatgagaactagatcttcacccagaccttgcttccctatccatcccctcccaaggtcattggtaagcctgacatcaggtgagggtctcmctttcttcatccagggacttgtccatccctggaacactcctagtttcacccctgtcctagtgggcactcattcatgaaccataacaaatcttttcttcagtgggaatgagccgtgctcaggcatcacaccatagggtaagagccatctcctgaaaggcaacagagcacccagcccaaatctcccccacactcgctgctccacagggtgatgccagtctttggcctcagctgtctgactcaagagatcccagcttgtaggcgcataggctcgtggacgacctggtggttcccctggtttcccagggctgcacaagctgcctatagcttctctcagctctggccttgctttctggcttgattgtggaatatagtttcctccaaggcctaatctccctaagtaagctctagatcactgcccctatggcctaaggtgacaccgttgaaattgtacttccgtccctgagaagtagtttcactccttaaacattcattgttgaagaatgataaatatacctgtctgccttctgctaactctctgggatttctttccctggagtttgacctcagcccaagacgatttcctttctccttctcatctasgagctggaggttgatgctatgcacagatcttaggatgacttgaatcacaggtgcagcaggataggaatttactctccgcagtttagggcccaaaaaaatcctaatttttgagacagagtctcctctgttgccaggctagagtgcagtggtgcgatcttggctcaccgtaacccacctcccgggttcaagctattctcctgcctcagcctcccaagtagctaggactacaggcgtgtgccaccacatccagctaatttttgtatttttagtagagatggggtttcaccatgttggccaggatggtcttgatctcttgacctcatgatccactcacctcagcctcccaaagtgctgggattacaggcgtgagccaccgcatctggccaaaaatcctaattaaaaaaaatattatctcttcttgccctctggagtccccagttaccacctcgcaccaaaacttgtatttagattttgttgtgtgacactcttattcattttaaaatggtctctcttactctatctctcttcttctgtctctgtaaactagcagttacttcaaagttcaaatatcctgtaaggtttgtcagaggtgtttgagccagaatgtctccaacttgaataggggttgggtaaaataaggctgagacctcctggctgctttcccaggaggttaggcgttcttagtcacaggatgacataggaggtcggcaggtcacaaagatacaggtcacaaagaacccactgataaataaaacaagatgcagtaaagaagctgccaaaacccactaaaaccaagatggcgatgaaagtgacctctgttcgtcctcactgctcattatacactaattataatacattagcatactaaaagacactcccacctgcatcatgacagtttacaaatgccatggcaatgtcaggaagtcatcctctatagtctaaaaaggagaggaagccttgtttcagggaagcctctgcccctttcctggtaaactcatgaataatccaccctttgtttagcatatgaccaagaaataaccctaagtatactcagttgagcagcccatactgctgctctacctacggagtggccattctttctttacgtctttataaacttgctttcgatctatagactcgtcctgaattcttycttgcgtgaggtccaagaaccctctcctggggtctggatcaggacccctttccagtaacaggtccacttttccccaaataagtgatcttcctcctccttcctccttctgatagtggcatctaggtcagggtgaatcttaccaaacctgccactggagcagggacctctggctctctgggatcttcttggttgaggtgtctctgggaaccagcttctttccttacggtatttgctgtggaggggtcacagctagcataacttgtgtttcattttcctatcgggggcaatgcaccgtaattaccccggaagctcagcctggctccaacatttcccgttaatgatgagccctccacctggtttctctgtgcttgccgaacctcagaaactcatttgctcttctcagtggtccccagctttgggctctcagctctgcagactctgccacaccatctcatgccctgctcagggcaacaccctggtggacaaggtgactcttaattcccagccaccccccgccccatagtggaaattgtgattggacatttattattattattttattttagagacactgctggagtgcagtggcatgatcatagctcactgtggcttccaactcctgggctccagccatccttctgcctcagcctcctgagcagctgggactatagtcatacccagctaattaaaaaaaaaaaaaaacctgtagaggagggagtctcagtatgttgcccacactggtcttgaactcctagcttcawatgattctcctgccttggcctcccaaagtgctggggttacagatgtgagccactgcacctggccttattatgtttaattggagggaacattgataaagtctgttacatagtagcaagagtatccctaacatgccttaccactgagaaataagattctttgctgctggaggtgtgtgaagtttttctatagcagaaggagatgtaatttttttaaaagtcctttgactacagagatttttatattgtctgtgtacaatattactgggtttattaaaataatttaatttaaaatatctcatttgatttatcacctacatctacagttgtgtatttagttatgggacatacatctaattgaattcccatctttttgtggtaaaggtttattttcagcatctctttatgcatctcatcctttcccactctccattttctctttttaatgcaccattttctgattcttataaatgacgtatcctccccctttggcaaggtagcattagccagcaagcatacctaatatttgtgtggatggaaggctcaggaagagaactatttgtctctttcgagcttatggctttcacaaagtgtcatagcaatttttatgactcaactttcaaaagagatttattagcttgggtctctaggaaaaaataatttataaggccactgacaatcatagctgtgaagacataaagtaacatgataagcacttatttttatagcactttttacatatgagactaccatggtatgaagttcaattatgatgactgatttataaacatcatttcttgtttaacgtgggtaatttttaaaagtatgaactggtgagaatgtcaaatggtgcagccaatttggaaaagtgtgacaggtcctcaaacaactagacatagagttactgtaggagccagcagtttcactcctgggtatctgtcaagagaactgaaaacagatgtccacacaaaacttattcatgaatgcttacaacagccttattcataacagccagaaggtgcaagcaactaattgtccatcagctgatgaatggataaataatgtgtggtatatccacgtagtggaacattattcagccataaaaaggaatgaagtactaatgctacaccttggatgaaccttgaaaacattacgctaactgaaagaagcaagtcacaaaggacaacagactatggaaatctatggagacaggaagtcattagtggttgcttagggctggggatggggtgaagtgggaggggtgggggtgatggctaaaggctttctttttgagatgatgaaatcttctaaaattgactgtggtggtggttgcacaactctaaatatgctaaaaatcattgaattgtacactttaaataggtgaattgtatgtacagtatmtgaattacatctcaaagctatcttaaaaagataaataagctctgtgcctcattttgcctcctacagtgtttcgtaaagttgtagtactaaaagggagatttgatagcaataatgataataataataaacaggctgggcgcagtggctcaagcctgtaatctcagcactttgggaggctgaggcaggtggatcacctcaggtcaggagttcaagaccagcctggccaacatggtaaaaccccatctctactaaaaatacaaaaattagccaggtgtggtggtgggcacctgtattctcagctactcaggaagctggggccagggaatcgcttgaacctgggaggcagaggttgcagtgagctgagatcacatcatggcactccagtcttggtgacaaaagtgaaactccatctcaaaataataataataataataaacaatttctaagtattattcttagyagtcacctacgcatggcactttgtgcagatgactcctgcatgtgtcagggtttttcttgcgggcaatgcagtctgatcagtataaactaggcagagaggtatttgatgaagggtttggggaactcagaaaatggactgggaagctaagaaccaggcatggaaatgagcaagaactaggggagattggggagcaggagcagaaatggtcttgcaccagggtcagaaatgcctgtggttgaaagtcagctgtcttcagcgttcaaacctctgtgctccagattccagctccagggtggttggcttagtgggtacctgcctctcagcccaaggagaacagagctttcgattcacagagcttccgattcacagaatttccagcctccactcaagaacaacagggatccaggtgctgaaaagggatagatgcctcccacagactccagggaagcattcagttgtgaccacctctacccttttaagggatcgaagcccagcctagcaggaaactgagctttggggctttgaaattttgccccaaagtgctgctagaagaattggattagataggataccaccatgtcactgactacttagggggaaaagaaagctgaggtagtgaaaacatttaatgaaatcctgaacacccagagtaacctatttcttccttgctccgttcccatttatatctgagaactgtgttcatgccccagatgttgcaagaatactgcggaaacaaaagtgttcgaaataattcttttttttcgagatggagtctcgctctgtcacccaggctggagtgcagtggagtgatctcaactcactgcaagctctgcctcctgggttcacgccattctcctgcctcagcctcctgagtagctgggactacaggtgcccgccaccatgcccggctttttgtatttttagtagagatggggtttcaccgtgttagccaggatggtctcaatctcccgacctcatgatctgcccacctcagcctcccaaagtgctgggattacaggtgtgagccaccgcgcccagctgaaataattcttatgctcaggatcaaaatgataaggggtcaattgtattaaacacacacacacacacacacacacaaactttgccttaaacataaatgtgtttcagaagcttggaagcagaaaataattttaggagctgagtattattaatcagcctatgtgttttcaactgcaccaagaaatatagcaaagatatgcaaactctttggatttaagacatcacctttgtgttttgacactctttcccaaaccccgcctaaatgacaggtgggactgttttcttttaaacagtaaaggcagggtcctgagaagacacttgaatggggcaattggaggagtgtttaatcgatgaactatttacaaagatgtgggcaggaagaccatgatagactgagcagttggggggctggaagcagcagggtacccctagaatctacagctctgagggggtgaaggagaagcagtttcaggaaggagggcgggatgggagctgatgggggaggatgcagtcacctgaggccaacctaaggggaaggagaagctgtggagtggaagccagggaaggaagggagccctgtgacaccatctgtgtaatcagcctcccaggaggtggagcagggtgacaagtgcactccgagggaggggccaccaggtgagtcagcccagggcccagctgctaagaccaggggcaggcctcctccaagtggggttgggcaggggggcaaaggagaacaaaaaagccactttacctacttctgtattgagtttttaaaaaagactgtattaatttacattgtaattttaaaataaaaatgtaaaaatattaaacatgactcggaaatcattgagtttgaggatctcatgagaagttgatgacccttcttgaggtaactaacgacactttggaaggtgaaaccaggttgctcgcccactctaagaaggagcgagaaggaagaaggagaaacagcactgtgcccccttctcccgctgcagtcggggcgagatttccatgctctgggaggtagtggaaggaagcgttcagtgaggcccttaaagacaatggccctgccagccagttgtgatgttgacaatgttctcctgcaggagggcgggaggcctataaagtaccaagcgcagtcctccatgagcaacggggaggcgatgagcgaccctctcctccagggatagacacagaccctctcctccagggataaacacagccagttatggccgggcgcgatggctcacatctgtaatcccagcactttgggaggccaaggtgggcagatcacgaggtcaggagatcgagaccatcctggccaacatggtgaaaccctgtctctactaaacatacaaaaaaaaaagttagccaggcgtggtggcaggcgcctgtagtcccagctacttgggaggctgaggcaggagagtggcatgaacccgggaggtggagcttgcagtgagccgagattgcaccactgcactccagcctgggcgacagagcgagactccatctcaaaaaaaagaaaaacaaaaaaaccagccagttatatttaccagctattaattaaatttttcactggaagcagtcttgccttgtacatagggatgaaacacacacacacacacacamatacacacaccatatatatatttataaatgcatatataaaaattatggtaaaatacatgtaacataaaatttacaaccttaaccatttctaagtgctcagttcattggcatcaagtatatttgcattgttgtggactcatcacaccatccatctccacaattctttttatcttccccaactgaaattctgtgcccattaagcaaaatctccccattctcccctcccccagcccctggaaaccaccattctattttccgtctctatgaatctgactattctaagaacctcgtaaaagtggaatcatatagcatttgtcttgttgtgactggtttatgttacttagcataatgtcttcaaggtccatccatgatrtagcatatgtcagaatgtcctttctattttgcttgaataatattccatcgtatggatatgtcatattttgtctttctatttatctgttggtggacacttgagttgcattcaccttttgtaaatataacacatacacaatgacacacaaactccagtatgtgccagggacccgcacttgttaaagggtcatctataaaagagaaagagaaaatacatgtgccaacctaagtgagaagatgagaagcttcaagaagcttgagttgggcttctgtgcatcacaaaggtggagcctggactgtcatctgggcccggcctcttgggtagtggtccctgaatgactggcagaacaagaacatgaaatggtctccacgcagaagacagccacgtggaagtggctgactggtagaccagctgagatgaagactactccagtcytcacagcggtgctcaaatggccccatcaaatcaaatgtaatgaccaggcagagactagggtgaaaacagttgtggaaatccatttgtatgtctcctgtaatatatgattggattagctcatcccaactcaatgaacttcattgccaagttctccagaggaaaagtctgtccttctagtgccttctgttttcacacaataagcaaggatgacattttggcgtgacttgttaaattgtagcaaatgagacaactgtcagggtgtagacaaaggcaaacaaatcacttagtgatttgtcgagtgaaaatcgacctcaactaaaggcgctcactggagtctccttgtggcatttctcatgggcacttgctttcataagcatcgccctttgatgttattttgctaggagaatgtggaaaagtgtatttggaaacactgagtttcagagctgatagtaatgctgtatcatttcaatcagaaaggaattttgcaaaaaggaactgacttttttgtttgtttgtttttgagayggagtttagatcttgttgcccacgctggagtgcaatggcgcaatctcggctcactgcaacctctgcctcccaggtttaagtgattctcctgcctcagcctcctgagtagctgggattacaggcatgcgccaccatgcctggctaattttttgtatctttagtagagatgaggtttctccatgttggttgggctgatcttgaacgcccgacctcagatgatccacctgccttggcctcccaaagtgctgggattacaggtgtgagccaccgagaccagcagggactgacttttaacagatcagttatttaagcttgtcctctgtgcctgggatggttttaggtacctgtctgcattcactgtgttaatacagtrtagtcctcaaataccgttggtccttgaacaacacagatctgaactatgtggggccacttcttggattttcttccacctctgccacccttgagacagcaagaccaattccttctcttcctcctaagcctactcaacctgaagatgataagaatgaaggccttgatgatgatccacttccatttaatggagagtaaatatgttttctctttgttacgattttcttartaacattttattttctgtagcttactttgtgcacagtatataatatacacagtatttaatacctacgacataaaaatatgtgttaatcaacattagattatcagtaaagtttctgatcaacagtgggctattaggagttgagtttggggagagtcaaaagttattcttgcattttcaactgcgaaggaagtcagtgcctctaaccccagtgctgttcaaggatcaactgtagttcaccaagaaagctggggttgatcccattccagccctaccctgctcttggtgggcacagagagttgtgagacctacctctggccagacactgttctatgtgtggaaatattgcaatgaagaagatcaaccmtccaaatgctcactgtggccaggctcggtggctcatgcgtatcattccaactctttgggaggccatggtggaatgattgcttgaggcccagaatttgagaccagcctgagcaatatagcaaaactctgtctctacaaacaaacaaataaacaaacaaacaacaaaaaataatgctytctgtacataaaccagsacataagtaatataatttcatgggatgatagtcactatagagaagatargggtggtgcagtggaataaggtgagatagggttggtgggcagggctcttctctgggggtcatcagacgggtgaaatttgagctgagatatgagtgatgaggagccgctgcacaaagatgctggatagagggaacagcaagatttgtgycttaggaagctttgagtttctgtgggttttgttgttgttgttgttgttattattttttttgagatggagtctcactctgtcacccagtttagagtgcagtggcatgatcttggttcgttgcaacctccgcctcccaggctcaagagattctccttcctcagcctcctgagtaactgggattacaggtgtgtgccaccatgcctggctaattttttgtatttttagtagagacggggtttcaccatgttggccagactggtcttgagctcctaacctcaagtgatccacccaccttggcctcccaaagtgttgggattacagacgtgagccatcgtgtctggccaagtttctgtgttaatggacacagaagaagtcagcacagctggaaggcagaggacaaggaggtgcatggtccaaggctgtagagagaagggcagcagccaggtcgtgtaagtgactgcacacggcaaggattyaggagtttcctctcattgcaatgggcagccttggggagttttcctctgggaggaaatctcatggatttatactgaagaaatarctggctatgtgctgtgtgataacagatggaagggggctggaggggaagcagagaatcgggttgggaggcctgtgggaccgctagaagccacccctgcactaggtaaacagtgtggacctgaaagggacaggctgaagcacgaagtgtgatttacaaatattactcgagccagaataaagacagctgcctggaagcctcagacacaagtgaccttggatatgaactccatttggctttcgtcacaaggtttttaaaggaacaaaaagggaggagtcagggagtggcctgatacaaagttctgtcaggagttctcattggtttccagaaataacattgattagtgataggctatacattattaagctatagggtgtggtttacagtgtccagtgaggcattattaggttaattcataactactcttggcaatagcaagcagtttcagtggatgaatacatagctcaaaaggggcatgtaggatgcgattgatgtctaattttaatgcctatctgggcctaataatttgaaaaggctcacatccctcagataaaagttattttctttcttcaacagctgtgggcactgttggagaagtataatggaaaacaaaatctcccaacccagaaatcctctctacaaaggtagcaaagaaagaaaacactctcattattgagaaaaacattaaaccagaaagtgttacacaccacaagcaatctgctaagagacagccaagacagaaaggaagctcacctgcttatggagccaagcagacacagctcgttccacacacgttttcaagacggacagtaactgttaccaactgagtcagcttttcccctaaagatggtatcgtgaagccaatacatgaaacccaaagcgagcctcaagcagtgcrgactttattcaatggccaaagaatggagaagcaggagcatggccgcaagtcaacttcttgtctagtgagaggtgagggggttaaaatatagggtatcytggctgggtaccctgcctcacgcctgaaatcccagcagtttgggaggccgaggtggayggatcacttgagatcaggagtttgaggctagcctggccaacatggcaaaaacccatctctactaaaaatataaaaaacaaaacaaaacaaaaaaatagccgggcatggtagctcacacctgtaatcccagcactgtgggaggctgaggcaggtggatcacctgaggtcaggagtttgagaacagcctggccaacaaggtgaaaccctgtctctactaaaaatacaaaaattagccgggcggatcacaaggtcaggagcctcctgagtagctgggactataggcgtgcaccaccacgcctggctaatcttttgtatttttagtagagatgggttttcaccgtgttagccaggatggtttcgatctcctgacctcgtgatccacctgcctcggcctcccaaagtgctgggattacaggcgtgagccaccgtgcccaggccgccttcctgtttcttaaagataagatagagaagacaggttagagaagagtagaaattcagctatgtcatgtaggcattacactgggtgacataagtagtaagagaacttgacaacactacttgtcacacacagctcattctaactttacctggcaactgaggtgaccatctgtattagctaatgggctttatctagagaaaaacaagcttcttacatctttgtgacaggaggcagttttgcagcttggaggcatgtgcccactgaaggcaggctstcaccctcccacagacactgggagctggggccactgtctctcccttgatgtttgcctttcaaggagatggctcccgggtccttgagaaacacatgcctgggtaatcaagctgacaaaagtcctmtctgatcttcacaaaaatgttatatacatttgaaagagaggagaaagtgcttataattacaagttttctaaggtaaatgctctgagaataagagagggagggaaayctcttcccccattttcaaccgggagaattaagcctcttgtttttaagttgcatttgtccttacagtggctactaggtgttgggaacactgcccgggagctaggaagagcaattagggctggaggctgtttggcgccaacaggctgttgctgagtgcggatgaaagtccagagagagagtggaaggtgggggtcaaagggcatggtggtgccctgcatggcagatggtggagaaactgcaccaggcaggtgcctcaggctttctgggtcaggggagagggtcaggtggccyttgaagttctgtttgctgttagcctgactgagttaactgcatgggtacctgactgtctttgctcagtctcctagtggacaaccacatttccggaaggcttttcacgagtgatatagcaactaatgctctcccagggctcactgcctggcaggctctgctccaaatgctttcatatgttaactaattcaatcctcactatgaggattctctactcccatgagacagggattgcagggagtataaggttgtgttggatgtgtttcctggcattagtaaaagaggatgtgaggcaagagcaaaactaatgcatgtgctgaaagagctatggtgcaaagagtacacacaaaccttttctccccttctctgtatgctgctgtggacactgttacaaagcatgaaaatgaggccgtagatgcaaaagcttaaaagggtgacccatacctcaaaagttctcagtaagtggcagcattttattatcgtggctatyattttgccagttatatcttaacaggtataaatattgaaacctccttagcgaaaattataacggtgagcaaattatgacagcggaggagatctgacctaaccatctccttcttgccttttaayctctaaactgtcctgggtcattttggggcatgggtcaagctaactttaggagaaatttagtttatagtttaaatgatgatagaccttcccaaaactaagtcatctttgtaaaactaatgaaaggccaccaggtcaaaagaatgagaggggcctgaattctgctgagatgtagacatagttaagcaatcaccagccgttattctggaggtcatgaaatttgcaactttctcaattactcctataattaacatcactmctctagaccctaaaattggccttttcagattccttttcagacttttgtatttctgaaaccaggtgactttacctggacccacgacccctacctgtggtccctgacctagaagcaggctcagcatatgaggaccattttttccacacccctatgattgcatctccaaccaatcagcagcatctgttctctagccacctgcctaccaaactatcttttaaaaacccctgccttcatatttttgaggaggctgatctgagtaataataaaactctggtgtcctgttcaggtggctctatgtgtataaaactctttctctattgcaactcccctgtcttgataaatcagctctatctgggcagtggggaagatgagctaattgggtggttacaatattacctcttcaatgtgactgaggttcttgaaggcaggaaattgtcatataatttatgtctcccatgtcagtaccttatatagggtaggtatcaataattactcataaaagatgagaattattggttccctagaagtcattttcccattcyaggcatggtgccttttaggggacakarctctgactgaactttatatgtcctccttagttagttacttagggtcttgatttcttctggaggctgtatttstcatttaaattttgctagatattatgcatattacttaagttttcacacttaatggcataaatctgtccctagtattccctctcaattttctaatctcctctgtaactgcagtctatttatatgtcctcagtaaatatttgttgagtctgatagtttttggttaygatcatggactagtgcagtgagggcagttggatattttcctcctgggaggacatctgggattcacaatctggatgtttggtatcatgagacaatctccctgccctggcttggggggccacccatgggttaaggcataagtaacaattcctgacaagagtggrgtcattaatgtctggagcaggaagctgaggggagttgtgtttttctcttgcctcaacattgtaggaggagagagaatcctttctaggcatcagggtcatccctgagcactcctggtgtgattttagggttctccaaggcccactgtggttctaatttcctgccaccatccctgaacatcccaccattcatatcctcagtgtagaaaacagagatggtaactttgactccagaaggtcaccattcacatgaccacttaggagaaaaggagaagggagaacttccagtattttatccaaattctttattcgtcactcagctagcccagacgtcttcttaggaagcattggragatatgagagagtggtgtggggtgggaagcaaatggttggggagacatagcatctggcttttttgggaagccctgctgggtttagacaaatctgcagacaggaggaagaatgagatgaatggcacttaagtgttattcctctccagatcatgattctcccagtttgaattaagactcktctctgagttttggaggagagatgcttggaaaggatgattgaagagattcattcacccattagactccctactattgattaaggatgtaatgaagtgatataagtcatccaataagctatgcttactatgtttttttttaaacatagtaaatgcaagccaaatagagccctctcccaccttagccagtagagtgacatcttaggatcttaggtgaagtcttttttttttggttcttttagtttttaaatttggaggattaggatgacaaaaatgacacctatgggtgaaggggtatggaaggactggaatgacattcagacttttttttcagtaggtttgctggtttaaaaactgtatctgaggacaaaatgcttggattcaaatcttggctccctaactaactgagatctgtcttctctgttctttgtcatcttcatcaataaaatgggggaaaataacactgtctatgtcttagggagaataagatggaacattgcatataaagtgtctaacacaagtcctggcacatagtcatcaataacttgtttattattgtgcttgttaaattccattcacctggaagatccagggatccattcaaagttggctctggctgccgtgatgccaagtgaagtcattccaattttgcagtctaaatagcacacactgccttgtccctaagagaaataccagccccagacattgtgaattgatcatttccactgaaccatttataaggcagagttgatccttatcattaaggtgagcaaagcagttgttgtgggcacttctcttcatgatgatgttcagtcatttaggtctctgtggaatggctggcaggaggccctaatggtgacagaaatcccagtgactactgtcctactggctctggttgggagcctttcctagcagtcctaccatgactggcctcttggatccactctgaattcttctacttctctttgcagtagaaagrcattaactgatatttctctttccaaatttctttgcaatgttttctgtagaagaactgaacattaaataaatattatttctagaactcagttttcgcaaaagatagcatttcagtcccacaagagcaatatttatatcattgcaactatggggcttcggtgggaaaaggatgacaatatttttccatttggatagctgtttcttatctaaacttattaaatggtgagcagaactcttcattgtagacttttcccaaccctgagtgccaaagcaaacacacaaagttcggaccactgacatgttgctgcagtagtataagggcaaataagtctgaatggagataacagacttggaaacggtactttgtgtctctactttcatggtccttccctctactgacatggaaatagcaccctaggcctgcccggggccatccctgaactagggatgcatcccccgtcaaaacaaactgaggacattggataattcacattttacataacagtattttactcagatttatgtggctgctgatgaattttcatcaaaaaagtattttctggaataaaatccattaaaccaatttaatcccttaatcaatttttatgtagtgtagttaaatcatttttatttttctaaaagttaatgaaacattttctatttttatttctgaaaagtaattttcatcaggatagattcttttccatttaaagcttataataaagagctaattaatcaattgatttttgtccccatcagattttcctgagtatagcttctgctactgtgagttttcttttatggccagatccaaagtttccttttgttttatttttcccctgctgtagtcaagtccaatgtctcaggctcaaattctgcacatctaaattttgccagcaatattctgtttgtttgtttgtttgtgacaatgtcttactctgttacccggactgaagtatagtggcatgatcatggctcactgcagctttgacctcctgggctcaggtgatcttcccaccccagcctcctgaggaagctgggactacaggcacgtgccaccaaacctagataattctttgtattttttgtatagatggggttttgccatgttgctgaagctggtctcaaactcctgggctcaagtgtttcacscacctcagcctcccaaagtgctggtattacaggtgtgagccactgtgcctagccagcaatattctttttaatcagttttygattggtgaaaaagtgactatttctacctataatattcattatggattggataaaacatattgtctaattattttggtgtcattatattcagaattcccagtatagtcatcccttcatacaggaatggaataataaaattatacattaaataagtgttgtaaatacagtagatgtttctaaagctaatttttaaatgaaaggacaatatataagtctakagctaactcctctgtcatgcacaatctgagttaacagaatagwttaggggttagcaagctttttctataaagggccatgtaataaatatttcaggctttgcagttcatatgttctctgttgcaacaactcaactgtgctgttgtagcacaaaagcatcctggactattcataaactaatgagcatggctgtgttgcaataaaacttgtttacacaaacagatggtggtccagyccagatttggcccatgggctgtagtttgccaatccttggaacagataaaygttcatgctattatttgtttagtaagagtattctttagttgccaggttgaccatgaactaccataaatagagagctcctggaatgtacattggaaaagtttttctttttgtccagtttttcaggatcacagctgttatacaaagctctgtgtaccaacaatgcatatatcaccaggctcatatacarttttcttagaggagctcaataccctgtggacttaaattaagaaccataaaactgcttgagagtggacaaagagaagataaccatttttcctatcttactgaaaatagaagcagaacaatcactcggactcacatcataggactaattatggatggagcatattagatgataaaataaaaactaacaggaaaggaaagcatgacactagctttggtattcagtcatggcttagagttactagcctcatctgggtatagcagacaagctctggccttaggaaaatattatactctacactttgatgactcccctaaaaacaaaacaactaaaacaattgtaaaaagcaaagcctattacaaagagggagccaaaattcaacatgaaatatactgtgcttaatagaattgaattcttgaataatgttcttctggcctccaagtgagaataaaggttgtgctatttaagaatgtttttcagctgcacataactgcctgtattagtccattttcacactgctctaaataaatacctgagacttggtaatttataagggaaagaggtttaattggctcacagttctgcatggctggggaggcctcaggaaacttacaatgatggtggaaggggaaggaggcaccatctttgtaaggctggagaagagagaaaagtgtgtgtgaaggaggaactgtcaagcacttataaagccatcagatctcatgcaaactcactctcatgagaatagcataggggaaatcgtccccatgatccagtcacctccctctcttgacacatggggattacaggtgcctcccttgacaggtkgggattacaattcgagatgaaatttgggtggggacacagagctaaaccgtatcattctccaccggcccttcccaaatctcatgcyttttcagatttcaaaaccaatcatgccttcccaacagtcccccagaggcttaattcattccagcattaacccaaaagtccaagtccaaagtctcatctgagacaaggcaagacccttctgcctaggagcctgtaaaatcaaaagcaagttagttacttccaagatacagtgggggtacaggcagttggataaattggccaaaacagaagggctacaggccccatgcaagtccaaaattcagtggagcagtcattcaatcttaaagctccaaaatgattgcctttgactccatgtctcacatccaggtcatgctgatgcaagcagcaaggtcccatggccttgggcagctccacccctgtggttttgcagggcacagcccccttcctggctgctttcacaggctggcattgagtgtctgtggcttttccaggtgcatggtgcaagccaggtggatctaccattctggggtctggaggatggtggccgtcttctcacagttccactaggcagtgccccaatggcaactctgtgtgagggctgcaaccccacatttcccttccacattgccctagcagaagttcttcatgggatctccacccctgcagtagacttctgcctggacatccaggcatttccatacatactctgaaatctaggttcccaaacctcaattcttgtctcctgtgcacccacaggcccaacaccatgtggaagctgccaaggcttggggcttgcaccctctgaagcaatggcctgagctgtaccttggccccttttagccatggcttaagctggaggggttggaacgtaggacaccaagtccagaggctgcacagagcaggcgggccctaggcctgcccacaaaaccatttttccctgttaggcctccaggcctgtgatgggagggactgtggtgaaggtctctgacatgccctggagccattttcctcattgtcttggtgattaacatttggcttctcattacttatgcaaatttgtgcagctggcttgaatttctcccaagaaaatggttcttttattttctaccccatcatcaggatgcaaatattcaaaactttyatgctttgcttcctttttaaacataagttcctatttcagatcatttctctcaagttcaaagttccccagatcctaaaggcaggggtaaaatgctgccagtytctttgctaaagcatagcaagagtgacatttgctccagttcccaataagttccttatttccatctgagaccacttcagactgaacttcattgtcaacatctctatcaacattttggtcaaaaccattcaacaagtctctaggaagttctaaactttcccacatcttcctgtcttctgagccctccaaactgttccaacctctgcctgctacccagttcaaaagttacttccacattttttgatatctttacagcagtgtcccactctctgcagtactaatttacttgcctaaaaatgctgcaaatagtactcacacaatagtgcagagataggcaatcatttgtactagtttaaataactctatatgccaagcaaaaacccaggtgttttctatcattctttgcttgctggcttttggtccttacacttgttgcctcatggttgcaaaatggctgttttgtctccagacattacatcaacatttgaagraggaagmagggttagtgtctgagccactgactctgctgataaaaggacagagaaagctctcccaaaagccctcaacagatttctgtttgtctcattggtcagaactatcttacttgaccactaatggttacagaggagagcagtgatgcaggatttttctyggyccctttgccagtcagggacctcttgctggtgatgctggaggccttgcttggggcacactacctgtccctggaggtgcctcacccaatcggcccccctgggccaggtctggcttgtataccagttcctgagttcttgtcccacgcccagaatgaatgaggctgtgctgaactctgaagggtgagggtgatggagaagaatttttttgaccaatgaaacagctttcagtggggaggggatgcaggggtggtctccctaccagaaggtgggaaagtcccccatgtggctgggtctggggctttttatggactcagaatggggagtatgtgttgattggtttatgagtatgcaaaaaaggttaaagcaaagactctactcaaaggtgggcatgacagtgtagaaaatcagttaggaaaggacaggtatatgtaaaataggtgaagggtggggatcaatcagaggaaagcacaccaaacaggaagacaagttctcaatctggtccaaggatttaagttgtagcttggctttcaggctttaaactgtcttcagcttggaggcgggatttcaccggggacccgccccatctgcctaggcatttggctgcctcctcctgcccttagtaggaaagtgagtgtttcattttctcaatttatctgtggatgtggacaaaggggaaaggggtagggaatagggggttgtagtcagcctccaacagrttattaccactgaaattgtgccctaaaggattaaagaagtcagtaactaacagaaattcttgagtttgcaaggtaagaaacaacttgctcaaatgctgaaactccctctgcttgtgagataaaactagcagaaatcagttggaaccaccatggccaactggagtttgcacacagtgagcttggtgaagtcacggcccgaatttctaccacgtgtttcatattaaccccttgaaattttctcatgggacccctgaggcaacatgaagagataactgtgcaaacctgaggattttctaggcctcccctttcctttcactaatcacctacaatcccaatatccaccccctaaaccttttctaataaaattatgccctgccttaaagccatctcagggagacaggtttgagcttgacccctgttgcaatagaaagcttttcttttgtcaaaaacccagagtcatagcactggcttctagtgcatcaggcagcaatcactttttgcttgataacaccatttttcataagtacctgaaactggattcactaattatgtcagctaatgttgacattgatagaggtaaacgactcatttcttatttataaatctgcaactgttgacaagaaaagccattggcttggttataacttttgaaatgtgctgcaattagccaggtgtggtggctcatgcctgtaattccggcactttgggaggccgaggcaggcggatcacgaggtcaggagatcgagaccaccctggctaacacggtgaaaccccgtctctactaaaaatacaaaaaattagctgggcatggtggcgggcacctgtagtcccagctcctagggaggctgagacaggagaatggcgtgaacccaggaggcggagcttgcagtgagccgagatcccgccactgcactccagcctgggcgacagagcgagactccgtctcaaaaaaaaaaaaaaaaaaacataatgataataataataataaaaaatagaaagaaatgtgctgcaatcacaaaatttcccagaactttatcttatatgaccgttttcctccagctcatggacagctatgtctgaatcaacagcagtccatagggcactgcccgaggtatcaggtgatgtctaaaaggattcaataggaggagcaggcatctgggaatataccaaaggaaataaagtcaacacctagtaacaatatctgcactcccaagttcaatgcagcattattcacaatagccaggatatggaaacgacttctgtctgtcaacagatgaatagataaagatttggcatactgtatacacacaatgggatactattcagccttcaaaaaagcataaaggccaggcatggtggctcatgtcttaatcccagcactccgggaggctgaggtgggcagatcacttgagctcaggagtttgagaccagcctgggcaccatggtgaaaccctgtctctacaaaaaagtacaaaaaagttggccaggtgtcatggcatgcatctgtagtcccaactaccagggaggcagaggtgggtggatcacttaagccagggaggtcaagactgcagtgagccatgattgtgccactgcactccagcctgggtgacaaagtgagaccctgtctcacaaaaaaaaaaaaaaaaaaagcggtgtggaactgtgccgcttgctacaacatggatgactggaagacattatgctaaatgaaacaaggcagatacagaaaggaaaatactgcatgacctcatttatatgtggaatcttttttttttttaaagtgaatatacagagatagagaatacaacagtggttaccaggagttgaggaggagagcagggaggagatgtaggtcaaatgatacaaagcagcagatatatacgatgaacaagtctagagatccagcgtacaacatgaggactatacttaaaaatgtcacattgcacttgggatttttgctaaaagagtagactttaygtgtccttgccacctaaatgagtaactgtgagatgatggatatgttaattttcttgactaccataatcattttactatcttcatatcaaaatatcatgctgtacaccttatataaatacaataaaaattattattaaaaaagaaagaacaggctgagaatggtggcttatgcctgtaatcccaacactttgggaagttgaggtaggaggatcacttgagaccagtagttcaagatmagcctgggcaacatagcaagaccctatctctacaaaaaataaaaataaaaaaattagccagatatggtagcatgcacctgtagtcctagttactctggagactgaggcaggaggattctttgagacatgatcatgccactgcactccagtttggaggacagagcaagaccccaactctaaaacaacacacaaaaatacagccatttctcctgggtgaaatgggggagctcagactattttgttttatttgtcaggagtctaaagcccatgtgagccaacttaagaaaattctgtttgtatttgagtgttctttattggaaagaaatggacttttccctaatgagcccattttacaaatcgagagctccaaatgcccggttccagcccccatgatatagatgggcagcaatgaggaccagaaatgctgggaagtgtccttgtcatgcaaggaaaacttggaacttcaaggatccatcatgggatgcaggacagtaggctccacccctcttcctgctttccagtaaatgatgttcagggctcacatgyctcttccaaggcatgatgtggggttgcagttctgatcccagcagagaacaaggctcctgtgaaacaattagttttggctcagaggcaaaaaatggaaaccccattcctgtatttacccttcattctttccttacctcatacagctggttccaggtttgattgcatcatatacataaataaataatctgctttcctggtttggtttagttttgctggagagaggagtttatgtgttcatcccatgactagctgggtggtcaagagattggaaagtaggagttctagtttagaccaagtctcatctcagaaaccacagagtagaactgatcccaaacgtcatcatccctgtagggaaaagaaagagagatcagactgttactgtgtctatatagaaagggaagacataagagactccattttgaaaaagagctatactttaaacaattgctttgctgagatgttgttaatttgtagctttgccccagccactttgacccaacctggagctcacaaaaacatgtgttgtataaaatcaaggtttaagggatctagggctgtgtcaaagtggctggggcaaagctacaaattaacaacatctcagcaaagcaattgtttaaagtacagctctttttcaaaatggagtctcttatgtcttccctttctatatagacacagtaacagtctgatctctcttttttttccctacatatcccaatagcacctgcctgactaatacatcatgctctgctgactccatatgtggctggtttcctggatccgattctgactgatggtatctgttctcacrctgctaataaagacataycagagactgggtaatttataaagaaaaagaggtttaatggacttatgtgttccacgtggctggggaggcctcacaatcatggtggaaggtgaaggaggagcaaaagcacatcttacatggtggctggcaaaagagagaaagcatgttcaggggaactcccctttataaaaccatcagatctcatgagacttatgcactatcacaagaacagcaycagaaagatccaccctcatgattcaattacctcccactgggtccctcccatgacacatgggaattatgggagctacaattggagatttgggtggggacacagccaaaccatatcagatggcttatttggtttctatgtagaacctctgcttttcattcaacagtcttcatttagccacagataagctctgtccctaacttccrctgatggaatgtacacataagaaacttccactgatggaatgaacacagaaggtgcctactgggaagaaaactggcctgaatctgagctgggtcaaatgtctgcagtcagtttgaatggctgctccttatgggaataatttacattctcaataaaattctctagcaattttctgattgattttaatgagctttaaagccttmcgtagaagatcccccagctgatagtcagccttgggcatggattaagggcttttaaccaatcttgcaacaagtttaagcagatattctttattgggtccaatctaaccaaaattattttcttatgttctccccagtaacgtgtcattattaagagaagtttggcttgcttagaggccaaatttagagggtcctgaaattttattttcttttacaccactttccagcatgttacctgatcagttgtttattatctttgctgttgaatggagtgatcattccaagggccygaggcaggaggcccaggcacagtggaaactctcccaaagaccaggatctttgttttgttccctgacatatgctgagcaccaggaatagtgartgaatgaaacaaattgtgaggctttaaagagccgaaatatttaaacactgggcacaaggttgttgcttaatcagtgctagatccttacctcccccttgtgtccaggtsgacttgttactgcagttaaaccacttgctgatcctcaaacaactagttagtggcacagccaggcctaggaccccagtctctactgttccaactaacccattcgcaggcaggagcactttgaatggtctcttattttaaaaaaattaaattaaaattgtctatttatttagagacagagtcttactctgtagcccaggctcgagtgcagtggtgcaatcatagctcactgtaacctccatctcctggcctcaaaaagtgtttgaattacagatgcgaggcactgtacctggcccgaatgttctgttcagacaaagccacctctaagtcgctgtggggccccagacaagtgatttttgaggagtccctatctataggaacaaagtaattaaaaaaatgtatttcagaatttacaggcccatgtgagatatgatttttttaaatgaagatttagagtaatgggtaaaaaagaggtatttgtgtgtttgttkattgttcagtcagtgaatgtacagcttctgcctcatatccaggcaccatctcttcctgctctttgttgttaaatgttccattcctgggtaatttcatgtctgccatcgtggatatgccgtggctccttgaacctgcttgtgttgaagcaggatcttccttcctgtcccttcagtgccctaataccatgtatttaaggctggacacatcaccactcccaacctgcctcacccactgcgtcacttgtgatcactggcttctggcgactctcaccaaggtctctrtcatgccctgttataaygactacaaaagcaagtcttacctataggaaaataagaattataacccttttactggtcatgtgaaacttaccatttgcaatttgtacagcataaacacagaacagcacatctttcaatgcctgcatcctgaaggcattttgtttgtgtctttcaatctggctgtgctattsttggtgtttaacagtctccccagctacactggaaacttccagaaggcacttttcacttgcttgtgtgttttycccagtgtctattagaggcctttgcacagggtaggctctttggagcagctgaaggtcacacatcccatgagcgggcagcagggtcagaagtggcccccgtgttgcctaagcaagactctcccctgccctctgccctctgcacctccrgcctgcatgtccctgtggcctcttgggggtacatctcccggggctgggtcagaaggcctgggtggttggcctcaggctgtcacacacctagggagatgctcccgtttctgggaaccttggccccractcctgcaaacttcggtaaatgtgtaactcgaccctgcaccrgctcactctgttcagcagtgaaactctgcatcgatcactaagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcmtygtgacccggccrggggaagaagctgcygttgttctgggtactacagcagaaggtaagccgggggccccctcagctccttctcggycttgtctctctcagatgtaactgagctgtgggctaggaggaaaaggccgggaggaggcacggtgatgactgaaaaacctctcccctctcataagaccagtcatcyggacgcgggctttcccccactcggtgcccacctggggtcttacaggaggagctgctcctcctcagcaataggacaagatggtcaggtcttcctgcttccgctgagaaaagttagggtcctcaggaacggagcagactggtacaggaacagagtcatcatggccaagagtccaccgggtcctcttgccatcaggaggaatagcagggcttgtrcaggaattggggctggagggaaggrccgggctcggtcagtctccagctgggatccccagagtggtcaccctacccctccctcgagacagactgcctgactgtgtgtcatcaggctggtcaccrtctccctgaacctcgatttgctcacctataaaatggaactaataacgatgcctgggctccctgtctcaggggctctggtatagctgaagagaactaatataacatgaaagtgctttctaagctttgggataagctaaaaggcagattccaattttattcgagggcagcgtagattggtgcttcagctcgtggatgacagagtcagggggcctggttctgagtcctagttctgtctcttcccagctgtgtgacgttgaacaagycactggacctctctgttcctctgcaaaacagcatgaaccaattcattaactacttctccaggatgcagtaggtcccagggactatcctaggaatgtgggctgtattagtaaacacaacagcgggaaccctgttccggggctcacattcacatcagagcaaacagacaaagacgctggacagaataagtgcataactacatggtacagagggttataaggagggaaaaggggagctggatgagagagttgagagtgcccggtgtgytggggaaagctgcagggtgaaatactgcatcagggaaacctcagggaaggtgaggactatggtgaggtcagaggggttgatatgagaacagtgccctgcaaatggcaggcaccacaggagcatgagccrtcatcttcacctttagcattcagcccgggagaagtagggagacatagaaggggcaggtgctggccaagaggcaggggcaggagaggagaaggcggaggggcactcagggcgagggtgtcaggcccrccaccccagagcaccattactcccaggacgcggctgcgtgcagacctggaaccagcctagggagcagccgcagatcacaactgagaacaaacgacagtctctgcctcaaaaatggcccatggaattgcgtctctggagacgctgcctgagcaggagcagcacagtgagcgggctgcatcgaccagcgccatccaaaccccgaacagttggcgcttgtcaggcaggacttcccagcagtcggttcccacaggtttcccctgttgacctgatttgatgtgactgtctagattaggtgtgaactggtggcttaggcttctctgcacagaaaggcctgcaagcagcagagagagttttctgttccatttttccatgtcatgtggctcttcctgagaacagcggatggagtcaaatgcatggggagtggggtgagatggtagctgaggtcagaatttggcatttgaatgactgaagcagaacaaaacacaccaggtacttcagcagctgcaccgtgttgagggcaggtgctggttacgggtctgggtgagggaagccagctgccaatgtaagaagaatgactgggtatgcttagatgaagcagaaaaatctaggcatcaaggtggccttgagtcagtgatgacacgctacagctccaaggaagcctggcctagccctggggggacagaaaaggccaagaagtgacgatattgcagtacacccccctccacaagaaatgagtgagatgtggtacaaaatgttagaattgaatgaatcaatagaataaacgttcatcccttcaatcaagaagagtcagatgaaatgaattagcagggccagcccaagaacctcttctgggggtctcagggtagctttcatttgtagcagctgaggckgaagcccagctgcaaggcctttgagagaacgtggtgctggacccgtgtctagggcaggggttctaaaccctgcttacatatcagagtcacctgagaattttctatttttttttttttttttttatacgtggtcccagcacagactaaggaatccaactatcattgggcaagccatgctaggtatgcatgcctttrgggctctgcaggggatagcgctatgcagggatggttgagagctggttttggggttgagacacgtgggaaatacttggactttgggctgagcctgtggtgctcaatcccggctgcatgttgggaccacagggagatgacaaaaccatccccagccctcaccctagggccctcgaatgagcatctcaggggtctaggaggcctccacaaagacctactgattggcacacacttgtttctctaggaagagaacttacagctgcaggcaggagcatgtcttaatctgcttgggctgccataagtaccacagactgggagggtttaacaacagaaatgtgttatctcacagttctggaagctagaagcctgggagccagccatcagcagagttggtttcctctgggtcctctatccttggcttgtagatggccgtcttctctctgtgtccccacatggtcttccctctgtgtccccacatggtcttccctctgtgtgtgtccatgtcctcatctcctcttctcataaggacacaggtcatattagatcagggctcaccctcatggcctcattttaacttaatcatctctttaaagatcctgtctccaaataatggtcacattctgaggtcctggggttgaggacttcaacacgggcattatggccgttgggggaggtaggacataattcagctgatattggtgcattttgcacttggatcatgtagatattttccatggagctttgaatccatttcttcttttttttgtagacatgaatggatttattctgggctaaatggtgacagggaatattgagacaatgaaagatctggttagatggcacttaaaggtcagttaataaccacctttcaccctttgcaaaatgatatttcagggtatgcrgaagcsagcaccccagtctgagatggctcctgccggtgtgagcctgagggccaccatcctctgcctcctggcctgggctggcctggctgcaggtgaccgggtgtacatacaccccttccacytcgtcatccacaatgagagtaccygtgagyagctggcaaaggccaatgccgggaagcccaaagaccccaccttcatacctgctccaattcaggccaagacatcccctgtggatgaaaaggccctacaggaccagctggtgctagtcgctgcaaaacttgacacygaagacaagttgagggccgcaatggtcgggatgctggcyaacttcttgkgcttccgtatatatggcatgcacagtgagctatggggcgtggtccatggggccaccgtcctctccccaayggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccayggtggtgggcgtgttcacagccccaggcctgcacctgaagcagccgtttgtgcagggcctggctctctatacccctgtggtcctcccacgctctctggacttcayagaackggatgttgctgctgagaagattgacaggttcatgcaggctgtgacaggatggaagactggctgctccctgaygggagccagtgtggacagcaccctggctttcaacacctrcgtccacttccaaggtaaggcaaacctctctgctggctctggccctaggacttagtatccaatgtgtagctgagatcagccagtcaggccttggagatgggcagggggcagccctgcggacatacctggtgaccacccttgagaagtggggaagtggctgctccgctgggtccctggatgggccgtccacctcctggacctgctgccctactatgtgcacgactatacaacatcctttttcttacatcatttaatccccttatgatgtggtgaagaggtatttgtgcctttgtttaccagtgaagaaatagagactcggagaaacaaagtgccttgctcaagatggcacagccaccagtgggggtcctgggattgaaacccacatctcctggccccacagcccagttctacactcagaagggtcaggttcatatctcttgagaaggtcaggaactggggtccctggcccatgcagaaataagcaattggcttgcttaaatccctttcatgttaggaggggcattactgaaaaccctctactacaaagattgttgatttttttttttttttttattgagacagggtcttgttctgtcacccaggctgcagtgtagtggtgccatcattgctcactgtagccttgaactcctggcctcaagcgatcctcccacctctgccttccaaagtgttgggattaaaggtgtgagccactgcacccagccacagattgcttaaagcattcatttaacaaatacttgttgargatttgctacttgtaagactttaagcctggcatctcagaggaggccagaggagggctgtataggccctgcctccaggcttttaaaggtcaatgggcaaatgcctaggatttggagctgcagggaaacgtgctccacaaggtaactcagggaagcctcggggctctcagaggacagaggtcactggggagcggagagcaggccttgcctggcagtgagggmaacagggctggtgaagctaggagcaagcatgatgagcccagcctgcagagtttggggcaaggaacgaggatggggcggttggcttggcatgagtgttgaaccagaaaatgggcctggggagggcagagctggagacactttgaacgccatgcttggtaggtgtgggaatggggacgcgttctgttcagaggtcatcccggaagcctgccgtgtgcagactggaggcagggaggattgtttgaaggttacgcaagagtccaggcacacagtcacgggaacacgtgctcagggagcagctcggcaaatccatgggtggggtggggctgaggggtgtgtctaagagacactgaggaggctctgtcaagatgttaacctcgtgagggacagagagycaggcgggaggtgaaagacaagactgtggagaaagaggttcagtggcgcatagtgatttttcttaccacracaacctccttgaggtctttcccttcgggttcagggrgaggtgatagatggggggattgctcagccctggcactgactggtcacaggggcagaggccagcccgagggttgcccsgttgagggtggcagcacactgtgcagggcagagcagggacacatggacttagcctgctgtccctaggagaagtgytgggaggagcgctcactgagaaggagggtcctgcagaaggcaaaggcaagaaagccagtggcatctgaaatgggtctcccttcgaaagagagcacatccacctgacccagaccgcagagccaggccaggaggmagaggaggaagaataaaaaagccaaccacatcgggactcaaaggaagcccaggatcctcgccggcctccaccgcatgctgccctgaccctgccccacttcctaactttgctggcctcagtttccgtcaaaggaggcagccacttcctgcccacatggtctgtccagtgaggagatcgggggctgtctmgggacctctaggtttccctttagcaatgatgttctatttacatgacctcagcaggcagctagatgtgtcccactagagaggacctraggatctggggcctgatgggctccagggtaccgtctgcccagtgcttgctgtgctcctgagcatggggcgctggccctggyggtttccatgacaccaggtcctgacttgacctcgacagatttacctagcctccggatgagaatggtgagctgtgcrtgtcagacgagcagagggaagacggcagccactctcatgtcaaatcccagcrtcttttgggaggcagcttcccttttttagtttagtttgttggaagaaaagaattgtccytttccccsctctaaactawaarccttgccagcccaggtgggcagcaccgaggtccctgcagggaacgtgcaaggggaaccctgcagtttcccgctcacatgcccttccgagactgagtgctccgaggactgaggacgagaaatatgccaggtctgccactgccttcttacgagacccggacccaggggaggcacagccatgcccagctcctgcctgccagttctgtcctcccagctgccctactttcatgctgggacctccaattcagtacaaagggagacctcactgtttctgaaccatctctactcagactcccaagtgccacgtgcccaggggactgttctgtgacaaacttatacacaacttcaccctattctcctaagaacaaccgcagaataggcctttcaggatgagtgggaggacagccgagggcagggatgtgctagtgtaaggtcgaggcagagggtgggctgctgtcatggaaagaccccaggtaactgcgtcacacacaaatttgtgtccttctcccacaacgggctctcccgagttctctgtcatctgcacggccctgtgagcaggaggggaaacagagggctcacccctgyccccaaggcccagtgtgcaaatccattcatcacaacgaggttgtgtgagtctccccagtagcaagggctgctgaggaatggagccctcgtttccggggcctgcgtggcccactctgtattctatgactgtgatgggggagggtgggggccacaggacagctggtgggctctgccatggctggggctagacatggattaaaaagtgagtatgagcaggggcctctaggagtggtgggatagtgcggtggtggccacatgtcattctacgtgcgtccaaacctacagaatgtaaaacaccaggagggagactcaaagaaaactatcaactttgagtgctgaggacgtgtcagtgtaggttcgtcagttgcaacaaatgggccacgctggtgtgagatgttgatcacgggggaggctgtgtagtgggggacaagagttatatgggaactttctgtactttctgctcgattttgctgtgaacctaaagtcactctaaaaaataacatctcttaaattttttaaaaagtgagtgtgtcaaaccacagcctttgggtcaggacagttctaggtttgagttgacctggcaggtaccagtggcttatgtcccttaaggtgacagatgcaaaacccccggtttggtgcctggcatgttgtgtgtcttgcaggtggcggttagggctgcctcagtgaactcaaatggctgcattttacaggagaaatatttgagccacacttgcggtcctgtggccaggagaatgcagagtggcctggggggggccaaggaaggaggctgaggcagggcgaggggcaggatctgggcctttggtgtctgccagccctcattcctgcccctgtcttgggtgactcttccctccctgtctcctgtctggatttcagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactrtctccccggtaggagcctcccggtctcccctggaatgtgggagccacactgtcctgcccaggctgggggcggggtggggagtagacacacctgagctgagccttgggtgcagagcagggcagggccgyggtggcacggggctgggcaggcggcctgtgtgtctgtctaccagtcctcyatccagccagcacccagctctccagttagtgtctgtctttcaagtgcaggcaaggtaaaggaggagaggaagaatgctttttctacacttacacttgcctggtagttttggagggggagaaaacattgcaatccgccctctgagagaggaccattttggtcccacacctgacacacagcacacctgtgacatccaagagcttcttggaactgacttgccaggagggttcggacttcgcgtgagcgggggtggggccttctcagggagcgtcccttgactccagaacgcccttgctggcggctggcggctgggtggggataggtgttgttagctcctctttcctgctgcaattcctttccacagagccctggactcaaactacacatcaccccagatcatcgaggcctggaaatctgctcccagaggcaggcattgagtgacacgatggcttgacatcaactctgggtgttttttatgttttaaaaattgtgatggtaaaatatacrtaacaaaatttgccatcgtaaccattttcgagtgcacagttcagtggtactaggcccattyacactgttgtgcagccatcacccccgtccatctccatttatcttctcaacttcccaaactgaagctctgtcctgctgaaacactaactctccatttccccttccccttggccccggcaaccaccacgatgtcctcgaggttcacccatgttgtagcacatgtcagaatgtccttccttttgaaggctgaataatattccattgcatgtggttaccaccttttgtgtatccactcatccatcgatggacacgtgggttgcttccacctttgagctgctgtgaatagtgcagtgtaccctgtaaacatgggtgtactgtcagctcttataagtgcttgatacatcactggaaatgtccatgggctctgaaggatgccaaaagatggaagaggctctatacgaagatcaatcgagttgacatagcaacgtgtccagcacgaggttgacactgtaccctcctgcctctctccttttcatgggtgtcatgtcatcaagaacactgctgtggcagtagtaagacacagtgcattatttcagagaatagcatttaaaaattacccaagtaacacaccttcaatgcagccaacctaaaaacagaatgcaccaaaggacaaccattcctaggtcctcatcggtaaatcttctatgtccctcacatagtattgcaaatgacatgaaggatttttattgtaggttttgctgaaattttccccaagggggaggatgacttagttgggtgatgggggkagcaaacatccctgtcgtcagggttgggtgcaaggagcataagcctgcctggcctctgggagagccctcactgtgtggcctggagccttcctaactgtgcrtcatctccccaggaccatccacctgaccatgccccaactggygctgcaaggatcttatgacmtgcaggacctgctcgcccaggctgagctgcccgccattctgcacaccgagctgaacctgcaaaaattgagcaatgaccgcatcagggtgggggaggtatgtgtgagcctgtgtctgtgcctgacctgggttccaagtgtgcacagggtgggaggcatggatgtaagggacacagaggaggctatgggtggggccagcagggcaagagggagcggagagtagggccaaaggtgggagagaagtagccagagcattctggggccttccaggtgcagagcagcaaatccctccccatccctgctgtgcctcctcctgctaggtgtgtgttccatggtcctgcttggccttgccttgcctcagggtcctccagggttcctatagtggagttgaaaccgggatgaagacagcaagcacccctggacctggtgccctgggcccagccccttcttcagggaaatgctgagcagcagacagaatgtccccctgccatgtggcaccatgcacatctgcagctaccaaggatgtgccttgatgttctgggccctgtgctcagtgctggggagaaagtgggagttcttacgggggccagcgggaagagccctctgtgctaagttagctaagccctggcactggtgggccatggccaagggagccaggaattctgcctgggacatcagggcagaatgtgaagatgggaggatgtaaggggtgtgttagggaggagccggcatgtgagtttggccattgtggccaattaacggtcatctacacacagacacacccttgcctacactgaggggcaggcatacactgtgcatcctcctggcaggctggaaaatgtccccctccaggacagtgcacagcacagaggtcctgagcccaccccggccctctagccctcagcaccctgggtcacccagtgcgccctcagaatgatcctgatgtctgctgctttgcaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgyccctggcctttgaggcaaaggccagcagcagataacaaccccggacaaatcagcgatgtgtcacccccagtctcccaccttttcttctaatgagtcgactttgagctggaaagcagcsgtttctccytggtctaagtgtgctgyatkkagtgagcagtagaagcctgcagcggcacaaatgcacctcccagtttgctgggtttattttagagaatgggggtggggaggcaagaaccagtgtttagcgcgggactactgttccaaaaagaattccarccgaccagcttgtttgtgaaamaaaaaagtgttcccttttcaagttgagaacaaaaattgggttttaaaattaaagtatacatttttgcattgccttcggtttgtakttagtgtcttgaatgtaagaacatgacctccgtgtagtgtctgtaataccttagttttttccacagatgcttgtgatttttgaacaatacgtgaaagatgcaagcacctgaatttctgtttgaatgcggaacmatagctggttatttctcccttgtgttagtaataaacgtcttgccacaataagcctccaaaaattttatctttyatttagcagccaaacagatgtatacaattcagcagatagactgtgcaaacgaaagtgctttcctggactttggatggaatttccatgggaggtctgagccagtacttagcagtcctttgaagttttaggtgatgcttttctctggacacttccattggtaagcagtggtggccatctgtgtgatggacagggggcgggaagagggtgacagggaaggccccataccccatgtggcacctgggaaaggaaccaggcagatgggacttcttccgtcctggtgacacagggccagactgctgctggtattgtgccccgggagtggaaggtagagaaataaatcttcacaaataaatatttgcaattttcccccatctgttgagtgcctctgcctgctcctcctcgatgggattaggcccacagttcggaatcttggggagagccaaggaagcggtaggcacccagtaggcccacggccgtcggctgatagcaatggtgatgctgtcctacctacttgtgtaaggcattcgatcttcctcccttccatacatattgaaataaataagccgcgcaatgtgttagctattgatcagaactaaagtgaagtcagccacggggattacaaatctcggcttctcccctcatgttcctgagagtcttcccctggttttgaacacatctccctagctcgatgtcaaggtgagggattctgtcggcaacagcagtgcccttagttgcttcgtcgtaactccccgtcaccggttttattcagttaccttccagtcccactctcagagcttcctggcttgttctgctctcaaagcgggtagagctggcacacatggactctccgaaacggctgcaagatgccaagtttctcggaagaactggaagcacagagaccagaagtgccttaaggtctcgctattcagtgtggcgcttagaccggcagtggcggcagctgccctgggagcttgttagaatgtggcttctcacgcccctcctggacctacagagtcagaatctgcagttttacaggaggtccaggcttggaagttgctcgtagagacctgagacagcgcagccacgtgctggaaacaaagcatttaagtttgtgactttattttaaaaggcagcaggcagtcgacaaaccaatttcttctacttagaggcggcttcggcttctggaagtcgctaggagtataaagttgccaaccagcgctgttctcccgctgttttctgtgcacttataaatgggaagttaggtcaggatagatctctcagctattacaaggatacaaaatacgaacattctacaagttacttaacacacacacacacacacacacacacacacacacacaaaattaattccacaggtcagtttctctgaaacattttttcactaaattctaagtcttcctggagttgcaagtgcctatctcctagacaaggcaattactcaccaactaaaatcactgtcaatctgagatttcggctgggcatgagaccatggtcaggggatgctttgaacagcctctgaggaaattagtgagtttgaaaaatggaaagatttttattactcacttggcagtaaaacctgatggggacagacgtcaggctgtttaagatcctcagaagaaaaagttgatagtgtgaatattcctaaatttgccacacgaagatgtacatgtgattataaggtgctgttgcagaagcccctgggggtgttatgggatatacactatatgggccactttaccttcctaaaatctgaaaaacttcaactactgaaacatggactgaaggttttgaatagtggatggtgaatttgaataccatcccgtgtgatttttttttctagcagactttagttttttagagcagttttaagcccacaccaaaactgagaggaagatacagcaatttctcatataccccctactaccttccagtctcccccattattgacatcccccaccsagagtggtccatttcttacaacccacgaacctacattgacacatcattattactcaacgtccatagtttacattagggttggctcttggtgttgtacattctatgggtttagacaattttcaggagtttcactgacctgaaaatcctctgtgtccctcctattcacccctccttccctcctaaccactggtaaccaccgatcctattcccatcttctccatagttttgcctttcccacccaggatgtcatatagtggaatcattcagtatgtggcctttccagattagcctctttcacttagtaatgtgcatttaagtttcctccatgtcttttcatgatcgctcatttcttttttattgctaaatactatgccactgtctggatgtgtcacagtttatttattcacctactgaaggacatcttgcttgtttccaagttgtggcaattgcgaattaagctgctacagacacccatgtgtgggtttttgtgtggacatgtttaccccacacaatttttaaagttgctcaatgatcagagatgttctgagtgactctgatagacccacaaacatgtcagtgactctatcccttcaagagagtaagggtctcagggcccacacccctgaacttgagtaacctcattcttctgttaagttagctggagccaggagaggagtttatgactaagtcctcaaaagccaacacaacagaaacaaaaattgaaaactggcactaagtaaactaaagagcttctgcacagcaaaagaaactaccaacagaggaaacagatgaactaaagaatgggagaaaatattagtaactatgcatccaacaaaggtctaggatctagaatccataaggaacttaaacaaatcaacaagtaaaaacaaccccattaaaaagtgggcaaaggacatgaacagacacctctcaaaagaagacacacaagcggccaacaaatttgaaaaaatgttcaacatcactaatgatcagagagatgaaaatcaaaaccacagtgagataccatctcacaccagtcagaatgcctgctattaaaaaatcaaaggaacaaaagatgctggtgaggctgaggagaaaaggaaacacacacactgttgctgggattgtaaattagttcagcccctgtataaagcagtttggagatttctcaaagaacaaaaaaacagcattaccattgacccagcaatcccattactgcatatacacccagaggaaaataaaccattctaccaaaaagacacatgcactcatatgtttaccacagcactattcacaatagcaaagacatggaatcaacctaggtgtctatcagtggtggactggatacagaaaatgtagatatacaccatggaatactatgcagctataacaaagaatgaaatcatgtcatttgcagcaacatacatacagccagaggccattaccctaaacaaattaatgcaggaacagaaaaccaaacaccacatgttctcacttataagggggagctaaacactaggtacacattgggccataaatataggaacaacagacactggagactctaaaaaggggaggaaaagagaaggtcaagggttggaaaattatctactcgctactatgttcactatttgggtgacgagttccactgaagcccaaatctcagcatcacacaatatattcatgtaacaaacctgcatatgtacaccctgcagctaaaatgaaaaacagaaagttacgtggagtgagtgtcatccttcgaggcttgattctatgttttgtgaggtggcttcagagcagccctttacatcgggttaatttggctccaccgcaggggccatacccccaccctccacgtctttccactctggacacacttttcccaggcccgttttgctctggggcttttttctacctgctcctttctggggattctttccttggccttgacaacctctttacacaggcgggctggtcaatacccagctccaaaagcaaagcgacgctccacagacctgtctcctctccgttactctgcacccccagttccagcctcttcagtgtccccaaactccacaccgcctcctctcagggaatgggctgggctctggatgctcctgtgcatccagagaccctccatgctagacgctgggccatcgcaggacccccacctgccccttctctctaggaccctgcactgccggcatccgacactgagcagcgctgtttcacacagtatcgattttcagttgttcaggatgggagggtcaatcaggtcccaacatgccatcaagctggattacacaagagatttaaacagtcagaatgccactctgaatttcgctctgttgtccaggctagagcgcaatggtgcgatctctgctcaccgcaatctccacctaccgcattcaagcaatcctcctgcctcagcctcccaagtagctgggaatacaagtgcccgccaccatgcccagctaatttttgtatttttagtagagacagggtttcgccatattggccaggctggtctcaaaactcctgacctgaggtgatccgctcaccttggcctcccaaagtgctgggattacaggtgtgagccacaccgcaccyggccaataatacattttagttcaagattagtgagagctaaggagaaatgagaatgctgattgttctgaaattcagtctccacatgaaaaccagctgagggttgagtggaaaatggagaaactttcgcaatcaaatgaaggtaacacttccttcactcaacaatttacagatgttcacagccatccaacacgaagcttagtggctgatcaaaagtagcaggatattttcagggtaaaaactgagactcacgggcagcaccaagaatgtctgcacatctcaaaagacagacagcgtttcctttagggcgctgaggctgaggtcttacacagagaggaggattgccaactggcaaagccctgcttttcaccaactgctcgaacggactggactgcctggctgctgayagggagggagagatccaccagatctattcagatgccatgaacagagaaaataacactgccttcaaacggggacccctaacagatcttgcttaagaatctaacagttcagcatctgcagttgatcactgcttttgagttctgagacatgaacacaccatggaggtgtccacgttgtcaatgactcagccatgctggctccaattactgcaccaccagtgctgttgctgctgttagagtgacatctagaccccagtaccagagagcttcatggttgtttcaaaagggccccgcaaaggaaaatcagcccttacctcctgcactacagagttcctgagtgaccctgcttttattccatcactaggatcattaagccatggcagcacagcttggtgactgtgcggttctcatatgggcaactccatatagcagttctagggagctgcgaggaattaccaaaaaagaccccagatgagagattggggagttcatctacagaagttccaaatcctttttttctttctctccttcctggacacacagctaaaactacagttccaggccccacgtgcctgagcgccacacactggagtgagggggaaggattttgtgctcacccaaactggggccagagccacaccctgggcgcccccatcacactcttctccctttctggtaggttgcagtggagggggagtgggctgaatggtggccttcaaaaagatatgtccacatcccatcccctggagcctgtgaatgtgaacacatttggaaaagggtccttgcagatgcaattaagcaaggaatctcaagatgcgatcatcctggattaaccaggtgagtcctgaatctgatgacagtatctctatcagtcagaaggggagaaggccacgtgaagacggaggcagagactggggtgatgctgccgtagccaaggaacacctccagccacaggacgctggaggaggcgaggaatctcccctagagccttcagggggagcacggcccggctgacgccatgagtttagacttttcaaaactgtgagagaatgcacttctgttgtttccagccaccacacttgtggtaatttgttacggcagccctagaaatgaatgcaggaggttcctccagggtgaacttggaagccataggatggagatggctgacttccagtcagcctgggtccccgaatgacctactcatggcctccccagcagcattatagtagaacaaaaaaaacttctcctgtggctgacacccacttttgagtctgtatattagaaaaattgaaactaatgacaggtttacagtatgtaagtattatttcatctttaagctttattcaatagtaatttctccaaagcaaagcaaataaaacac

SEQ ID NO: 1663 - DNA, 16159 bp, Homo sapiens
gcgtctgctcacaaacagagctgtgcaggcaaattggagtgaggggttgggaatgactgctacagtggtatttatttactgatttttttatgaaaatggctaaatgtgtattttttttcttttatcttttgagaccgagtctcactctgctgcccaggctggagtgcaatggtgcaatctcagctcacctctgcctcccaggctcaagcgattctcctgcctcagcctcccaagtagctgggagtacaggcacacgccaccatgcccagctaatttttgtatttttagtggagacagggtttcaccatgttgaccatgctggtctcgaactcctgatctcaagcaatccacccacctcagcctcctgaagtgttgagattacaggcgtgaaccactgcgcctggtgtgtattttttttttttctgattgcaaaagtaatgcttattttaaagattgagcaacatcaaaagacataagcaaggaagcaaatatctacaatcccaaatatctacaatccccaaagataacccctgctaacatttgactacgtttcccgtgttttccctgtgcatacacatatatgtatttgatacaaaatgtaatactgtacattctactttttaatctttattgccacttagcatcctattacaaacacttttctatagcattaattatagctgtacattattttaaatagaagcatggtattccattttataaatccagtataatttgtataaacattttttgaagaacattgagattattgctgttttattattataaacaaccctgtgataaacttactttccttccttcctcctttctttccttccttccttccttctttcctttcttccttccctccctctctcctcttcctcccttcctcccttccctcttttagtggaatttcagcatcaaaggttctgcattttttggtgtgttcgatacacagctcccccacgggaccatgggggttgtgtacaaaataaataaataaataaataaataaataaataaataaataaagtgatcataagagcctgggcaacatagcaagaccctcatctctacaaaagtgttttaattatctggttgtggtggcacacacctatagtcccagctacatgggaggctgaggcaagaggatcgcttgagcccagcagttcaaggctgcagtgagctatgatcactccactgcactccagcctgggagacagagtgatgtcctgtcctgaaagaaagaaaaataaaggaaagtgggcatctgagcactcatttgaaggaaatcctccggaatcgattcagaaatcctcatgaagkacccagaattccctgctttggagccagccagaccaggatgaactaaaagtgactgaacacttattatctgccaaccactttacatatattaactaattgatcctgatgccaatcctataaactaggtcctacttttattatccttttgcaggtgagaaaactgaggcacagagtgagcatctaagctgcccaagggcacacatctagccagggacagagttgggatttgtaccagctggtttggagctcaagccttccatcatcacaacagcttggagaggtaagtattattatccccgtttttatagataaggatattttgataaatgttaagagatgccacaatttgccagttgactggcattcaggctgcacctgtcacggctttcttcgtggcactgggtgttctgcatagaatagaaaaatgctttcctatcaccacccaagatcacaaactagtaaagaagagccagtatttccatcctggtctgtctgacttcaaagcaaggaattctgggtccttcatgcggattttctgaatccattccggagcgtttccttcagatgagtgctcagacgctcactttccttttttaatttttctttctttcaggacagtacatcactctgtcttccaggctggagtgcagtggagtgatcgtagctcactgcagcctcgaactcctgggctcaagcgaccctcttgcctcagctttccatgtagctgggactataggtgtgtgctagtacatccagataattaaaacatttttgtagagatgggtgtcactacgttgcccaggctcactttatttatttatttagagacaggatctcacttcatcacccaggctggagtgcagtggtgtgatcatagctcattgtagccttgacctttctggcttaagtgatcctcctgcctcaccctccctaatagctgggactacaggcacacaccaccatgcccagctaatttttacttttactttttatttttagagagataggtcttgctatgttgcccaggcttgtcttgaactcctgaactcaagcaatcctcccacattggcctctcaaagtgttgggattacaggcataagccaccatgcctggcctatttatttatttgttaattttttttaaaaaaattgagattgcaggaaataatttttaaatttaattttagttttaaaacggagattgcaggaaacaaatatgctcacttttcaaggtccttctctggcttcctctggagactggagatcagggctgggaggtctgcacctggctaggtcacgtgtctgtcaatgcccctgtatctttaccactgcagccttgacccagtgtctcactgacactactccctgctcctctcatcctagaccacatttggtttccagaactctcacagttgggcatgttttggttgctggtaacagaaaagtcaacttaaactggtcttaacaataaagacaatttattggctcatggaaccgaagaaagtacagagagaagatggcctctgggcatggtttgttcaggactcttggtctgtttctctgattctctcaactctgccttcttctgtgtgttggttttttccttggactgtttttgccatttatggtagcaaaatggctgctgactgcaacaagactatatacttgcttttccacattcattgagcaaacatctgaactttgctctgactggatcatcttgggtcacagactcactccctgagcctgttgctgtggttacgaggacgtcactggggagagaggagaaacctccctctacccctttcctctactttgatcccagatccaagtggattcttctggaggaatgagaagagatgctgaagctggcataaggctgatgcagggacaaaatagatgttcttacagccacattgtgctgttcacatggtctgtgcagaagtcatcatgtttaaaacagagtggtaagaagatgtcacccaaagagatactacattttsccagttgactggcattcgggctgcacctgtcacagctttctttgtggcattaggagctctacatggaatggaaaaatgcttctcagcaggaacattctaggccattttaagagggcacagttataagtgggaagtgaggtatagaagataggttgggtgggctgacttgctggaacattttgaagtgggtaaaattttattctaaactcatctatatgtgctttctccctccttcagtgaaatgctcgtcctactgcgaagtgaaaggttctttccacccttgtcctccagatgcaacttctcctggagaccccagcattgctgttgccctcaccacactcatgcagcagggctgctccccttcactcctcgggctccaggagaccagcctcttccctaacccctcagtgattccttgaaatagactggaatagtgaaccgacttactgagggtttaggaaaagcagaagggaactatacaccaagaagaacttaacacacggtgttaaatatacctgctcttggccctggtctttctcaagggggtgtctcacaggggattccctgtctagcaactgctgcccccttgtggcaaaaactatccttctcccggcctcagggtctttcttgagtataggcaggtgttttgcagtctaggcccccgtcttttttctcctgtgtccccagtgactattttctgcccttggggctgattttccctagatgattaatagagggagtctcccacctcctgggactaccccatctttgactcctttctagtctaggcgttagagcacaatagtccaacatcagtaaaagcaaagcatgagtggctattgtccccttacacttcctgttaccatctatgaatgataaaagagcccaggaggaaagcacaacttagcttaaaaaataggcttgccggctgggcatggtggcttatgcctgtaatcccagtgctttgggaggcaaaggcaggaggatcactagaggctaggagttcaagataagcctgggcagtatatcaggaccctttctctacaaataaataaataactaaataaaaaataaaaataaaaatataatataaaaaaagaaagccagatgtagtggctcttgcctgtagtcccagctattcaggaggttgaggtgggaggattgcttgagcccaggcatttgaggttacactgagctatgatcacaccactgcattctagccttggcaacacagtgagagcctgtctcttaaaaaaagaaaaaaattctttccagtgcagaactgtaggaatccatggcatggtaaatttggcatttgtggtagggcaggatttatacttgcacagactggcattagctccaaacattagaggaaggttggaaagaagcaatgccaggcagaccaactgggctgtgtggaagtgaagctatcaggcataccagtgactttagtgtgtagccaaaagcaatagacactgaatcgtggtggtgacttatggtccatgaatcacaggagaaatgtctcccttcatttattccacaaccattgattgagcacctactatattccctgaaagagaacataaacatgaattgaagaaggttcttgctgtctcatggctcccaagctagaagagggctgacttgtaaatgcctcacagcagggttcatgttatatggagaagtgacgaaggtgccagaagactcaagctaggggacagccattagctgctggaggcagctaaggtgggttcccagagaagccgttctccgttactgagatgggggctgcagtgaccttgaccacagctcttccattcatggactgccccagctctgtggtctctctgctaaccagccagactctgggagtggcctatgccgtcagcctcagggccatttaaaccaactggtcattggcagtgattgtgcgaaagagtggctggcggcaaaggagggtttgtgttccattcaaataccctcaaaaagcctgaaaaataagtagagattgaggccaggccttggagttgtggaaggtggagaacactgggaagccaacctccaaagaagaccaggttggaggcaaaggaggaaggggagctctcgttggcaaaccaacagggaagccaaggatatcccagtaactgctctcacatccttgatgagaatgccttgaatccgagctaggccacctcaaagaagcctgcaaaataagtagagattgagtgcctgctgttcaaacacaactcaagcgcagtcctcctcctctttcccactggattgcccccaagtccctcctatgggggactccttctgaagtctctgctgtaagtcaaatccttcgccctttatacttggtcaggaagttgcaagcttccacaggtgatatactagggaatttaggaataaacaaatggaaataaattcaagaaaaggaaaataataaaaatgatcatccatagagtggagaattcagataatggaccctcaaccccagcttcacacctgggacccccacttggtcatatggaccctggcagtctctaatcacaagtctgtgatcccttgacttaaactgttcttccccaaatgtagacatgggtggggctcagaagggaggtgtcatctgatgtggtttccttatttccgtttattcatcaagtgccctctagctgttaagtcactctgatctctgactgcagctcctactgttggacacacctggccggtgcttcaggtaggaagccacctctgtttgctaggactttctgtggggtagggctgcttggcttgactttattttggaaaatgtattcatttctgtgggagctgaggatttctgctgcccgcttcctctcttgtgaccascactcatacatggagttagcaggtgaagaggacagcctcctcatcccctctttttataccttscccttttgtgggaagaggctgaccattccccaatttgatgtttattgcttcaccttaagactttgtcttcagtgaaaatgcaaatactggtagggagggaacacactaaaatgtgtggatctgagtggactcatcatacaccctcaggcctggcagcaaatgagaggtggatgattctgtcttcctcgatttgcagatgagaagactgaaatctataggggtacgagaccccactcaaggtcatgagacttatttatttatttatttatttattttgagatggagtctcactctgtcgcctaggctgtagtactgtggcacgatctcggctcactgcaacctccatttcccgggttcaagtgattctcctgcctcagcctcctgagtagttgggattacaggtgcacgccaccacacccagctaatttttttgtatttttagtagagacggggtttcatcattttggtcaggctggtctcgaactcctgacttcatgatctgcctgccttggcctcccaaagggctgggattacacacgaaacttattaatggtagaatcaggatggaatgaagactggatgctaggtgtctttacaaccaacctcggtgactttccaaaggctttcagacttctctggagagtcctggagctttgaggggctctttaggggccatctgggttcggagattagcacactctgccccacagtggctcarcttttatctgcttcacatactgggcttctgggaagatcttatttcagtaaactatttcacaataggaaawatatttgaaaactcttgaatgattctgtggattttttcaggggtggagggtttcagggaccaagatggagactttatcttctcaaatacttaaaactcctttagacagaggaacaaaatatgtgctcctcatttaaagaaggcttaaaatatacagtttaatgcaatgtgttgttatcacttccttcccccagtagattttaaggagggtaaacaagaatcagggagaacataggaatagaaatagtagaaggggacacctgggaacaggtttgccttcttgcattttgcttaatgctggcccttccctgaatgtctaagaccaacctggtccccacatccaaatgcacagacacagctgaggatggagaaggctaaagagggacagaggtagagacayaggctgagaggaggcagttgtaggttgagctagggctaaggtgttttccccatattccatcttaccccacactcaggccaggccttagagttgtggaaggtggagaacactgggaagccaacctccgaagaagaccaggttggagtcaaaggaggaaggagagctctcattgycaaaccaacagggaagccaaggatatcccagtaactgctctcacatcattgatgagaatgccttgaatccgagctactaaatcacatttccttccttctaaccttccagttagatcaaaccattgctgaaactgaagaggacatgtcaaatattacagatccacagatgtgggattttgatgatctaaatttcactggcatgccacctgcagatgaagattacagcccctgtakgctagaaactgagacactcaacaagtatgttgtgatcatcgcctatgccctrgtrttcctgctgagcctgctgggaaactccctsgtgatgctggtcatcttatacagcagggtcggccgctccgtcactgatgtctacctgctgaacctggccttggccgacctactctttgccctgaccttgcccatctgggcygcctccaaggtgaatggctggatttttggcacattcctgtgcaaggtggtctcactcctgaaggaagtcaacttctayagtggcatcctgctrytggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcmtgaggacccaggtgatccaggagasctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagtggaacgagacaagcagcccttagcccttcccctctgcagcttccaggctggcrtgcagcatcagcatccctagaaagccatgtgcagccaccagtccattgggcaggcagatgttcctaataaagcttctgttccgtgcttgtccctgtggaagtatcttggttgtgacagagtcaagggtgtgtgcagcattgttggctgttcctgcagtagaatgggggcagcacctcctaagaaggcacctctctgggttgaagggcagtgttccctggggctttaactcctgctagaacagtctcttgaggcacagaaactcctgttcatgcccatacccctggccaaggaagatccctttgtccacaagtaaaaggaaatsctcctccagggagtctcagcttmaccctgaggtgagcatcatcttctgggttaggccttgcctaggcatagccctgcctcaagctatgtgagctcaccagtccctccccaaatgctttccatgagttgcagttttttcctagtctgttttccctccttggagacagggccctgtcggtttrttcactgtatgtccttggtgcctggagcctactaaatgctcaataaataatgatcacaggaatgaaygcatgctgaaaagaccactcttttgcacaccatctgctcaaagctcctcttgtctgtcctgtccgctttcagcctccgtctgtccacttattaagtttgcctttgtggtttagcttcattagatgtttatctgtgtaaaaatgtcccaagtgaggacttaagatgtcagggctcttctgatggcaaatgatagaaagagaagtcaaactagcttaagcaaaactgagagtgtgggtttagcctgtgtggggaaggatcagggaaggcttgaggttgggaatagggtgaggctcagagacaggacctagatcaagcttcagatggggatcagtgattgatgttgaaatcaaagctgggatgggggcagggatggggtggcagcttgggatgaggtcagagaaggatgaatgccaggaatcggtagagatctacaaggagggagagtgagagtcagggtcacagtgaggtgttgggaacagggagattcaacatggagctgggaccagatatggagagtgagactttggaatgggataagtgtgggggagtggtgaggctcagggagggggtgtcaggcctggaatgaatatcagggaaggcttagtagctataaggctggagcagaagacgtgcctggtagggtcaccatcctatctggagcatcatctaagatcttcttccggggccaaaagacagaggctcctcagtctgtcctgcttaagactctccaggcaggtgagtgaggagggagttaggcactcgagccctaagagatagacctgattcagcagagaagacaagaaggatgcaaaggatgcacagagaatctagggcagaaggctgagaactggggcctccttttcctctcctccctccgctgatctccctccacctctcctactgtttcctcaaagtccaacttcctccttcttcaccttatgcttctgcaaggacaactccatcagaggcttcagtaagtaaatagggatccacactgggtccaggggaaatgcaaatgactcataacctcatgaaaaatgctcagtctcactaggaactaaatgaggctcaaacagcaacaaaataactcagaagtgttttaaacaggggagggatatagtggactcttcaaacaagtgcaacatttttcgattggattttttttttttttttaatgagacagggtcttgctctgtcacccaggctggagtgcagtggtgcatacacagctcactgcagcctcaaccttctgagttcaggtgatcctccaacctcagtttccagagtagctgggaccagagctgtgcgccattatgcccagataatttttaaaattttttgtagatatggagtcttgccacgttgcccaggctggtcttggacccctgagctcaagtgatctgcctgcttcggcctcctaaagtgctgggattacaggtgtgagccactgcacccaggctgattggaaattttaatgcagcctgtaattttctgggtatagctcaagacacaaatgatttggatttcagatttttaaaaaatgtcaggattttggtacttagttaacagcatattgaagtaccaaaaactgatatttcaattactagatagggtgaggattagatccagtcagagccagggagagtgtttgccttaaggagggactcccttgtccaggatggggctggcactagggatggggtgaatcttaggacaggagtgggggtcagaaatgggaggggtcagtgatgagattgggattacagaggggatgtacatcagggtaaggtgagggacggggattaggatgtaacggcatgttctgcacaatgcttcctgatgttaaaatcctaaagtttgttttgtagccttggtgacaacgtttgagactctaaatcaaaatgtgaaaatctactgttttcccctaaaccagttccacttctgaccaaccacagcctctcaccaccccttgccctccatcccctggcccattcttgttaattccagcaaaaatactaattgacaatcaacattttatgccatagaggtaaaatttgcccctttctcagcaaagtagtattttaataagagtctttcagagactgaaaaatctcatagatgcaaatgagtaacatgacaatctcctctttggtctaaggatcgtcccaaagaggtgccttcctagagaagaccactcaccaagagacagtggtggagccctgtcttttgccgtttccatgcagaggtcagagaggccactctaggttccacccagaaagccacaaggagctaacggcggagctctcagcaccaatgttttcttgcagcctggtattcagtttttaaatccaaagtcttccttccaaccttcagggtagaaatgaatcaaagacataataaataaaaaataatcgaaatatgttaactcgactttttaagattaaattttctttctattgtctaagtattttatacacattgttgaaaaaacgaaatggctttatgaagcttataacaaaaaaccagcagccttccagctccaatccctgcagacaagggcagcagctgtcagctctcatagctgtttcatcggatagtgatctatatatttctaaatatcatacttgttctgctagtttttttcttttttttggtctcactcagtctcccaggctggagtgcagtggcatgatctcagctcactgcaacctccgcctccctggtttaagtcattctcccacctcagcctcctgagtagctgggactataggtgcccgccattacgcctggctaattattgcattttttggtagagacagggtttcaccatgttggccaggctaatcttgaactcctgacctcaagtgatccccccacctcagcctcccaaagtgctgggattacaagtgtgagccactgtgaccagccctctgctagttcttgtttttctccccctccaggtttagctatcatcactgactctctcttttggctttgagaatgtaatattctcccagtccctctcctgctttcaccccaatccaagcaaacacaaatactgccttctccattctccagaaacagatgccacattttttggttaagtcgacattcaatttttttgttattatgactatgtaaaaaattattcacagtaggatccaattttttttgtacaagttttgttttccctggaattgatgagaggatgttccatgtacttatcatgacatcagttccaatgtctccctcaatacattcacactcagcggataatctattaatttttctttctcaaagacctctctccgggagtccttcattgtcttcttccaacctggacaggtgactcttaggaaaggggccagttcctctttactaaattgctttgactatgtttccagagaaattttagaatctgcttatcaatttctatataatgtccagctgggattttgatttggattatgtagaattcatagatcaatttagagaaaattgacattgtcatattgagtcttccagtccatgggcacgatatctttctctatttatgtcttctttaatttttttgcaaaggatgttttatagttcttggtacacaaatcttgtacatactttgcaaaatttgtccctaagtattttatgggttttttggatgcgattacaaatgatatcttaaaaagttttcattttccagttctttttttggttaccatagtatatagaaatacagttgcagtatgtatattgaccttgtaacttgggacctaagtaaattcatttattggttctagtagatttttttaaagattgctttggattttaactgtatgccatcatttcagaatttaaatcttctttttagttttagaatgcatgatgtgtaccttggtggtgtttttcttcattcattgtgctgggcgcctggtaaattttcttaatctggaaatttaggttatgtaaatttatctggtattagttctttgacagtgttccacccttcgttttccttattctttaatttttttaaaagaattattctattttattttatttttgagacaggatctcactgtatcacctatgctggaatgcagtggcccaatctcagctcactgcagccttgacctcccaggctcaaggaatcctcctacctcagcctattaagtagctgggactacaggtgtgtgccaccatgcctgcctggctagttttaaatttttaaatagagtcggggtctccctatgtcacccaggctggtctccaactcctgggcccaagtgrtcccctctccttgtcttccaaagtgctaggattacaggttgagtcactgcaccctgcctatttaaaaaaaaaaaattaaaaaatcctcctgcctcagcctcctgagtagctggggctacaggcatgcaacaccacctttggctaattaaaaaaaaatttgtagagacagaatcttactatgttgcccaggctcgtcttgaactcctaggctcaagcagtccttcttccttggcctcccaaatttccggaatttcaggcatgagccaccaagcttgacctatttaaaaaaaaaaatttaggggctgggtgcggtggctcacgcctataattcctgccctttgggaatccagggcgggaggatcatttgagtcaaggagttcaaggccagcccgggcaacatggtgaaaccccatctccacaaaaaaatacacacatgcacaaaattagctgggcatggtggaatgcacctactctgggggctaaggtgggaggattgtttgatcctgggaggcagaggttgcagtgagccaagattgcaccactgccttccagcctgggcaacagagtgagaccttgtctcaaaaaaaaaatcctccttccttagcccccaggtagctcggactacaggcacgcaacaccatctctggctaatgtttaaaatattttttggagagatggagtctcactatgttgcccaggctggtcttgatcccctggcctcaagtgattctcccacctctgcctctcgaagtgttgggattataggtgtgagtcactgtgcgtggcaaaaaatatacttattttaaagtcagatccaaattgctttattatctttagctcctcaggtgtgaattctcccatttgctgttgactgactgttgattgtgatgattgtcagctctttgtaacattttattgttaattcatcttttgaaggcatttttttgtttcatgggagtcttgcatgtgccctggattatgaagaagtctattcaggggtggctttatggctgtacctgctagggccttactgggttacatagctcagagcattttttgttattgatatttcttggccctgagtttccacaccattgcaaatgacagatttgggtcctcatcacttgatactagggcttgggattctggaatgttcctcaattggccccttttctctcatgacctaggaaggcagctcacttgggggttgtgtctcaggctgcaaagtgcttttctatccccattcaagggcatggcagctctttcttggtcctgacaattttataggcaatcaagttgtagtttctgctatacatggggcctttagggtcactggtattatcattcccatccttaaggtacatgatcaattctagtatctttctgggttcctctggctttaatcctactccctgataagtccatacatttttaagctccctcttcatttctggcccttggagattttttctctctctcttgcctgctattgacctcagatatttatttttaaaaattaattaattcattcatttatttttgagacagagtctcactctatttctcaggctggagtgcagtggcgtgatctcagcttactgcaacctctccctcccgggttcaagcaattctcctgcctcagcctcctaagtagctgggattacaggcacccaccaccatgccagctaattttggtatttttagtagagacggggttttgtcatgttggccaggct

SEQ ID NO: 1664 - DNA, 321019 bp, Homo sapiens
  misc_feature (1)...(321019): n = A,T,C or G, or insertion/deletion polymorphism (see Tables 1-2)
gcacacccatctcagagactaaccaccgcaaatgacaagtgaaaaagacagagccgttacagctatcctggtcgggtttattttcccagactaccatgtggggagttgaacatacccaccctcaggtcggggacaggctcgtgacgatgctcagggtagtggtggagccccagaagcctccagtttccattttggacccacggagatctccagggtgcctatcactcttggcccaggcctgggctttccaggaacttccccgattgatgttttactgaacgtggtgccgaaagttagtcacaggaagacattatctcagctgtctctgcgcaaatgctctctgaaacctccacgttgcttttaaagcatcatggagaaatgtagcatttatgccttgggagccagctatctatgcagagctaaaatagaaaatcttctcaagttgagtataaacagatcctcaacaagactgagactcttgttgcttgtggctgtgtggggataggaatcagctacagcatcacttgtatttttcctgcccttggggtgctctgtggagaccatgtgatgccttccacagctaatgcccctaaggaaagaccttaggcagatacacactgaaagtatacacatctgtagacagctgtgggcaaggatgttggagtttagcatctctactaactcacctaatagtaaaaacgggaagcattgtgctaacattttttttagaacagctgcaactatctaaattataatacaatcttaacaatttaacattcagatacaattatgcagaatgaagtgcacccatcttaagtgtacagtctgatgtgtttctgctaaatgcatatactagcatagccaacaccccatcaagatatagagcattgccatcacccaagaaagttctttatgcctctccctagtcatttgaaactttccctctctacccacccagggcagccatgattctgatttctagctctagatcaatcttgcctgtttttgagctttacataaatgagctaatacagtatgtactcttttggcttatacattatgctttggagactcatttatgtttttgcatggattagtagtccattcctttttactgctaagcagtattgcattgaatggatatatcatgatttgtttatccattctccttttgatttacatttgggttgttttagtttttgctattatgaacaaagcacctattgacattcccatagaagtatttttgtggaattttcatttcttttgggtaaataactagggctagacttgctggatcgtaagttagttgtatgttttaccttataagaaactgtcaaacagttgacataatgcactcttaatgaagcttattacctgtgaagtgaggtcttttaaattttttgtcttttgatttttgtcttaaattgcatcgatattagatgtgtggacattcttctgaaatatcttaaggatcagaccttgattaactgtgttattttagtagatctttaatgcttctgagttatttatacggacagctcgaaatctgaacgactcccattggaaaaccagaatgatctctttcatggatctctcccatatttttatttatcttctttaatgttttatacatacaaaaatatgtagaacatgtgttagttattaagcatacttataaaatggaaatttgtaaatccgtcactcaatccaagagtgaactcatttccaaattacaatggaaacccatgtgcctatgggcttctcatcctctccaaaggaattcacatccttcattaattcttttgctaaaacaaaagcaaaacaaaggaaaaatattattttattatttaaagcaaaaaaaattttctgtaacttttaaagttttccttgctttttaagagctttatcaaaatggtgttacgctgtgtgcgtttttgatatttgtatatttttactcagtgtgtttcaaagatctgcccatgttgtgtggggctgtagtttattcacttttgctgctaacattcctttctgcgaatacatcacaatatactgtattacttgatacttgtcaattgttgtgctgtttctcacgtttgcacttgatgtatatgatatacattacattttttggggagtctggtacatttagcagaataatttgagatgaaactgttatcaagtaaacggcgtttttaaaaaatgaaaacaagcaatcagtttctgctccaaaagagggagaacctataagatacctgagtaaaatggtataaaataaaaagtttggtgcattgtcaatgtgggtataaagcaaagactccaattaatttttgtctacatgattttatttcaaggttgaaaaaataagtttgacttgtgtatgtaaaatataatcattgaagaaatacaaatcacctcctttgtccatgtggtcaagttagagcgtaaagacaacctaaatttttgttccttttttttccctaaatattaagctatataatgatacatctcccacttcactgtttaaaataacttaatacgattgatttcctactacttcaggaaaacacaaacatttaaaaaattcacaaataaaaatcattttagtaaaaaaaaaacacacaaaaacaaatcctacaacccctacaacaacctatatacatttaaaaattctatagacctctttatgttcttggggacaaataaacaggcatatttattactaatactaaaaatacattgggtagtatttgaagattttatattagcactagccttttaaaaatcagctctaaatttttgtcttacaagtatgtattaaaaattctgaaatcaagtataatgaaattatatatcaatattcctttgcatttaactccagagtggatctgcaggaatcaagaccaacctcatgcagagaacttaagaaatatttaaaaattagtagactggactttaattcttcatgtgtagtgcctaatttttaaataatacattttaagattctaataaatttatttcactgttaaatctaggaacatccaaaactgaaactctttatttaaaaatcaagctgaatttcagttaaacaaaaccatcccatcatatgaataactttcttaggtaaaacaaggtttattttctttctatacaactgactctgaattgagctagaaatttccaaggaggaaaatgatctaggaaacaactttagaaaaaaagggctaagtttccgttatgatagcttttgacttgttttcagctcttaaaaaattatttacgaacgatggatacacgttctaatgcagaagtattttagaattagagagtaaaagaaacctactaccttcctttacatcaggtcccttcttaccatcctacccgattgtttgagacaaccacttcttatctcgacaattcacaactcttttattagctatcttaaaaaaatttattactggcatcaattagcctgagtcatgaaaccggaccacattaagggcgacacayggtccaatcactgtttgtaaaagtccacgtatttcaaactcctctctcctgccactgctgrgctgtttccctctttgaggacctggtctccgcagcatttattcattagatggcagtcctaggggagtctcgctttggggaaacctctsctcctgcacattcaagaaaacaaccgcggagacttagggtcggtactggtttccagtcacttacgtagcaaacgaagcaagaggaacgtgcctgggaggacccgagacaggtgcgggtgggtttccgcagtagccgctgatcccgagtgcatgcggcgtgttcccgggtcgggaccgcrgccaagggaggcttcccggccccagcctccaccccctcctcggcgccccgggacccggacacgccccccgagcttcggagacccgcagcgtgcacgcgccccggccgctccccgcagccgcccacgtggtggagccctgagctgcgcgaggccgcggagagcgctcagggcgggcggctggtccgggaggccacgccagcgcgacccagccgagtcggcccccagcccgggcccccacatttcctcccccggagggagggaggcgactctccgcgggctgccctccccagcgcccgccgcgccctctggcggccgccgcggggacgcgcccggggcacgcggcgctgcctgtctgggccccccttccggggcgcggggcccgcgaggggcggcggggtcctctctcctcgagccactctgggccgagccacacgggccgcgcccttccccctccgctccccctgagcccccaaactccgggctccacggtcgcaacgccgcgggcaccccagcctggcgtgaaagtgcccggcgtagtagcctgggggggggggtcccctttctcccaggtgcgccccttccgccacgttcgggctttccagtacgcagcgaaaaaaatgccgcatgcacgcatttatttattttgcaacagctgcaagaaacaatgaagcttttcaagaaccggggaaacgcgctttccagccgcgctgttgttgttttcaatgaacctctcccagccccgcactccccgcccacccctcccctctcctgcccacccctcccctgcctagcctttccctggctacccacccctgccccgccgagaccggaccggcggcgggggcattgtttttggagtcgggcgggaggggagggcgcgtgcggggtggccggcgcagtgcggtgggggcgggagcgggtgggcacgcgcgcgtgtctctgtgtgcgcgcgggaggcggtggggcgggagatggggggcggcgcctcgcagtctcgcgccccacgcccgggctccgctccgcacgtcttggggaacccgggctccggttttttgcgcgcgccggcctgggccgggccctcggcgcgccgctgctgcggcggtggccgctcgagtgtgcgagcgggcgcgtgtgcgcgggccagggcgcgcgcgcgcgcgcgcgagcccccagtgtgtggcagcggcggcggcggcgcggcgaggctggggctcttgtttaccagcattaactccgctgagcggaaaaaaaaagggaaaaaacccgaggaggagcgagcgcaccaggcgaactcgagagaggcgggagagcgagagggacgccgccagcgagcctgcccacggccggcgctcgcagaccctcggccccgctccccggatccccccgcgccctccacgcccctcccgcgcgggggcagctccacggcgcgcctcgcctcggctgtgaccttcagcgagccggagcccccgcgcagagcaggcggcggcgggcgggggccgggcgggggccggcgcggggcgggcggcggcgcagagccgggcggcgcggcgggagtgctgagcgcggcgcggccggcccgccgctttgtgtgtgtcctggatttgggaaggagctcgccgcggcggcggcggcgctgagggaggaggcggcggcgagcggagccaggaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagtccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttgagaaaggggaatttcatcccaaataaaaggaatgaagtctggctccggaggagggtccccgacctcgctgtgggggctcctgtttctctccgccgcgctctcgctctggccgacgagtggagaaagtgagtatgtgcccgccgcccgcggccactgcgggaacttttcctccgaggggctgcgccctgtttgcgaaacccgagttgccaccgtcgcagctgtcgggcccccgggctcgggagcggcggggtggggcgcagggcggctctgccgggagggaggctgcagcggacccgggacccgggctcgttcgtctggagccccgcgggccctggctccgcgcatccccgcgcgggaagggcttttctctttctccgtcctgacagcccagccgtgtttcccggctaggcgcgaggactcggtagggaagttggtgccggggcgggctccgcggttcccgggccccgcgacccgcacctcgccccttccrtgcgcamgagcctctccgcacacagcgctgatccccctgcggcgcgcaggcagcagcgacagcaccctgggccgcaccgcgtctccgctgctggggctgaccgggcagtggggagcgggcagccgcccggcccgcggggtgcgagttgccctcgaggggggaggtgccctgcggagaggccccgaagccccaggacacgtctccaagcgcccgtcgctgcctcccgtcgcccaacgtgcttttgcccctcgggctcctcgggttcctggccttgcccgtcactttggcccgctcctcgttgggttacctgcccccggcgtcccggggctgggcggtggggtgaggggaagcgctctctgggcagccccccgggaagtgcgaggccgggagtcttcctcagcttgtctcttccggggagcgccactgggtccccagttcagagggctctgggatggtctcccagtttctcccgggccgggggatggaggggtactagggccgcatccgagtgtgcgttggtgggtgtgtggtcggagccgacgtgcattccgacacacgtgctcgcagcgcggggtgtagtcgccgcctcacggggacacctagacgcccgtccctggcgagaggtgtcgtacgctgtggtttcagcgccagggtctgcggcggcgcggggagggtgttgtgttttgcgagcgcggagccctggccttggttttgttgtggtcggcgtcgtgtcgccctctcttctgccgccccgcacttcctttgtacgtagttaataagcagtgtcgctccacattcgctgtcttttgcaatctgatagcttttgttttggtggtgtcgggtgggggttagtagggaagcgcggggatgcggggagcgagaactccccccggtgtctacggccggaggaggtgggggttttattcttctgaaaaagttgaaagtgtggcttactggtacattcaagatggtagggtaatttgaacacgattaaaagtttaaatgtcgcagaactgggactgggaacggtgagggcgtgttggtgagtaatggttgccgagggtatgcaggtggtgccgattaactttgaaaaaatcacgactgagccttcacgagtgaggcggggaaggaggaggcagcggaggttgtatggccccatcaccggggcaattcagaaaggctgtttctataaacaaatccttaaacgtctggtaagaaatgagtccgcgacggaacgagagcagatcgtggttcgcgtgtttactgccgagtgggacgcggactggggccggaccttccacagatctgggctctcctgctctttgttttctaaactttcagcggactcgattgggcgaaagccttccggctccctttactaagtcgtttaggtggtggctggggggacaaagragggtttttatctttaaaagataagtacggtttagaagacacgggagaaataatccattttgttatgttatgcagttgaactgtatagcttctctagttttgtgtttttaatgttctgaaattcaaaacagcagggatggccttcgccgacgcaggagtcgggcattttaaaataggctgtttttcttttggagcgttcttcttgaaggatattstttgtgcaagacggcgatttttgagaacacaggcagragggagggggtgttttaatgtatgtttttactccatgataccaaagcttccccccaggatccctttacagtggttagttcctggaaacctgatgggtggtcagaaggcaccccaaatctcgattatggtttgctgaagtcttgactgactcagtacctgcccctccctccatctctgaaatgtggagaattaaaagctatgcctgtgaacgggcgttcagtttttagcsgggaaggtgctagaccacttaactctgatagaaataagctgctgagccctatcagggagggcgttctttcagctgttgtctggtggagaaataaagacagggtgttggttcagttgcaggtattttgctggcgtattgagagattagagtttcctctttgagtgtgatggcagtagaaagagtgttgtttatcttagaaaacttagtttctgaagcagaggcagtcatatggatgtgtttgttttgtatcaccataatgtgaacagagcatctaaatgaaggcggttcggaggttctgagtgatagccagataatctgagggctattttgtttttaaaaagtcagcatgcactttaaatttattgtacccatctccttaaaaggattcagtcatctttctaccccaggcatcctgttgtcacagaaatgtaggtatgtgaaatgttggtgtttaaagaagttagtgttttattaccagaaggagaacccagaaaaagaacttctgaaagaacctaaacagcaaattatagtttagatcctctggagagacatagcaagcaaatggtgttttgtggaagggtggggtttgtgtcaggatttgaaatgtaaaaggtcataatgtttgatttgtcgaaaaagattagaaaagttcaactctaagaaatatgctaaggttgaatagatgaagcttaaaaatatcacaaaaagtgaaagaagtcagtcacaaaagaccacatatcgtatgatccggtttatgtgaaatgtctagaataaacaaatccatagaggcagaaggtagatgagtggttgccaggggctgggggcggatggaatggggagtgactgctrgtgggcacagggtttctttttggggtgatgaaaattgttctaaaattagtttgtggcgatggctgcatagctctaaatatacttaaaaccattggattatrtactttaaatcggggactttaatggtatgtgaattatatctcaataaaccctttttttttttttttaaagaaatgtgatcaggttgaaaataacttgttatgctaccttaaattacgttaaaattattacatayatttgacaggctgatgtctctctctcttttcatttatgagtttttcagatccgtgagttgcagcaatacaacaaactgataattgaagcttagcaacagggattcaatcccgcagtagaaatgggcaagcaggagaaaaagaatcttggttctatgtagcttcagttagggattgaggagctggatttaaaaaacacaaatgctggtggagggcagatttttgacaatagaaacctcagctgaatctgaaatgatggtttttttcaggatagagtttaggagctgagtctgaagggctgtttgtatttccagttttattatgttttccaacaaagaaagacattgctgttttaagatgttttaaacactcattttttgatatgccacattgaccacaagtggtagtaaggactgaggatgaacagaacagttcattttaatgcagtattgttgtttcttttctttgcagttttattttatttcttacatagttccagggtctgagcaggagaaagaatctttaggatgcagtagttttaggatacactgtttcaagtatacagtgatttttataaaattaaaattccttacagaacgaaaggttttaaaatgtggcaaaggcatttttgttttgaaactgtgtgcatttatccagatttaccctggcctttcaataggaaaagacctagagaataattgttgtttacatttgcttttggtctttgtctaaggcttagtttactaataaaaatgtttcctgcccttcctattgttgcaagatcagggcagtaatgaaaatcaactgtatcattttcacttgttgccttagagtttttgccaagaggaaccctcaagggacggtggtttccttttaaatctggtttcatttgttttgtaagaatgtgctgtaagaagcaactgaatccagcctgcacttattgtgcacctactgtatgaaagctgaccttgtgctactcagtgcatgaacctgcagagtcttgcatgaaaccacctttcttgaaattcagattttttttcagactcagtatagggtgcagttttcaagtagacagtagttagcattttaaaggttcttttaaaaatatttctgtagacttaggactctagtgttgttcatcagaagcctttaccctataccttttttgcctcattggtgctttccgttatattgggatgtcactgtagactgtgacatacaggtgatgttaacccatcttgactggcggcactgtcttctttataacattggatatggcaattgtgatttacaaactgcagtgttgtagttgcctttttccaaaaattaggagtcacaggtgtgtacatgaacgttgcatagcatgttttgagttgtaagaaagatggaacttatttcagaagttttctggattacatattgcttagttagctttctagaaatcaggaagcattcataatttcagggcattttataatttgtaaataacttggtgtttttaaaagcgtgagggagtaagagtgaggagacaaatcctgaaagtttttgttttttaattgtaaagcatacaagatacatttctttataggttgtgattttccccaatttgttttcaaaactcatttaaaaatcagacctagttcatggaagaggtatttgcgcctgtgggcgaacttgatttgaactgcttttcttagccagcttaggacaggtgctgagtccaggggatgagctcttctcaattgtactaaatatataatagttgcacacatgttacggatatagtttcttgatttccagtctgagatgttctgaaggaaaattctgaacactttagagacaacaaagtgcctaatgagtgatgcactctgatccctcctggaaaatggtgtttggcatcagcttagcaagaggaggttttccagttatttgtaaagatgtgatgtggctttaagtggggatgggggagggtagcagccccagtgtttgtggacattgagacctgttgacatttgggaagcataactgagttccactatttgaaaagattaaaactttgatatatgtacacatcccctcatgcctgcacccccatccccgagggtctggaaaagaattgatttgttctgaggaaggaacatatatttggaatataaaatggttagtaaacaaaggatctttwaaacaagttagattgttatctcaagagaagcatacttcctcggcatgatgttttcttttgttaaattgctttggttttatttgactcaaagtattaacaatacctttgattttgagacttttggacttttgaagactaagtttttaaatggtcaattttactcgtttgaaagtcccagataccatttttgaagatttctctccctttttttccactgatgccggctttacttatgttttattttcaaatcttaaggaaaaactgatatttccttacttgaactgagaaatagtcgttttccctccctcttttcttccacagtaaatacatgttgagtacttactggatgcagttctttaggtttagaaattatttgatactgtaaaatgtcttaccataagtttttaaagatacccgtcaaactatagatgttactgccatgtttattaaaaaaaaaaataaaacgaaacaaactagtaagcaagcttaaaatttttctttttcctgccctggactacagatttttttttcttttttttttttgagacagggtctctggtcacctaggctggaatgcagtggtgtgatcacggcttgattctgccttgacctcccaggctccagtgatcctcccaagtaggtgggactacaggcacacaccaccatgcctggctaattttttgtatttttagtacagacgaggttttgctatgttgctcaggttggactcaagcgatccactcacctcggcctcccggagggctgggatcacaggtgcgagccaccacccccagcctacaagaatttgtaaactcatagattgctcttctgttttcactggaccacaacagaaagtagtttcttttatggtgagggatgaacacctacgattgcaatataagttgttgggccttgtgtccatggagctcacttggtggttggtggtcttgaagcattcacattctttggagtagtggggcggctggctagtcacatggggaagatgtgcacacctgtggatggggccatcacacactgcagcgatagctgggcctaccttactgctcacctggctgggcacagcggctcctgcctgtaaccccagcactttgggaggccaaggtgggcagatcacttgaggtcagaagttcaagaccagcctggccaacatggtgcaccccctttctactaaaaataccagaattaaccgggcgtggtggcccgtgcctataatcccagctacgtgagaggctgaggcaggagaattgctgaaacccaggaggcagaggttgcagtgagccaagatgatgccactgcactccagcctgggtgacagagcgagactccatcacacacacaaaatacatatataaaaataaattgctcacctggtaatagtctggaaaacattttttttttgtttttttgcatattttaaagactttagaaagtagtcttgctaatccagaaagttcttgcggggaggagtttgaaactttgttttatctcactcctcagtcttagcccccttaataccataggtctctacttcagtaagagttacataatacgaatgccgtttgttcagaattgtgtatctccatccatccgtccatcgtccaaattctgcragtttgaaatacattgttgttgctgttttgtatacttttgttcaaccattttctttttaacatggcactagctttctcaaactggctttggaattatttgtcagtttaaaaataaataccactttaaaaattactcttgacatgggagaacaaatatattttgatagttgttagagcataaatattttatagagcataacttgaaatttttcctgatacattgtgattgctttcagcttgtcctctgctgtaaaaaatatagtcgtggttagtctctgtaaagttggttattgggaatatgtgcttgattacgtaaatgagacatcaccaatttaagtcagccaaagtttagtcaatagaactttaaagaacagaagtctaatggtaattagggagagatgaatttatttrtaggagttttccccaaattcaaagcgtcttagtgacctttgataacttcctggaaaaagtaggaagcatggagagaaattccaggtaggagcccatgatccaattgactgcatcagcttacaaagtgttttctaagtcattagctattaattctgtctagattgtaaaatccctctcagttgtgtccacatttatctgtgttgtcctgtatttattctctttacctaatttccctgagtctcattttagtgggataatacacaagcttacagactcaggactttaaagagaagcacagattgccacgaaaacaaatgaacacagagaccagtagcagcagagggagatctgctgtgaggcttcccttagttctgttgtctgatttctgtggataatgagttcactgcatatgttaggtcacaacatgatatcgtgtagtcgtaggtacagaacttttgttatggtagcctttcttcgtcaggtgatacaattgggattttctttctcacatgcacctcagtaaaattttcagcaacagagattggctcaggatggaatttgttcagtttcagttctgcagcctgtccttttctggggagactcattaattgaatgttgcctttcgatctcactgagtcacttgaaatcgctcagattgacccctattccgggatccagcctggtccagtgcagacctgcattgactctgactacatgctgagttggcctctgaaccagttcctgtaccattcccttagtctgatggacttgccagctccaaatactcagaacgtgcctcttgtggtcctaggatcaagtccagggtccttagaatcaagtaatgaaacaggtccttagtaatcctgtgctgtagggatccactgttagttcctggtactccccagcatctgtgcattagcttgatggaaaggaagctgtgttatgcctgtcttcaagtttttgcttctgctgtttccatagctgagaatgtttttcctcttcactactctgctacttctccttccatcctcaatactgaatagcagaaagtgccgcttaagaacacaggaaggtcaccatagctttagtttctccttagctgccaattagttctttggtcctaaagttattaacttttctgagtcttgatagaaatgcggagacttaaaaatatttgggggagacatttctccttttctcactaaacaacagaatgaaaaccttttctaacaggtttagaaaaccaaagtcagaaaaattgtgaggaaatagaataggttttttaaattgaaataatttccaagttccaggtggatctgtaaaatagggacaagatcataactttcaaaaggcagcacgctaagtcaggtgattcctttcccccatatgccttttctgtggtttgaataggtcagagatgccatctttacatttccaagtcaaattcctcttccttcttgaaggtttttgggatttccctaacttgtatagatctactttcccattactccttttgagttcataacccacggttttgctggttgacagtgatttgtcttgttccttgcttgtaattttattaggaccatggagccaaagtggctggtttgaatctcagctcttcastagctaagctctcaggcaaataatttaatcttcttgtgcctcagtttcctcatctgtgaaattataattttaatagaatctactttaaacattcatagaaatcaaattcgtacacatgtcaagtgcctagaatagaacctggcacctggtattaagcccttggacttcaactgctactgttcttagggttgtgacatcctcgaacagagatgttctttggatagaaatataaggcttacttgatgtttgattgtccttgccatttaaatatgttatagaacctggcacataggtgctcaataaatgtataataaaactttattttgctaaggtgtttattaacaagatggcatgttgcttattaaacagttgtgattttttttttcagtaaacgatggtcatccccctgcagtttgccttccatttcagagatctgtttattacactttctcccttaatattgtcatttgtcaatttctgctcacacctgagaggtgtccagtgtgcactttgcccatctcgcctatgcataggctccatctagtggccagaagggaaattcagcatattaggtgactgaattaatagtgccccaaggaggaagatagcgatcccaacccactctctggcttgcttcctggggactgattgcaagaaaatgtggatactacagacttctgtagaaatcactgggctacagttttggattaaggttactctactgtgtcagtgcgagctgtcctgagagaattagggtcttcctaagtgatgcagacaggcgyactgcaactccatggcagagctgttaacacctagtgtgtcttttacagttagagttttaagataattttacaggactttaataaatttaaagctccaaaatatttgagattagagattaaaaaaacactactgatttcatttggaaaaatacagcaagatttaccttccattgctctatttaaacaggtagtaacactttcattctcttctctctcccctttggctattctatgtggttaagatgctcgccagccagaaatactcacagagaataagaataaatacatccagtgttgtgttaggtcccacaccgtctatatttcgctagctaattttatgtattttgtttcatgttttattgatattttcagaatctttcttgctgagattacacaaaatatatagctggttattcagttttacgtgtcaaaagccttaaacctgtttccccatgattgccttttattatttttaattcggaaatctttgtttggctgtctgagagagaacttcagcctcccttcctcccagacattttgaacagttcaggctgtactcattcgtgtctytttgtcttggcaggtggaagcccctctgcttggaatagcaaacaatactaycagcttgccctctggcaagctcctttaagagttagctgtaatttcaccctctctctggccttgattctgcatgcagaatgattgcactgacttgagctcctgtggtctcttgctatacctcctatttgggcatctcccccatattgctttcccccaccattggggaggggaatggtaccttggttatctttgaattcccaggaggtggcccagtgcctggtgcataggaggagctgaagaaacggaagacttcttaaagggatactcgccattcactttgaagcacttctttgtacaacaaatttattttcatctgatcattgcacctctgctagccaaaacattttatcacaccagttactgctgcatggaacttgaaagcaataaaattatctttaaaatcattgtttgattaggctttttgcacattgaggtgaataaaaaaaattagaactcctggaagggtaatttgtgagtctggccttgtgtcaagatcacctcatccctgtggatggagactttgttccataagttccctatagataagatgtaatgaataattcattggcaccgatttatgtctgtagtgtgcttttaaaccctcytggagctgggttcctgaggaggaagcatctgcaggctggactcggctgcctggtggtctccggagtggcctggtgcagagggccagggtggcatctcagaaagttgggtgggtagggtacttgcacacctgctgaccttgagttacagggtggacctaggtcatttcacaggcccttccagccttcagatctcaagatactaggcagagagagagatggagatttgagggagatgtggttggaacaagcagaatcaccacgtatggaagttggcttctattttttgcattgttttcttggtgaggccagtaagcttttgcctcactcctgggagggacagtagcaaggtcttacaggtctctctatcattgaagcaccctcyccaaccctgccggttttggttgctggtgaaggcctttgacagtgtcctggtagggcgacggtgaggccagctcccgacctctggacagaagaaagcttacttgtctaggttggtgtcaaggggactcctgaacttaatgaacaccttagaaattatccttaaagtctcctcttccgaggagtggggtggnnnnnnnnnnnnnnnnnnnnaatgtaaacataatcatttgaagctggaatgttaatattcaagagtagcttgtaaaaaagcatcttgtgaaattctcatgtgaatgctgaaccggctggatgtgaacttagctggacagcctggcctgtctttgctctgctcttctccgtgcggtttgcatatgtgcagggcttcctttgaagccttgtcccctcaaacaattcactgtctccctctctcccacgcatggaggcatgttggaaagggagctccaggcctcagtgtctctgcctgtgattggaataacactgctctagcagggatgccaatgagaattagcaatagataatgtatccaagctgcccagcaaacctggcaaatagaaagcatccaataaatggatgcttttctctttttttctcctcctcatggtgggtggccctggtgggctctctctggggcctccagtcctccttccccacaacactggggaattgctgccagttgaatarggccctttttttttttttttttttttgagacagtcttgctctgttgcccaggctggagtgcagtggtgcaatctccgctcactgcaacctctgccttactgcaacctcttcctcccaggttcaaacaattcttgtggatcagcttcccaagaagctgggattacaggcgtgtgccaccacgcctggctaattttttttttttctagtagagacggggtttaggcatgttggtcaggctggtctcaaactcctggcctcaagcaatccaccgacctcggcctcccatagtgctgggattacagatgtgagccactgtggctggccaaggagggtctttttttgcacatctacagtgaaaggtttgaacccggacgtctgagtctcaggtcagttgttgaaaccactaagtaaccaccttgcttctctgtgcctgaagagaatgggtttttaggttaaccaggctgactggttcaaggtcatgtccctatctgtggaaggggagtgggagtggaaggtgagtggtgacagagtatggaaccctgtttctgatatctagattatttgagggcctccagtggtctctgctccatggaaagcatatgaaagaatatgattttttttttttactcgagcttgttgtctagttgggaaaactcaactactggtggagagtaacagatgctatgagtttagtgctaagttatgggatgctgaccggagagaagtatgtgggctgcaggcagtggggtcacggaactgcagaatggcttgagaagctttaaggaggatgtctgactttagtgtgccctaaatatttgactctcaagatccaaggaggcagctccccaggagaggaagggaccatgtgtggtgtgggtggcagtgtgcactgatggagtggagagggtgtcagaatccggtgtttgtgtggtgggaaggaattgactgctggctagagaatgaggagcgctgaaacctttgcaccattgcagtggacccgctgagaagggtgttctggggaggctgctctggtctctcgatggagtcaggattgggggacagatagacaccccggtgtgagccagtgatggtatagatgagggaggcagtgaggacaggctcagggagggaagtcttgtctctagacctgagaccaggaagcaggaatggactggacaggttggcccasctgagggaggtgactggtgagatgggtcctcggtgtgaggggctgggttgccagaggagctgtgggctggggtggtttgtcgagagagcagtcccagttgatggagaggcaggacccgcaaaacaggttggctgcaggactgggggcggtagcacagggcagctcccgaggagacacctggcacttttaaggcatggaatggagagagctaggggagagcacacctgcagtgaggcaattcacatagcaaagttctccggaaactgcagtgttcaacttttttaaagaatagctggatgttagaaaagtgraggaactgtcacctttattaggggcatcatggatacctggtagcatcaagggctagggttaaaacccgtggagtaatacgccctcctattgtgttcctctcctctaaaaatgaaggtgaaactgtttcaggtgagcgctgttgttgttcrtttgctggggcactgctttctgatttttagaggagtccaggctggagactgacccctgcctttttctgagttgggccggctgggcccgaggctggttctgggctgggccaggctgatgcagtggccttgggcttcccgaggctgggagagggcrgtggcccccgctaccctgaagagctggccaacgcggcagggctctttccagtccttaccatgcaagtgaagaggaacagtttgtttaaagaggggtgccagcttcacatccaggcctggactttgctactggtgcttttgaacttgtgttgatttatgtttgtaaattgactggacacattgtggttcttgatgagaagcaattgcccatccttagcccacgattagtgccactctctgggtgctgcctgttctgccactgtaactgttttcacttgacaaataacattaaaaaacacagttctgcaagagacttcctgggagggtggtatcatttggcctgtgggcttttgtaayactttcctgctattaggagagtgaattctgaattttcaatcacgttsacctgttggagcaagtagagtttcagacggtctccgcttttctcgactagaaagcaggccttctcccttttccccccagtcttgtttcmtgacaccattcccctctgagatgagggttggagaattagaagtctactgatgcattgtaccggggcacgttattgaccctctctgctctcctttcctcatctgtaaaatggaagataatgccacccatcaggccgagtgcggtggctcatgcctgtaatcccagcactttgggaggccgaggtgagcggatcacctgaaatcaggagttcgagaccagcctggctaacatggtgaaaccctgtctctactaaaaatataaaaattagccaggcacagtggcatgcacctgtaatcccagctactcaggaggctgaggcaggagaatcacttgaacctgggaggtggaggttggaggttggaggttggaggttggaggttgcagtgagccaagatcgcgccactgcactccagcctgggcgagagtgagactccatgtcaaaaaaaaaaaaaaaaagtgtcacccatcttggaggatcgttaccaatacttcatgagtgaatacatacacatttcttagaacctagggtttataaacactaggagttagctgatactattgttgctaaggatagaggaaatacgcattagaagttatttacttcctttaaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgccattctcctgcctcagcctccccagcagctgggactacaggcgtccgctgccacactaatttttgtatttttagtagagatggggtttcaccgtgttagccaggatggtcttgatctcctgaccttgtgatccgcccacctcggcctcccaaagtgctgggattaaaggcgtgagccaccgcgcccggcaggaacccagcttcatttcttgtaaagagagtttgacaagcgctccactggggatagcagcacagcttcctccttttctgtccctgtctccctcctgactctgcatctgcctccgtttgaagcatcctcctccagtaagtgggtcatttggattccaaggcccttttgaggccatggtgatggatcatttgcgttatcaatgtgaactgtggatgtcccttcgcccttcagtctcttccttcttcaaggagggggaggtaattgggggtcatgtggcctggggaagagcctggtcacgagcatgagggatgtgagtgggactatgtttccagccaaaatttagggcacaggatctgaaaaacacttagattaagtatctgcaacacaaattagggtattttaaattgaatgtggagaaccctgagaacctgtgccctttgtgcgtggatggctgcttgcaaggatgagcatccccagctggagcggcccatggctgccagaacaggagaaggcttcagtcaggtgggaagccagctgcagtgtgttgcctgatgcaggatggtgcgagaaggagctgctctcttgctctgctccctggatcgcacaaggtcttcctgagaccagaattcaaggttagtcctgtttaggcaacttggtagatggacttgaatggtctttgctaagcgaatattgcctatggtggtatttgcaaggaaaacaaaagtgttttgagcccagactaaccaatttaacaatgctagtaggtaaggatactactgtttgctttctgtgatgagaggtctcttaggaggaggggttaattcttttgatttaaaacttactacttgaggcaaataggcacatgaaaagatgttgaaagtcactagtcattggtgaaatgtaagtcagacccacaattggtacttcatactcattagtatggctattaccaaaaacaccagatgatagcaagcataggccaggatgtggagatgttggaacccttgtgccttactggtgagactgttaaaatggcacagccttttttttttttaacaggaagatgatatggtgcttcctcaataaattcatcatagaattgccatatgatccagcaattccactttggggtatatgcccaaaaagaagtgaaagcaggggctcgaacagatatttgtacacccatgttcatggcagcaaataattcaaaatagccaaaaagtgaaagcaactcaagggtccatccatagacgggtggataaacaaaatgtggtctatccatacaatggaatatcattgagccttaaaaaggaaggaaattctatgatgtgctacaatgtctgtgaaccttgaagacactctgcgaagtgaaagaagccagtcatgaaaggacaaacagtgcataattgttacccttacgtgagctatgtagagtagtcacattcatagagacggaaagtagaatggtgaggggcggtgaatagaggctggggggagggagcaatgaggaattggtgtttaatgggtacagagtttcagtttgggaacatgtaaaagttctagaggtggatggttacggtggttgagcaacattgtgaatcagtgtcagtgaactatacacttaacaagggttaaaatgttaaattctttgttgtgtatattttaccacaattttaaaaagcttatttctcaattgtttatgcgagtatatgtgtggaatagttggggagacaaattcaaggagaccagtccttgtccatggcggtcctaggtaccacgggatcactgcgggggaactgtgaggtcaggagaggccttgaaaaaaaacgcaggtttgagctgagtcagatggaatgggtctgttttctatatcaagagacagtattgcagataatttttttctttcaaggaaagcaagtcaggagtcaaactctcatgccacygtagtcacaaatgaaatttattgctaatcagccatgtgacgtgtaattgctttttcattttcttatttttccagaagagagatttgtttagatgtttgattccctcactgattatgattatactggaagtttttcatttgttttgacagctcaattttttttttattgtaaatggactccctcattacagaggggggagcccttgaaagaaagggattgacctctgcaggcaagaatctgagcatcctaaaagtagaaaagggctagaggcttcgccttacaggccaggaagcttggagggacgcgctgctagagaccatggcacgcatgctgtgtgtcgaaggccaggtccgcctgtctgcctctccagcagatactctctggggctatttttttctgcttggttgtcatcytttggtttaaccaggcgccagggctcaggcctggacctgctggattccaaagaagacttcgaggtggccgagcttgtctggcttccagaggagctttctctgtcccgcccgggggagtggctcaccttggtctgagaccaatgggaggaagcctgctgcgrgcaactggtctgtgcctggaagttggacttgcattttctctggacctccaaagcaaacccgaatgaccactctcatcctccccttttgcttgtttgtgtatgtgcttgttttgcctggtcgtcaggcaggaggtggtgtcagatgatgagaggtgttgctcgtccctgggttggttctcttacggggctgtatggatgtcttagctcagactgctgtgacaggttactatagactgagggctaaaaccacagacttatgtttctcacagttctggaggctggaagtctgagatcaaggtgccgaccaaatttggtttctgttaagggtccatttcttggcttgcagatgacaaatgtcatgtgtcctcacagggtggagagagcaaggggctctggtctcttcctctttatgtaagggcattgttgccattatgggggctctaccctcaggacctcatctaaacctgattacctccctaaggccccaccttcagataccactgaaggtatctgggggttggggcttcagtatatgaattggaggggacacagtcatgcagttcagaacagtggagcagtgtgccatagtgaagggatctccagaccaggattctctatggaagttcttggccaggtctgagagttggttacagatcattaaaatttacatggaatccagtacttgaaagtacatgtcttcaggatggcgctgagcacattcgcctctgtaaccaaatgcctgaaatgtgtagtgcaccttctgagcaccccagtgctttccttaaagtgaatgcagtttgagaggaactcaattattgagaaattttatatgaccccatttctctcattttaggacagataagttgcttattttaaactctgcaggagctacatagaggaagttatactccaggagagcttaaatttcactctctgaaaactctgttccatgtaagtacattcctcctctctcccctcctcagtgagcacgtacccatcagatgtgtggaattctattaaaagcagctcctcgtgaccctccagggttttgtaaagctgacaccagcatcagtgagttggaaggggctgccacagaagacagacttactgctgcagcccgcttcagagccctcagtagtactttttcctctcccagcaaatccaggaggctgggaaggtgattgttaattgtttatgagcattaactgtttaccagtcatacttactattttaaatctgaccctgccattatgttgttttgtttctgttcacagctgagctttaagctgggtagaatttcgtgatgagtcactcctatgactgtaaaatcagtatcgatcaagccttcctgttcatcctgtgagcagtttagagacagatgagacaggcttatggtttccactggctcggctccgtgcgtgtgcggattgggcttcctgagagcctggttagccccttttatctgctctctgaaacctgcgcaagggtktttagcatgcaccttgaaacctctgctgcctgaagacagtgtgcttaaatgaagggtatacaaacccatgtgaggttttctcttcccttttccatgaactccaccccaattacctgtttgaattttgcatgccagttattttcagggaactagtgacccttttcttgccaccctgggctttgaattgaaggccagtgtgccaccttttctttggctttgttagaacgttgccctcagggtcatatgtgctggctgctatgaattcttactgcttgatggacagagaaaggtgagggttagatatctggacagggcatgacagggcgggtcatcgagtaggaacattgggaccttttgcttccaggcttgagcagtgggtgagaaacactgtcttcccattagggcagtgggtgaaacactgacttccctccatcctctgggcagccttgtcaggtgggtgtggaagctgaggtgtgtctgccccaggctgtgcagtcagccccgtgttctagcttcccgtgccgaacctggccctggaggctgtctgcctggcaagggggctgcacaaagctcggaggggcatttctggtgcttggtagatggtaggcctgcccccagtgcactgataagagcatgggctgagagtgccacttggattcggctacagtgggcggcagagtgggggtgactggtgttgcttttactctagagcagaggaggcagatgaggtagatcggggccccagggatgctgagctgagctgggtagagagaatttggttttgtaggatttggagacagagacaaatttggagtgtttggatgttcggggacctgcaggaggtatgtgaggtgtgtaaaatgcagcccctgttttawaaagagcttacattgtctcttgagaagataaggtgtgcccagctgtggaatggaaccagatgcttttatgagtgaggatggagtgagcacactgggaaagagccctggaattggaggaagagatcattttgcccagagggatcttggaggtctcctggaggagggtacttagatgatcagaaggattatactagacttgatggggtggtcttggcatcagaactttaaaaatgtattttggggctggaagcaaggctggagaggaaggtttgtttaagttgtagtgggggatgaggctgggggcaaatcagggatggttttccaggtctgtaaaggctggggtaagaggaatggttggttcttaagagcaaaaaaaatcccttacatattggttctcttatttgtgctaagttaaatacatgggaggctactggtgtttatgaaataaccctgagcctttttggggaggtagtagtggatgtctgatggaagagatagaagactggtcccaggggttcttagtggcaccttcctctcaggtcatcactgtgcttttgcacattgcagttatatttgactacatttgattatggcagatttacttagaagggcactggaaaaaagcctcccaaattacaactgacacaggaaatgactttattttcttctattttttttctttgcttttctcccccaatcaacatacatttttaaacctgtcatctcacatgacctgccggtagaattgatatgtttaatttctgtagaaaataactggaaatatttcacaagctccagtagcttcctgttgtagggacccttaggactttggaatgagaagttttctattgagttgtcatatttggaaggataaaggtgccctcttttccctcgatccacatagtagactcctgtgtgcgggcatttgtttggtgtctcacgttgatgcaaatgcagccattgcagagtgagccccgctctgttactggatctccatttgctcaaaagagagcagtgtccccctccaaatctgcatgtctgaaagcattcatgcaggttcattgcatgggtctttgcattttacttagacttagcaaaaatcaggtatagtctttcctgaaaacaaaagtgaccattgtttttaatcaactgcagggtgtttggagttgtgaaatatttagggtcccgagtccattccagattcaacattgggaaagaatgagaaagctgaagcctggggcaggctctgtctgcagaaaccatgggctatcaccccctctccttagcagcattgtaaacaaacgtcatttgtaaggagcatgtcccaactgagcttgtaattataggggcaagatttgtgtggtggtaggggcatggagctggagactgggggcttccttattggttcatttatcctggcccttctcttttctctcaagtctcagctcttttaagattcagaaaataatgcaaaatgcctaagatttctgaaattcctggcttcagagacttgactacataaaagagccaggattttcaggctggccatttcaggatcagccatttcccacttcctgattcatagcttccaggatttgtaatgcctgtagacttttttctctyttgcttaaaagtggccattgaaagaaaaaataaatagcaaaatccccatcccagaagttctacttcctgttgttgtactattgagctctgaaaaacagctttgtaagtttargctcttgtttggactatttcagtggaattcttgagatctttttgtttggacaggcaagtatgaaggcgataagtcgaaagaactacagcttactcagcacagaaatgcagaggctcaaatttaagttcttccttagctttatggtgtgtatattaatataatccaagcaatagtgagttgcttagccagggtgcacagacattttccacaatgccagttgtttccctcataatgtttaatgtttatttttaaaggacatatttgggcacacgtttcatttttgcctgtaaaagaattgggaatatttatgattcttgcaacaaaggagaaggatccaaagtaaccaagaaaatgatggactggcagccttcacattttcccacaactcttttcatgaaataaaatgtagataaggctgggtgccatggctcacgcctgtaatcccagcactttgggaggccgaggcgggcggatcacctgtggtcgggagtttgagaccagcctggcgagcacggcaaaaccccgtctctacgaaaaatacaatacaaaaattagccgcgtgtggtggtgtgcgcctgtagtcccagctactcgggaggctgaggtgggagaatcacttgaacctgggaggcagaggttgcagcgagacaagatggcgccattgcactccagcctgagtgacagagcaagactccatctcaaaaaaaaaaaaaaaaaaaaagtgtaggttagcaaaagtgcctacagttcaaatgcttccatgctaaacgttgtatttcttccggtctcatttgtgatgagagtcataagattttgagaaatacaaaaacctttccagctttataggatgataatggcttggccactcaagtagttctgattgggttaactaattttggtccagtaatcatttcatttggggtgaatggatttttcccccctaaatacgggtacctggaaagttgaagcagtgaatctggtgaaacttaatcagtgatttcgtaagggttaacaaatgtttctgggtgggattcctaatgtccagcttcctctgtgtagctcagtaagtcttctttggagacactagcctgcattgtaagactgtcacatgggagcatctttttattttattttacttttttttaaaaaaatgaggtctttattatcctggctggagtgcagtggtgtgatcatggctcactgtarccttgaactcctgggctcaagtgatcctcttgcctcaacctcccaagtagttgggctgatagacatgagctactgtgccacgtagcattcttggggattattgtagggtccttttggaccacacatggttttatactctgtagctgattgatgtactggcatgtcagtgacattgtgtgtatcattacactatttggttaattgatgtactggtggaatagccatcttctggaggctcttgtttgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttgcttttaaggcagaaacacctttaactcttagtagccttacagatcatttttgaaaacacctgtgcttgccttgaatggggcggtgaccactggatccccccatgctgggtacatgttttgcagtcacagacactgctggcctcacctttggtggtgaaggaatgtttccaatttctgctgatggtgtagtgctcttgggagctgggtgctctgaatgagcagatgggcatctgcttttttaagcctgctgttcattctgcaaaatagttattgtgcaaatacctgataagcaccaggtctgtgccaggcgctgtattttgtattttgcatgtctgaggccagcatctttttccctgttcctttttctcctcatccagtgaactttccactgtggttgtagtttgtctgaaaaagatttggaaaaaatgtacagccatgtttctcttgtctagagaagctgtcttaaggacttcgacaagtttcattggcagagtgaatgagtggtggcctctgaatagttgaaatgttaatgctatctataggttctagagaatctgtgtctttaaaagtcatagcgataaagtctcagctttttgagagagtgggtttcagacatactactatacaggaaatctgattgttgcattgaaacaggatttgttatcacatcacggttagacatacccaaaaggcaaaaactacagtggtcatgattgctttacataagattttggaggagaaactgttagctccatgaaagcaggaactgtgttcactcttgaatgcctgctacctgcacatggtgaatgttctataaatgtatattaaagaaatggaggtccttagagttccaagatcaccgtcaatatcatcaccctaggcttcctcgtccttccagttacttcttttccagaagagtccattgcctcctttatatgaggtctacagagcgcgttcagagggctcttatcattgattcagcaatcacgtgtacacatagcactagaatgacttcacatatttgacctgtttaaaaataacgtgcagctatgacgaacagcgaacctttgattagggacacatttgcctgccgccagacactacaagtattatgtgtattgcttttttcaaattataatagtaatagatgattatgagaagaaaattagaaaataagttttctgtctctctataaaaggaaaataaaaattatccttaatctcaaggtaaccattgttaatattttgttgtgttttcctgagattttccccctagacttatatgtgtatctatatatttaaaaaaatgaaattagtagtatactatgtacacacatattgtgaatttctgcccataacattatatctttatcacctggaatgaggtctttaatgaaattattaaaattaaaattattctataaatgctaaatttaggtattttacaatttttttttttttttttttttttttgagacaaagtcttgctctgttgcccaggctggagtggactgcagtggtgcaatctcagctcacttcaacctctgcctcccaggttaaagcaattattctgcctcagcctcccgagtatttgggactacaagtgcatgccaccatgcctggcaaatttttgtatttttagtagaaacggggtttcaccatgttggccaggctggtctcaaactcctgacctcaaatgatctgcccaccttggtctcccagagtgctgggattacaggtgtgagccactgtgcctggcccattttataattttgatcattaaaaaatgatgtgataaaattattgtgtattgttgttgatacactactctgattaattctttgggctagattcctaaaagtggaaagtaaggaataagaattgtgtaagtgtgcatgatcctagataaatattgccaaaatattttgcagaaaattcttagtttcagcttccagaagcagtgtctgtcatccatactccaccagaattgaacactaaattgagctttgcaattttagcatttaaaaagttgtatcatttaatatagaatrgcagtctcttcattatgatcttcccttgcctagtaagtttatactcaagtcaaaatcggttaatcatgcatattgattccttgtttatctttttcttttaattctttaatacttctagaatgtatttgtagttaagtgaagtaagatacctcctcctgttgacgatttagtttccccacattgtgctgttttttttcttcactggattatgtaacaatatcttttcttttttttctttctttctttttttttttttttttttgagagagtctcgctctgttgctcaggctggagtgcagaggtgtgatctctgttcaaagcagcctccccctccccagtccaagtgattctactgcctcagcctcttaagtagctgggattacaggcgtgcgccaccacgcctggctatttttttattgtatttttagtagagatggggtttccacatgttggcctggctggtgttgaactcccggcctcaggtgatccgcccacctcaccttcccaaagtgttgggattacagacgtgagccactgcgcccagcctagagactctattttattagtgttttttgtagacaaagtctcactctgttgcccaagctggagtgcagtggcgccatctcggctccctgcaacctccacctcccgggttcaagcaattctgcctcaacctctcgagtagctgggactacaggcatgtgccaccatgcccggctaatttttgtatttttagtagaaatggggtttcactatgttggccaggctggtcttgaaatcctgactttgcgatccgcctgcctcgacctcccaaagtgctaggattacaggcgtgagccaccgctcctggccgagactctattttaaagctgtcttctcccactgatttgccttttgtttgtggtaaaatcattttgtcttaaacactgtagcttcattatacatgttaacatctgctaggaagaatctccactcaggttaaaaaaaaaaaaatttgaagcaccattatttcaggtgaactttgtgtgtgtgtatgttgttttgtttttgcaattcttctccgctactcttccaaaaaagaaaacacaaatttattaggttttgattgttaataaatcagtttgggagaaaacatttccagatatttgaattactcattcaaggacatttcgtgtttctccatttactcaactattatctatctatgaagaaatcacagaaggtcatagaggttgtatacttttccttttgggttatttctggttaatgaatgctttttgttgctaatgtagaaggaatctttattccccattgtttattttatatttttaaattttttttcaattaaaaaaaatttttttttcattcctgagacagggtctcgctccgttacccaggctggagtgcagtggtgcggtcatgactcactgcagccttcagctcctaggctcaagtaatcctccacctcagcctcctgagtagctgggactactggtatgcgccaccatgcctggctaagttttttctttttcttttagaggcaggatcttgytgtgttgcccaggctggtctcaaactcatgacctcaagtgatcctcccaccttcacctcccaaagtgctggcattgcaggygtgagccaccatgcctgaccttccttgtttcttttaggtgattattggttgtgtgtgaggaaagctctggtattttctgtacttatcttgtacctacccaatttgttgattgctcttattcgttataatagtctttcagttgactcttcctaatttttttgtgccgagaatcattgatgacaaataaggataatttggtctccatttttctggtacataatacgtctttacttaccatcagttgtgtgtcacttaggaatataaatggctgaaaataactgaaagcctgcctaataagggagtaggccgacaggggctgacttttctcaagttcaggcagtctggagggaaggagtctgtggctgctgtgaggtgctcaaagagggtgtgaggactgggctcctggcttctgtttgttcatccttagcctgtggcttttgtcctcgtgaacacaagatgacctccaggaattatgtctgtttcaggcaggaagaagttgagaaggaatgaagacaaaaggcaaaaaaggcagaatgacaggtcagcaagcgctgctcagccagtaggccctgcttctccttggccagaactgagttgcatgcagctggctagaaggtgggagatgaatgtgggtatggctagtgggttgggcatgggggttgggccaaccaagcatggttggtcatagggtcttgctgcattagcctgcacatccagaattgttacatgttgattacaggcatatttgtccttttttgtctatattaatgataatgcctctgtttctcaatgtgtaaggcatcttttggtttaagaggttttcatcatgttgaagaattgcctgtcttgttttcttgggtgatttattaaggatgggtgttgaatgtcatcagatgtcattttggcattcatttggattcagaagtggttgttacacctattaattgaggtaggaatagattacctagtagtaatccctcctcaaattcccgtgttaaactatttttggttgcggtgggtggctgtttaaattcctaattaaatttggtttgctaacatattcagattttttaatctcttattttaaatgagatagctttacagttctctttagatgagttcttttccagattttgctgtcaggcctagactagttttgtaaaatgaattaatgacttttcctttttaccttctctgtaacagtttttatagtgtggcaataaactgtcctttgaaggtttggaacaactcacttgttaaatgcctggaggctgacacttaaaaaaaaaaaaaagaatagtttttgttgtgtttctttttgttgttggtgttgtttttagtcttcagtgcagtggcataatcttggcccacttcagccttgacctcccaggctcaagcagtcctcccacctcagcctccctggtagccgggaccacaggtgytttgccgccacacccggctaattttttattttttttgtagtttttgtagagatggggttttgccacgttgcgcaggctggtctagcattactgggctcaagtggtccacctgccttcgcctcccaaggtggtgggattaacaggtgtgagccaccatgcctggcgtaaaaagatggttagtttttgttttgtgacagctttaaaaaaggtcttccatgggtgttggtctgttccagggttctggttctttcctctgatgctcttttttttttttttttgaaacaggatctcgctcttgtcccagatggtgtacagtggtgtggtcatggctcactgtagccccagcccactgggctccagcaagcctcccacctcagcctctggagtagctgggacccatacctggctaatttttaaatgttttttagagacagagtctcgctatgttcccatgctggttttgaactcctgggatcaagcgaccctcctcccttggcctcccaaagtgttgggattacaggcatgagccaccatgctggccttctggttctttttaaatcaattttagtaatttagtaatttccagcaagtcaattaaaaattatagctcagttgtatgtagtattttctgtgtggtgttatgccctctgtatctgttttctcagatgttttagttgcttttctctcttaatcttgattagayctgccagagctgtgcttattttgtgtccccatccaaatccagaattaattgccgtgctccacatgttttggtcaatggtggacctcrtctgtaacagtagtcccatgagattataatggggctgaaaacagtgctgtcccctagggatatcgtgtctgttgtagtgcaaggcactgctcacgtgtttgtgttgatgctggtgtaagcccactgtgcttccagtcagatgaaagtgcagcgcatacaattgtgtgcggtacctaatacttgataataaacaaccatgttactggtgtatgtatttactatgctgtacttttaattgttagagtgtactccttatacttattaaacacaaaattaattgtaaaatagcctcaggcaggtccttcaggaggtatccagaagaaggcattgtgatcataggagctgatggctccgcctgggttactgcccctgtagacttccagtgggacaggatatggaggtggaagacagtgacatggatgatccggaccctttgtaggtctaggctaacgtgtgtgtttgtgtcttagcttttaacaaaaaagtttaaaaagttaaaaaaaaaagttaaaaatagaaaaaagcttatagaataagaatataaagaaaatatatacaagaaccaaaatttaagaaaaataaagtttgtaaaagtaaaaaaagttgtgcttaagctaagtttaatttattattgaagaaagaaatttttaaataaatttagtgaggcctaggtatacagtatttataaagtctacrgtagtgtacagtaatgtcctcagccttcacattcactcaccactcactgactcacccgagggagcaacttccagtcctgcaagctttattcgtggtggtactcccatatacgtatgtatacttttttttttttttgagacagagtctcgctctgtcgcccaggctggagtgcagtggtgcagtctcggctcactgcaacctccacctcccaagttcacgccattctcctgcctcagcctcccgagtagctgggactacaggcgcctgccaccacgcctggctaattttttgtatttttagtggagacagcgttgcaccgtgttagccaggatggtctcaatctcctgacctcgtgatccacccacctcggcctcccaaagtgctgggattacaggcgtgagccaccgcgcctggccttttgtttcgtttttaagagacagggtctagctctgtcacccaagctggagtgcagtggcgtgattatagctcattgcagccttgaactcctgggctcaactgattctgttgtgtcaccctccccaagtagctagaactacaggctcatgccaccacacttggctaatttttgttttttaattttttgtagaaatggaatctcactatgttgcctaggctggtcttgaactcttggtgtcaagcaagtgcttggcctctgaagtgctgagattataggtgtgagcctggccatatgtactttttttttttttttttatccttcttactatatttttattgtaccttttctatgtttaggtatgtttaaatacacacatacttaccatggtgttacaactgcctgcagtattcagtgcagtaaygcactacaggtttgcaggttggtagcctaggagtaataggctatactgtatagcctaggtgtgtagtaggctataccattgaggtgtaagtatactctgatcacacaatgatgaaatcacctaactgtgcatttcttagaatgcatccctgtcattaagtgatacgtaactctgcttctttaagcctctgtagcactttggttatgttaggattctgtgtctttacaagtctgctttgctgatcgattgtgacatcttgagggcggctgcactactttctgcctgcaccttgtttcgcatgtctacctggcgcatgacatacacctcgttgttcagttcttgcttctctgcttgtgtctttgcattcaccaccagctattctgatagttatcaggaggttttcattgattgcagtctcgtgcaatgggtgcaggtaatgggtagccttatggaggagaaaatgcttacctatttgggttcattccaaggagtagttcaaggataaacctctaagtttggggagtgctgtaatttgctggatatgtgagccatagaagacagcttggatggcatctgatgcttcctggctgcagggatggaggcagcagaccctcctgcctggggtggttggttgccatccctgtcgggggctcatgctccaccctcaaggctattcttgggggagttgtgacatggctttcataaaaactcagtggaattttaccctgtgtattagttagtaaaggtgagtctggttcagttggtttgagtcaaaaaatctgttaatatctctgctttagacctgcatcaggctaatacttgaatttagggtctgtccctggtgtcatctgaatttttgtttgctatgtgtgaccaaggagatggtcactcttcaggatgggtgggtggaggggagaaatgctatgatttctgttgggtcatgtgaaatcaatttggaatgtggatggggcccttacactttttcttttgagcttagtgattttctgtgtagggtggagagcgattaggaaggaattcaccacccttaggtcctcaggcatagggtcttctaggggcaggactgatgagtgaacagcagggtggatggagcagaaccgttggaaccttcagggcaggacctgccaccattatttggtcacaggaagtgttcagtggtgaacttgttggaaatgattttgagtaacttccgtctcctaaatcatattaggactctttggtctcctatggttatctgagttgttttccaggaggagctgggaaggtaccaggagaaagatgactgtccctctcatgtttgctgagggtgttcctgtaaggtgagctagtgttccttttagggcccgtggagaccgaccttcacattgaagaagcatatctgtgctccgagatgttttcatggggagaagtgtcaggtgtaattataaaaggagtctttctctttaaatactgtaggcgatttagaaatagtggaggtttaattgaagagcttgtctacgtttttacattttccttaggcacagagaaactagtatctttctctgggttgcctttttttttggagacagaatcttactctgtcatccaggctggagtgcrgtggcctgatctcggctcactgcagcctctgccttccgagttccagcaattctcctgcctcagccttccaggtagctgggattacaggcacgtgccaccatgcctggctaatttttatatttttagtagagatggggtttcaccatgttggccaggctggtctggaactcctgattaggtgatccacccgcctctgcctcccaaagtgctaggattacaggcatgagccaccacacctggcctgggttgctttttaaattcatacctactgtcttatttgggtctcaaatgtgatcagtggttatacttttcttgstatgcatttaagttggagcaggctccggggcaccacttccctccctagagttgatgaacccctcatatcagtgacctccccatgtcacagtgtatctcgtgtgcactgctagatattctgatcacacagtgctgagattactggtttctctccctttctctttctgtggttatagggattctttaagggcaggcaacatgttctttgtttccataggatctgacaaagtgcatggcataggtaggtgttcatcaaaaggggtggaatagggttgatctcaagggttttaagagagatctgacgagtttgggtgtgtgacttaaaaagcagatacagcgccttttcacggatacacctccgtgattcctcaagtggtctggctgtgtttattttaggattctaaaagtaaagtgttctgttctgagtctttcacgatctgatgttctccagttctgtgaggtctcctcctttagtcccatcattggggctgtttctgctcggaaggccaggaagttgctggaagtctgctgggctttgcaaagggacttttgcttgtgtgggcattgcccagttgtgttacaacttgtttacagccgttggtttttaagggatgaggtaatcttagctcagcttagtgtaatacacaacagttttgtttattgagaaaatcattgttgaagtttttcagatgttagagatgttatgaattgcaatcaagtcggtatcctcttatataagtgcatctgacaagcccatttcacaactacatctcatcagtcacagttggatggcaaggtttattgtttaaagtttttgttttttcttttttaagttgggaaaggaagacagatggtttcagaagccaagaaagggcacaaaggcgtggatatttggaaatcgggacataattcaccattcttcttaattttttctgatctctaagacactgagacagctgttaattgaattgcttgttcacagtatttgagacgtaatgaaatgtgagtgtcctaatcacctggcgggcgtagatctttgggatcctcctggaggcttagtagggctgccctgagcagtattgtcttctccagctgggcctctgagctgtaccatgtgcccgtgctcagcctcagtccmtccctcagccagttgttaaatcactttggacgtgtgacagcctcaacatgtcacagctttaaaagttcagattttaaaaaggtaaggaaatgatctcctagtgagacaacttctgcctaaaaaataaaagcttctaagacataaattctrtgttatgaacaacttgcaattttcatagttttcagttttagctctggcagcctcwgatagatcttaaatatgtttatcacagctggaaaaatgttttattgtcatctttgtttatcataatatgccacctactctggttgtgtcttacaactgtagctctgtggggttttttttgtttgttttatgcttgctaatgggggaggtggggggtgkgggcggatgaatataaatgatacctagaaattgaaattggaaaaaaaaatgtattcagccagtactctttccaggttatagctaaacgtcagttggcaacctctatgctgtggtttattgagtaacacttaatacttarcacagccctcagtgaagatcttttatggccttttctgaatgttatacaaacataactaaagcttatccagatgaggacagggacctttctttccttcctttttaaatggagcaaaatttggccactgggttgctgtggatgagagagtagaaggagaaaggcagtcatcgggagactgtgtgctgagagagcgcatgtgggatttggcttcaggaagtctgggcttgcattctatccagcgctaatatttagtgagtgtgatttggggcaaattatttcgtctccctgagcttcagaatgtttgaaactttgtgaggagtctgaccccacactgtaggctccctccatgtatatatttcttcttccttttcctttttttttttttttttttttwaatttttgagatagtgtctcgctctgtaaccccagttggaatgcagtggcatggtcatggcttactgcagcctcaacgtcccaggctcaagggatcctcctgcctcagcctcctgagtagctggggtcacagakgtgtgccatcacgcctggctaatttttaacattttttgtagagatgggagtctcactatgttgcccaggctgcactcaaactcctggactcaagcagtcctctccctccagcctcccaaagttctgggattacaggcatgagccaccatgcccggctggaactgttggctttgaaraaraatgatgctgtgcttgcctttgcagtcctgtcaccatacttcctggaaagtgggtggacacgctggatggtagatgttgagttstttagatgcctggatgcttacatgctttgtgtgggttcttactggggctgtaacttactagaggacagactccaacttctgcttacttagtctggggaggttaataataatctagggcacccgcttcccagtgggtttccatcagtctcctccagcccactctactctctgttagccagctgggcacctcttcctctgtgtcccttcggtatcttcccagtggctctttccacgactggctcagaccatgtgtatatctgctcattgtctgtccagggtccctccaaagatgcctctgtgggctgggcccctggtggtgcttcctccagataattgttgaagatggaacaggagtgtgcaagaacaccagcgtgcttccagtattcaggtctagcggcaggtcccaggcatcagcggctcaccactccaccgcaggtagcctgattgcccagccttggagccgcagcctccttgggtggtgtggcagctgtcagtgtctgaaaccattttgaactttaaagggtggtgtcagacagcagctattgaggctacttaaaagaatttttttaaatgtacgagttcagtggcattaagtacattcatattgttgtgcaaccatcaccactgtccatctccagaacttgttcatcttcccaaactgaaactccatgtccatcaaacaactccccattgcctttttccccaagtctttggcaaccgccattccactttctgtctgtaaatttgactrtctggatacctcatgtaagtggactcgtacactatttgtccttttgtgactggcccattttatgagcataatgtcctcaaggttcattcaggctgtagcatgtgtccagaatctccttcctttttaaggcccaataatatttaataatatatgtatgtgtgataacacatttatataatgtccattaccatgtggtatatatgcttatccatttgtctgtcgatggacacttgagttgctccccygctttggctactgtgaataatatgactgtgatcatggatatgcaaatatttccttaagtctttcagttcttttgggtatatacccagaagtggaattgctggatcatatggcagttctatttttaattttttgaggaaccactgtactgttttccatgtagactgcataagaattccaatttttccacatcttgccaacgtttatttttatttatttytttaaattttttatagtagctatccattctaatggatgtgaggtggtatctcattatggttttgatgggacttttgagttttagcaaatatcaatgaagtatttaattttttttttttttcttagagacaggatctcacattgttgtccaggctagagtgcagtgatgtgagcatagttcactgcagcctcaacctcctaggctcatgtgatgctcccacctacgcttcctcaatagatgggactatgttcctgcgccatcactcctggtgaatttttaaatttttgtagagatgcggtcttggtacattttctaggctggtctggaagtcctggcctcaagcagttcttccacctgaacctcccaaagtgctgggattataggcgtgagccactgcacctggcttatttaaatttttatgggtatgaattcacttaaaagctgaaggttttgagaggagagrgagcatrtgaaaaaacctaaaggttttgggaggaggaggagaaggaagagagggagcatgtgaacaagagcaactgattacttccttgtcattcatttgcccagtgtttactaagcacctgctgtgtctcagacctgtgctggtttggcccttgtgaaggacagtaaatacagtgcagttccagctgcgcatgggatcacagtccagtaggtaaacgagtgcctaaacttaagagaaatgagtgcagttggggtcctgtggcggtgaaggggcgagtctgcacccaggcgagtgttaaaggcctggcctagagaagatgggtgttttgatggaaggagctgctgggaascatgtgtactcggtgtcttggagtttagaaacctcagttggctccatgtctcgtccttagtaaaggaatatcgggagctgagactggatgtattgacacaggtcaaatcacagagtcttaggccatttcaaggaggttggatttttctctggaaggcacagggaggttttgaaggacttaatgcagaagaatgggcactgtcaggtttgtggtttggaaagtccgccttggtagtagggtggagggtgcattatggagggctagaccagggtccagcccccagcgagatgctgtgtggtaaccaggggagagagaggtggtggtgttagaagccacgacttggcatagaagccaaagcatccccaggttgtcattgtgtaattaatggttaagttggggcaagaaataaagctcttaaaagtgtccagctgtagagctctctgcctgtttttatcttcagatttttgtctttgccatctctggcctccagtggaaggccgaagttacttaacttccttgctggaagcagggctcctcatgattgccagcccctgtttggtagtggtcctggagtgctgtggaaatgggatacttggtgccacttaccttggggctttgctcctgaactgcagcggtgtcttgtgctctgtggtttgtagcatggaacagaggctgatgggcggggagtttgagtcccagtgattgaggccccctgcctgcctgcaccttactgaaggaaggacatggtggcttctcagtgtgctctctggtgatctgaacctagattcttgtttcacgggtagggggcagggttttggattcagccctggccagccctggcccaagttcatagtgtcagtagtatagttctcccaccacccccttctctcctgctcctgttttctcccccgccccttctctcctactctccttcctctcccactctccctcctctctctgcctttcacttccccccacactctctctcccccgctcccaactttctttctctcttcgactcaccacacaacacacacctgtgtgtgtgtgtgtgtgtgtgtgtgtgtgtgtgtgtgatggcactgttatttcatgtgtatacctttgcgtagcgttggcacatgtgggaatgctattataatgctttcgttgggggtctgtgctaaccactgctgagtgtgcttcatgttttctagacagcatgagaccagagctctccaccttgccattagctggtgggagaattttgagaaagtcacccaattgctcttaagtcctcatttttttttttaaatctgtaaaatggtatcacagatgcttatagctcaagactagttgatgagggtctgtgactcaaaaggccccatagatggggttcagagggcctttggaaatggcgtgcaagctctttgtaagtgtattttttttggagaaagggcccagctttttatcagacatcctgagagattcaggacctaaaaaataaaccttgattaatcttggaagcctctttttacgcagtacgctttgattcatcagtatatgcatgtggatgggttctcagatggcctgatgtttctcctccttcctctgtgtggtgggcgacgactttggctgcccagatgttaacatcagtaagcagaagctcagtcagtgttagcaaaattaaatcactctgcaaaaatcaatgttagtgaaattaaatcacttgatcttaaaagcagcatgaaatagcagtttttcatcttcattgtgctgttttcccactctagatatcttgcagattttttttggttgcttggttggttggtttttggcgtccttttcaaggacaagcagctttggacagttgcactacttttttttttttttttttttttttgacagagtcttgctctgtcacccaggctggggtgcagtggcgtgatctcagctcactgcaacctctgcctcccaggttcaagcagttctcctgcctcagcctcccaagtagctgggattacaggtgtctgccaccacactcggctaatttttatatttttagtagggacaaagtttcatcatgttattcaaattcctgacctcaagccatctgcctgccttggcctcccaaagtgctgggattacaggcgtgagtcactgtgctcagccagttgcactacattttttttttagatgccattgttgaggatccaggggtttgtcatagattgattaatcagaaagtattaatctaaagtattagaatatattgattgcaggcagggaccttgcatagtttaaagatgactcagaaggcacattaggttcttgccacactttgctgccatcacagatggatgtgagttgcccccttatataggtctctcgggatgccccagtggagaacagcattgatgttgaacagatcctgtccgatggagagataccagcgtttcagccagcggtgtgagtgagggcaggggccacctctgagggtgcttgctccctcacactgtcctcacgctgccctcaagctgtgggcaaaggagagggatcctgtgccatcacagccctagaagcagaattccaaaatgtgggctcctttgggtgtggtttgggggtcaaggagatagagcaagtaaggaatgaactttgagggtttatgatcattttcatgatgataatgacctaaaaacatgcttggctgggcatggtggctcatgcctataattccagcactttgggagactaagacaggaggatttcttgagtccaggagttcaagaccagcctggacaacatagggacaccccatctctacaaaaaaattaaaaaattagccaagcatggtggtgtgcacctgtagtcccagctactcaggaggctgaggcaggaggatcccttgagcctaagaggtcaaggctgcagtgagccatgtctgtgccactgtactccaacttgggtgacagagcaagactatcccaaaacaaaaacaaaaacacatgcttatggtaggcaattaaaacaggaggtaaggagtaaacatgccaggcccctcctcctctcctctgactcttccttcttcccccctgcttcccaagggtaagctttgcagatacttgctatgcaagcaaaaatgctattcttagccatcgtttaaacacagatttgcaatttgtggtttttcatttatataaattttggctctcttcctatagcagaatgatctttgtttttaaaatgattttaagtatacaattaatatgtgaatgtatgtttcttatggaaattagaacaatacacagttacagagtagaaggtgataggtgatatagctcaccctctcctcttcctgctaytctccccagtctgcttcactccccggaaggaactactggcccatcagcatgtctccttccaggcattttttccatgtggttatgtccacctgcataagaaactgggggcggcagggtggggcggtgttggcgggtcaggcagaagcaagccacagagcagtaagggtactttttaaaaaaacatttaaatagatccctgttgtcctgcggcttacatgctcatgcatactcactgtttctttaaataaactttttcttttagaatagttttagatttacagaaaagttgccgcgatagtctagagagatcccatgtacctcttaacagcttcgcctctgttaacattctgtgtcaccatggtaatttgccacagctaaggaaccagcattagtccatgactgtcagtgaactaaactcaagactttttttggattttaccagttttgcccaatgttcctttcctggtctaggatcctgtgcagaatagcgcatcacagcacattacatttagctgtctccttcacctcttctggtctgtgacagggtctcagactttccttgtccttggtgactttgacagtttcgagggacactggccaggttttgtgcacactgccccttaatttggagttgtctcatggttttttttgtttttttttttttttgagacagagtctcactcgtctcccaagctggagtgcaatggtgcaacctcgactcactgcaacttctgcctcccaggttcaagcaattctcctgcttcagcctcccgagtagctgggattacaggtgcctgccaccacacccaactaatttttgtatttttagtaaagatggggtttcaccaggttgggcaggctggtctcgaactcctgacctcgggtgattgcccacctcggcctcccaaagtgctaagattacaggtgtgagccaccctgcccggcccatggttttcttatggttagtctgggaccatgggtttttgggagcaagaccacagagctgaaatgccctcccttcagtgatttgtcagcatgacctatcaccattgttgttaaccttcaccacctggatgaggcagtgtatgcgtggggacatacatctatttgccccactgacatgagggttggatctctagaagaggagtcactgttcagaggttataggcatttgtattttttggcagatgttgtccttcaaaatggctgtacacatatgctcctcccaaaagtaggagagtgcctgttgccccatgtcctcactcaagcttggtgttattagattggtaatttttttgtgtgtgaatctgttaagttaaaaatatttctttctttggccgggcacagagtggctcatgcctgtaatcccagcactttgggagtccgaggcgggcagatcacttgagctcaggagttcaagatcagcctgggcaacatggtgaaaccccatctctaccaaaaatacaaaaaaattagctgggcatggtggtgcttgcttttggtcccagctacttgggaggctgatgtgggagtatcacttgagcccaggaagttgaggctacagtgagccgagatcgtgccactgccctctagcctgggtgacagtgtgagaccctggctccaaagaaaaaaagaagattgattgagatagggtcttgctctgttcaggctggaatgcagtggtgtcatcatcatagtttactgtagccttgaactcttgggctcaagcagtcctgctcctttggcctcccaaagtgctggggttacaggcatgagccactatgctcagccaagctaaaaatatcttagtgtgcatttctctaattgtcagaagtgtatttatttaccataccctggaaaccttatgtaagatgatggtgagtttggactttccagtaacatttggaaactgtttagtaccaagctctcattaacaatataaacaaaataggggtctacccttaaggaatcaaagccattatctaaaagctctttcccgcaacaactacctgagataatgtccttggtcatatgccccagcatttaaaaatggagttagtgagagtctgttgtttaccacctgatacattggtaagagctgcttgatggtatggggacatcagtagggaggatatagacgtagccacccccgccctasatagtaggggcctcagggtggggtaagcctgggtgggggaggtatgagtggtggaacagtgggagaccctggatccttagtctccagcgtgattgcattttgccaaggctttgtcccatgtccctttgtcccgtgttccatttgcccgtggtgttgcctagagagcatggagrggctggtggagcatgctctgtggttccctaacccagggctgtgtggggagagcttgcagcacccccctgaccccatatgaacgtccttgctatttcctgctgtgccatccagcaactataggatgctgtgctgtggctgggagacctgtttggtcttggaagctgggtcctggatgagcagaatgaggcaggcatagaggtgatgttggctacgggcaggggagcrtttgctttgccttggagtagtgccatttccatgtagaggggcaagatttaccaccctgttgtggggatttgagactttgggttttgttttcctttacaccttgagctttgttctacagcaggtccctgggaagactggtccacaaagctgctgaatggggctgctgtccwkcagccctgcctcctgctgcagaatgcagaggacgctgtagacttgcttggtgggtgcctggggttttctgcctccctggtgcactgggcacagcggcttgcctgccttttgggtcgtctccacctcccagggatgtttttgttccctgatcgaatgacytcctgttttgtttgttttttgagacggagttttgctytgtcacccaggctggagtgcaatggcatgatctcggctaactgcaacctctgcctcccgggttcaagtgattcttgtgcttcagccttctgagtagctgggacttcaggtgtatgccaccatgccacgctcatttttgtatttttagtagagatggggttttaccatgttggtcaggctggtctcgaactcctggcctcaagcagtgcgcctgcctcagcctcccaaagtgctgggattacaggcgtgagccaccgtgcctggcctgacctcctgtcttctgtttttgcccactgtcaagggtagacttcttcaaggctgtacttgtgctatcctaaagaggagtaatgggagacatttctgactttgtcagcatgctgcttggcagcacctgcctcgtttctggtgaccatttggaaatgtgtcctttatctggtagcaaggagcatttacattgatccctatgcacttaattggcatacttttattcctctggattttttttttaaagcataattgttcgtgtctacatgatgtaacatgctgctgacttttaagcaaattaacagagttcgtgctgaagcgcaagggtgcagggaaacaaaatgggagggttattaaaggggtgaggcggctcctcaaagatgtcactgcaccattcattcttgtgttcctggcccatggcaggctcattaatcctccacgacaatccattagcatgcctgtcaacccttcagagaagatgagccataggaaggcttagggatccccacttgaactgctgtgtggctctatgaacatccccaccttcctggagtgaggtggttgtggccacctgactttccccattttttttttttggacctcagcctccagcgctcctgggccagactcagggtgggggggatgcaggtgccagtgactgacacttggcccctcacacttcactgcctgatttgctttaaaggcaagggttgctcatgcttgtctgagctctccatctgtttgagaattatattgttctcaactggaacttgtaaaagagaaaaaaatgtacttctcaatttccatggaagaatatagattttctggtggggtggaaactttcttagcatgaagggatctttgtgtgatctgcgcatcagcactgaataaagaatgggtgcgccgaagtcggggaggccgactttcctgtggcttgctggggaaagtttgaactgtgtgtaagcagtgcgtggaaggaaagctaagtgtggagataacgaagggaatgggatttaatagaaacagggtgtgatgagtggcagttgcctgatgaagtggaaatcttgtgttccaaatttgtgagatccatttctgtcctctaaggaaaatgttgtatgtgcaggaggagttcatgtagttgggttagattgtgttttctgtctttattttttttcctgcctctatgggttgtgaacaaaaacaagaatttgatattctgcagtatagttaactcgtgcaaacagtgtatgcttttcagtgggatataaggtctgaaataataggattttccctagtaagtcagtttcattcctttacatgtgggttatgagatacaaagtgaagctctgtaaagctttttacgagctccctgtgttgccctcctttgacgggtcaaggcattggggttgacagaggtttctactctcagaggctttaaagaggtgcccactctggtgagatggctgtcagcatgcacgatgtgtgtgagagagcacctcttcaatcatatgcacctggctgtagcatccttgtcagccttaagagatacctccaaagcggaattttctacccctagaatcatgtgaggtcatctcaatttaagccccagctctgctccctaaattacctgagtgatcccaggtaggtcatttgctcattgttaaccatcagtttccttagctgcaaaacagagcagataacaccccaaaagagttctcatagtaaatcacatcaggcttacacaatctcagaaatgtgcagctccacaggaatcttcattacctctttaggcagtccagtcgggtttcaaatgaatcctactgtctgttcttatatggaaccacagtccctcaccctgtgttgatctaagttctctgtttctctcctccagcagggtcataaagagcctgaccagtccccctccctggagacctttgtgtgctgggtttctgcagccgttctccatgagaagggacttctggtccctgctctcacttggatgttcttccactgacttatctctcttaatgtgtggaggcagaaacccagttttcagggtctctcccctggccccttactaagtctcccttaggtacagtctaagactgcctgactttttcttctttttttttttttttttggcagccacaacatcacatcgtcacatacagaaattatatccaattaaatctcctaagtctttttcacacctcctacatttgtgcatttctttttttgcacccaagtgtccaaatagcatttatttcctctctattgcaattccaatctgttgatctttttagctcttgactctgtcatccagtgtatttgccattgctcctggaaacttgtcatctttgaattagataaacattttatctgtgccatcgttcaagtaattgataaaaatgttgaaatctacagtactcagaaagagacctgtggcctcccactagagaccttccttggtctgttcattaatcagcactttgtagggtaaattgaacatttactaagctattcagatgtagttcatatttcttcaccttgtcaacaaagagatcttagcaaggcattgtagaccaagtatgtgttcctggaatatacatattaagaaaaaatccttatgccaagaaaatgggcacatccccaaaacccaggttattgtagtttacggcttctgacccagggcttcactttgtagcagtgtttttcttctgtttttgcctttggctgataccactgctagagtgcagataagagaatgttactaccagggggcttgagtgtcgggctatgattggctgtcatctggagcagagtgggactgagctgctcaggagaaaggtcttcaggtgattttttttgggaagctaagagcactggttttagacatcctctcctggctgatgatgggattggccttcatggggctgctgtctggctgggctggtgggcagaggttcctgtgggtgtggatggagaaatcctaaatgccgagggtrcctggtcttagtagaaatcgtaggatgcctcagtgaagaagtcagggatgcggattgtcctccggatgcttggatgagcgtgcagtggaaaaagtactcctttgggggaagaggtgaatctggaggtgttagagcagaagagtaaatgcagaagttgtagcagatacaaaggctttggcaagagtgggagtgatcattgaagggaaggcaggggcttgctgggacaggctggagccgtgatggaccctcatagtaaccctgctgcattttacaaaggaagaactgtgttggggtacagatgtgccaaacactcaaagttagaaaatcaacgcagtcggttgtggcttctgcccttgaaacatcagatagtgagaacctgccactgttcagtttgcagagtggttggttgcatacagtgttttagctcttgcccactcaatacagaggttgcatgcgggcgtccacctgctccgccacctctgcctgcttgtggctgtgtgcccagagcccatttccctggggagtcagtgcagcactcctgggggacccttctgtttgtgtcctgacgaatctgactgtgctggatgcagtcccacagccacacctggtatgggtggcatctttaaaggcctggcctgtgtgtgctgtatctgcagcagagctgtggccaaacctgctttccttccatctgggttccccttggttctcggtggtggacgggctgtgtggtctcccctcagctgtccacttgcacttgtgttaaaatgcggcagaactttccctctatacttaaattgtggtgaaatacrtatgacataaaacttaccatcttaacttttttttmttgagacaggatctcattctgtcacccaggctggagtgyggtggcgcgatctctgctcactgcaacctctgcctcctgggttcaggcgattctcatgcctcagccacccgagtagctggaattacacgygcccgccaccatgcctggctaacttttgtattgttagagatggggtttcgccatgttggccaggccggtcttgaattcctggcctcaagtgatccccctgcttcggcctcccgaagtgctgagattacaggcgtgagccgccgcgcctggccttccttttttttttttttttaagagatggagtcttgctctgtcgcccaggctggagtgccgtggtgcgatcttggctcactgcaacctctgcctcccaggttgaagtgattcttctgcctcagcctcccgagtacctgggattacaggcgccaggcaccatgcctggctaatttttgtatttttagtggagatggggtttcaccatgttggccaggctggtcttgaactcctgacctcgtgatccgcctgcctcggcctcccaaagtgctgggatcacaggtgtgagccaccacgcccaccggcctcccatcttaacattttaaagtgttcagtttaagtacctttacactgctgtccaatcaatctctagaacrcttttcatcttgaaaaacggaaactctgtacccattaataactcccattctctcctaccacagccacgggcagccactttctgctktctccgtgagtctgactactttgagtacctatgagcagaatccgcaggatttctccttttgtgactgccttatttcacttagcataatgtcctcaagctccatccaggttgttgcatgtgagaggatttccttcctgtgcatgaactagagtgatgcagggactgacctctggccatgtgatgggtggttggtgatggatccaagaggtagctggtctctgaatactagcccagtccttttccttgctaggaaagtccccagatcagatagaaagcctcagtatttcaagaagcttctgttttgacaccacatccatgaagaatcacactgcagggtaggggaacagatgagtgggatttctacactgttatcagctagacttagataactggctaattgaaaagagtacaggtcacttaaggaaactggagcattgtagggcaaggtaaagtgcttttgaaatgaggatgtgaactgtaactggaatgatgtaatgtgttctacaaaatgaagccagtgagaggacaggggacacagggccgacttttatttaggacatttgcctggttctgagaagaaagttgaaagtcacgagagagagggaaaggaaggcagaaggaacttggtttttgcaggtgcctgctcagcatgggccttgccccagcttggctgtacctcacagcaccatccactggctctacagtctgtccttcggaggtttagggtgctgtctcatgcacagtgggtgctaggtggtagtgaggacagggtgtgggactaggcaggtgctgcccctcggaaggcctcatggtgaggcaaagatctctggctccgagggactctatctcctggtgtcctgcttcatcgagaagccagccacccatgggaactgtggataattagaaaggcttagaggctcttctaagggtgttttttgaaatatggagacctagaatattgggctttgggatattttaagatgagaaaggcatttggagtaactgtcagagcagataaagttgtttttatgaagatccgggaaaacggttgttacaaatacagctctgcaccaattctgcgccagtctgtttggctacagatgctttcagtggaggggacactggggcttgtgttccctttagtctttgaattcccgttaaagtttccatgtcttaagtggcgtggcaggatagaaacatctcacccatcttagtaagttctttgctgtatgtagcactctggttttaacgttctgagccttcaggactgcccttgatgtgtgcatttattttgttgatatgcatgatgtgtgggtggctctgcggcagtaaaacagttcacattcaaattacactcggtttctaatttctgttctcagagtttcctctgtaatggaaatctcttacattcttatcattgccttcagttattgaatgtgttaggtggccaggattgctgtctgtgtgaaatgggaatgtatatatacaacgtaaacatgttctgattgacacgtgaagataaagggcttaacatgaattgtgtcggtttacacttacacagaaaattctactgtaataaactgaagtgtcagtagtgtttgttatcataacattgtctttttccctcttttctgatctctgatttttcaattaggaatgaggcctaaagaaacccatgctctctcttctctgagcgcaaggagggtgtgctgagaccttgaagggcacagcatgggaggatcatatactagggagagtctgtctccaccccatttttcttctgctttgctttgtttcgtagtttcttcgggcttcttgggggttttctgagagagagaatgtcaatttgagaagtaacaggtgcacaggctttacctgcaccacactgcagataaggtgggtagggagggtagtgacaggtggtgtggtgggttattcagttctttcctagggcagtgggtctcacagggtggtgcttaggccagcagcatcagcatcacctgggtgcatattagaaacaaattttggggcctcacctcttgcgttttaacagttccttcaagtggtcctgatgcatgttgaggactttgaacactcctcctacaagcaaagtgaagttgacctcccacacacttgtctcagtctgctttctagcatctgtcccattgcctttgttgttctccccgccacacgggctgcacccctgggattcccccagctgccaccaggcatcagctccagctgcctcccagggtgtgctcctgcctctgcttggagtaccctgcctcccactcttcctggcaagaccctgctcatctttcagggtcgtctctgctgagaagtcttcctgacctcctcggagatagggagttgtggggccttgtctttatgttcccagggttctgtctattgcgctattaaaactttttttttcatttaatttgccacttgctagagagatggttgttctgccttcgttgtgcaaaattcagtgatacactaatcctctcctaacctcttaaatcattttgactttcacagagtgatagtgtctagagagggtttttgttgtactaagttattggttccaaagaattcattttaagaggagtaaagaactaytatagtatgccgcttactgagacaaaaccgacttctcacataagcccaaaggttttgttatgttggattttaccattagagttaaagatgatgattggttcactaatgtgctttaccttcacagtgtgcctgtagacctgtagtaaaagaaggctaattatgtttcctgatgtcttttatttccaactataagctaagcctatctcattttttttttttttttttttttttttttgagatggagtctcgttctgtcacccaggctggagtgcagtggcgtgatctcagctcactgcaagctccgcctcccgggttcatgccattctcctgcctcagcctcccaagtagctgggactacaggtgcccgccaccacacccggctaattttgtttttgtatttttagtagagatggggtttcaccgtgttagccaggatggtcttgatcttctgacccgtgatcctaccgcctcggcctcccacagtgctggtattacaggcatgagccgccgcacccggccaacctatcccatatttttaaagaagagttgatcaagtagttacccattttaactaaatggataactataacattctttaatggaattgttgacagagggataatcagtgtttttgctaattcatgccaccctcctttgttgtatgttagtaatatttacattggggcaacaaaatagatcagtatttccattaatgtttacttaataacagctgctaaaaggtattactgtttgcagtaacacaaaagcacttacctgattcttatgccagcttctatagggtaggtagtgacagcccattttgcaggtgaggaagatggggtttagaggtgaggtgtgtctgcctgagagcaggagctggtaaatggcactctgggctcatgggagtcacgctgtttttttttttttttttttttcctaggacctcaaggttgtgtctaagacataatttacagttctcgtgtaggtcttccaaatacttagctacacagctttggggcgttttctcagccaaatacttttctttagcccttctcatattaacatttagttcttagggatttattttcaaaatatatatagcttgtatatgccattcacctaagttgttagagcagacattctgcctcttgatctttagaaaatacctaagagtattttgttaacagtactcatttcagctgaaagactttattttaaaatttaatttaattttattattgttttttgagacagaatcttgctctgtgtctcccaggctggagtgcagtggtgtgatcttgacttgttgcaacgtctgccttgtgggttcaagtgattcttgggcctcagccacccaagtagctgggattacaggcgtgcaccaccacgcctggctaatttttgtatttttagtagagatggggtttcaaactcttggcctcaagcgatctacctgccttgggctaccagagtgctgggactgcaggcatgaaccactgtgcctgacttttaaggctttctttaaaatggcatcttttggccaggtgtggtggtaatcccagcacttctggaggctgaggctggaggattgcttgagcccaggaattggagaccaacctgggcaacatagggaaaccctctctctgccaaaaaattaaaaaacaaaacaaaacctaggtgttatggtgtacccctgtggtcccagctgcttgggagctgaggtggaaggattgcttgagcccaggaggtcgaggctgcattgagccacgattgtgctgcagcactctagcctgggtgacagagtgagaccacgtctcaaaaaacaataaaaaataaataaaatgacatctttggagaagtgaattctacccaggtaccaagcccctgcctgcccctcccaactcccttccctgactcccagcacccccatctgttttggttctgctgttgccattctctggctttggggactttgctgaggccccactgtccccatcttccagctgtaccctttctctctgcttccctgcttgtcttattctttacagggctgcctgggatctcacattccaaaagtttttgggtttgtttttggatcatgccaatatcggttgctttgagaagggagaaagggtattttgcattttccttttaatcatcggtgagtagccacaaagggtgtgtctctccctcttgtgctgtgtttactgtttactccctcggtgcatgaattatttcatggcaccagtggagcatattttcttctctttcctgtttgtggcttgcgcctcctgaacgctgctatcattcatggtccagcttggttttctttttcactgtttctatcacaaaacctcctgaagaccagtggtgtcagtcataggctccaaaacagctggttcctaggccctgcctcgtgctctgtggtttgggcttgtcttttcttccagagtaagtgggtagcttcttcctactttttttctcttttcttctataaatgggaggaaaagtgtgaagtatggagactgctctttcatttgaaggaaattcacagttccagctctgtagtgtggcctctgttaactagtggtcaacactgactgtggaaggggggccagatggcaaagtgaagcagattctttcctcctgtctgcattttgattgcagtatgaagttcaacttgcttcagtctttgtcttcatgttgtttcactaggtactgaattttgtgatctgttggaaataacaagtaaatagatgcctaacgctttatacaggttgagcctgtctaatccaaaaatccaaaatccagaatgcttcaaaagtttcagcttttggagcactgacatgacaccacaagtggaaaattccacacctgacctcatgtgacgggtcacttttcgaaactcaggcacacgacacacagttaatttagtgtccccaagggaaaaaaagaccctcccggcccccttcagctgtgatgtgtcttttccacacatgcccagattccctcagacacctccacaaagggtaataaaatggttcgttgtatacaaactttgtttcatgcacaagattattaaaaatatataaaatgactttttagagaagcgagaagagaaatgagaggtaggggagggagggaggagttgggggacagttgggggaatagttgaagctaaggtgtttaggcagagctctgaggaggtgacgtttgagtggagacccagatggctagagaatggggcagcctcctgaaggagcagaagcactgtgggcggcagggtatcacagaggaggagctcggtgtgttggaggttggtgagtcccgtggagtcttgtcagatggtgttgggacagggacggaccgtgaggaggctggatcatggggaatgtgttgctttaggccaagctggagttgatagtggctcagatcagagctaaagtartggagacacacagacattgaaagaatgatgaaattcactcattctgcgtgtgtcccatgtcatgtgtccgctgcacaccaagtactgttttaggcactggtgatataattgtgaaccaactggagctgcggtgagagagaccatgaaaagaagggccagagcggtgtcctgcagagggtggtgtaccttgggagggaagtgtgtagggttgttgaggaacagygtgctgcacagggaggaaagacrtggggcagcattgtgggaagagcaaccaagattctcataggcttgggagcggaagccctgaggtctgttgctggactagatatgtgaggtktgagaggagagaagaatcaggaatgactctttgattcttaacgtgagcaactcagagaatgagagtgctgcagtttacaagcttggaaggtggattatgtggggggatgagtgagttgtttgacacctcaatggatatactcagatggatgtatacgttagagctcaaaagagtctgggccagtgacatgaatttgatcatatctagagtatgagtggcacaggaagccacttgtctggatgaggtgacagaggaaaaggttgaggatagcaaccaacatttagaggtaaggtagaaggcagagcagtgtggaatcagggaagccgagaggaggaggcaatgccaggtgactggaaggtcaagtgacacttcgacagtgtcactgagggctctgctaggagctattcggtgtcataatggggacagaagctcagtcggagtgggttaaaggtaaccaggaggtgagggtgctgagaggtgggactattgacaagccttgtgtcaagttttgctatgtaggggctgaaatctaatgtatgtgactgtgtataagtgacttgacttccccaaatctgtttcctcacctttaaaatgggtgtttgccaagtgctggtttctgctattcttttctctgtcttaggggtgtcattttctctttggtaaaacagaagaattagatgatatgaagtttcacattctaagttctcaagctttgcccactcctcagcccttgggtccctccacttcctcttctcttcgctatctctgctcagtttctgtctttgattgtaatgtaatgcccagtgggacttttcttctctccctcgtctgttcacttattccgtcctgcactgggccaccagattaatcctgcaaaaggcctcacatgggcttctctccygctcaggagccttgtgggggctttattcctctgagatgaaagttcttatccccacatgtgatcctttatgacttgggtgctatcaaattcatttcctcaactgctcccctcttcaccctgaccatcagatctgctggcacatgggcataccttgttctgcattgtctctggcctgtgggatatttaccgagctttaaatcctaggcaccctttgggagccggcctgtgtgcagagctccccttagcacggtggcacaaagcttggacaccacctcttgtctgtcctgcttaattccattcacatctagagtggactcgctgtgtgcacaccactgaccacctgcctcatgtgacagttgttcctcatgggtcttagctctttgccttcaccatgagcctcctcagagggcagggcactgcctgttggcatttctcgtggtatcatacatgttgggtgcttcccaaattaattacatcagtcagaaaacttcactctatctgagaagctttaatagtgtactkgggattattaaatcctaaaaaaggttatcacaaagagttttcttggtgtgtgtctgtgcttagaatttagaaaataagtcatccagtattgaggccattttatgaaaagcctttaaaatctgcaaatgcgttggcccagcacttccacttctagggatttatcctaagaaaatagtcttgggtatctgccaataatgttcactggagtgttgtttataatgtgcaaaacaggagctaacctaaatgtccaacaataagggattggttaaaaaaaaaaaacaaccctcatggtgtgtattaatactctggaactactgtccccttaaaatggtgatgtagaaggacatgtattgacctagtaaaatattaagtgaaggaagtgtgtttacaaatgtcatttttgtctgatttcacttaccttcatttatagagagtggataattggcatagatagtgttaacattgtttatcgtggaatgttgagatcgttgatgatttttactggtttttttttttttggttattacctctaaactctgtaggaagcatgctttcttgatcaataaaacttaaagttggagtttatgctgcttttattcataaaaaaatcacgtttttaatcttctgttaggttatcctttatgtctacattaatgcacgtgtggagagaacacagtctactcggcttatgtcaaatggtagtgggaagcatggaagcatgcgttttttagtccccactttacaagtcacagtgacggttctccagtgtagagtagattgattgccctgtgtccttcaggcagggtgcagtagtaagttattgatacttggctgctgagctgtcgttcaggccttggcaactgacgctctgcagaacggaccaggagtgtgcggtggtggagtccggctggcctgggttgcagatttaactttcgcctctgcctctgtgtgcctctgggctgtaagctttagtttgcacggttaacggggatggcctctcccatggtcggttggagtgtgttgcacagcgtctggtccagtgttggcactgtataaatgccagctaactggttagccacctaaactgtcagtctgcaacccacagctctgcagtgaacaattgaacctcatttctttaataataatacaggattcctgaaaaccaactgtattattgtttggaaaatagtttaaaaattatttcyttctaactgagacgtttaccctcttgtctcccttcagtctgcgggccaggcatcgacatccgcaacgactatcagcagctgaagcgcctggagaactgcacggtgatcgagggctacctccacatcctgctcatctccaaggccgaggactaccgcagctaccgcttccccaagctcackgtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgagraacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaagtaagaatgatgctgactgytgctttctctctgcctctctctctcctctcctcctccttgacctcccttctcttctgagtgcacgagttccgctgggcagggtgcagtcgtgttgcatttaggacgtggcatgcctgctgtgcggaagtggttcccagtgggggtcttggttggctttcctttgcatctgggactcttggattgcgggactgtggcgtggctggaggccatcatggctgctgtcaagactgttcaaatcacatgttagaaataatccagcacactcctgggctagacacttgctgaccttcagctttgaattcctgatgagaaaggtgacctggtgtgcttggaagtccctgagccttggcagctgggggctgcttatgtgtcagctctttcatcctttgtgcgaagtgatattttttgttctgcaggacttccttagtttgaatggacttggaatatggttaaataaagggaaggtaaagcactaactcatatcctgtgaaagtggtccttaggtcctagtgatgatgttatgatactcaggtgtcctggttatgacagagcacctggcccaggtgggagacctctggacccatttctgcaagtcccaggttcaggctgtacttgcaggtagctgtgtagcagggtgcatttttaaacctctgggattctgttttcgttcttttatacctgtttactgaacagttgtgaaaatcttaagatttcacgagtgaaggaactttggaaagtatttactgttctgggggtcagatggtggtattttgaagcttcttgtatatttatctgcaatatgcttattttcccttgagaataactgagctcttgccttcatgtgatcagttccttaagaaccaggctgtttggtattaaaatgtgactctgagccttcaccttattgcattcagcaatagttatgtatattggctaggaagcttttcctcactggtttgaagtcagtgtgttagctataaatagctattatttaagtgttggcccagttaaagatgtaaggaacccatgttctctagttatgaagaaccaagaaaccccaaattgttagacttgcctaaaataaataaaaggcgagaccccacaggggtgaagtgtgtaaagtaaataaaggacagacctcccaggtagcccttcagttcccgttcaaccagtcctgaggcaggaaaaggatctgtgtaccctgatctgccacgcacttttctattctgcagaattggatcagtgcgtatgtgaacattgattagtgagggcaggggtcccactggctgcagccagtaccttgtagagctctgagaatgcagtcaggccactttaaggttggctggagttggagggagatcttatgctaaagtcacttgtgtggttgattaaaactgccctatcattaagttacccactggtttgagaaaacaacaaaatatattttttaaataaccttgacatttaaaaattttatctgaaaagtaaaaggtgttatcaagggaggcagcatggagtagaaaagagatgttgaatgtggtgatgagggccaggaatgaccttggatgggccagcccttctgggctgtagttgggcttttttaggatatttctagggcagtccagtacatcccttagtggtgatcatatatgggcatgaggatgttttgaaaactcataagctctttagagaagggaggtgccatatgaaacgtcattaagtggagagttgttcacgaactaggtaggtagttactttggtcttgccataggtttttggctgtttctgatgagctactgwttgaagacccctggggtaggggtgaggcctgcattctgggtccaagtctaagagtggcgactagaaatgagcaagttatttaaattgcctgggccttggtttcttcatatgtggaatggggtaaagcctgccttcctcatagggctgttggaagatgaaaaggaggaaggaaaagcaccgtgaaaatgttaacgatggttagaaggtgggctctgctggtgacagacagagccttgatatcacctgttggttggtcacctgcttccccaaggccacgccctgcagccttctccttgaccatcccagccctgctgatgttccttgtgatttcacaatggagtacttatataaaattggtaactgctttccgggaaattgacttcccttccccttgtcctgaaaactcaggcatgggcatatttcttggagattttctagttgaatcagaacttcctcttggtttgygtagattccatttagacctgcattgtccagtgtggtagccgcttattgagtaagccacgtggcttattgagtacttgaactgtggcttgtccgaattgggactgctttaggtgtaaaatatacactagatttccaagacatagtatagcaaaaactctgtacaccatttcattaataattactatgttgataacatgttgaaatataacattttggatatattagattaagtaaaatgtgttcttaaatttcacctgcctgtttcctttttattcttttttttttttttttgaggcggagtttcgctctcatcacccaggctggagtgcagcggcgcgatctcrgctcactgcaacctccgtctcctgggttcaagcgattctcttgcctcagcctcccaagtagctggaattacaagcatgtgccaccatgcccgtctaatttttgtattttaactggagacggggtttcaccaccatgttggccaggctggtctcaaactcctgacctcagatgatccgcccgcctcagcctcccaaagtgttaggattacaggtgtgagccaccatgccygactctttttaattcttaatgtggctacttgaaaatttaaaattacagatgtggcttgcattctgtgttggtaagctgctttagagcatttcttttaacaccaggagttcttcccctcatcatctttttggctgagtcgtcactgcagcgctcatagccccgcatgtacctctccagccagaacccttaggaatcatttggggagctccatgaagggcattgagtccaggcagaatggctaccttgagttcaacataagcattaagatggccattcgaaaacattaagcacagaagaatcccattcaggtaatcttctgttggctggctgtagaactacggagaacatctggagaaacaygtcaagggtgtgtgtgaaatcgttgagcctactcgattttgtcgtgctgttgcgyggttttcacttggcactgtcctttaaactccttctgtgccgtgactctgcagtgtctggcagcgtagtagactctactccctctatggacgtgatccctctgtgggttctctgcacacttctgtatttctcggttctttttggatttaggagtggattttatacatttttgagtcattcctaaagagcgattgacccttaaagaactgtgtacagtggtttcctttcagtaagaacatagttgtgtggcaccccctgacatgtggtgtggttgattcttcttccttgtcttccaacgccaccctcttatgagtctcttcctacccccacaggtgccgcttctctgtctcccttccctcagtctggcttttaacggtggtctcctgacatagtccattcaggctgctgtaacaaaatcccataccctgagtggcttacacacaacagaaatactgctcacagttctggaggctggaagtccaagttcaaggtgcttaccagattaactgtctggggagggcccacactctggttcacagaagcaccttttcactgtcttcacatgttggaaggggcgagggattttttttctggcgtcttttttataagggcactaatcccatttgtgagggctccaccctcatggcctaatcacctcccagagccatcatactggggattaggtttcaacataagaattttgaggggacataaacattcagatcatagcatggctggagttctgtcctgggctctcttttcactttccttgttctcatctcatccactggtaactgcattgcctcctgtctccacctaaacttccaagtatctccagcccagaacccttttgagtccaggacctgtcattcatatccatcccagaacccttttgaacccaggacttgtcattcatatcagaccaccacgagcatttcactacagcctctgatggtcttccctgtttcctcacttttgcctattttttttcttttctattccctcttaagtgggccacacttttgttcccctggttcttatgtcaggaatgtgggtgtcctttggacacttccttctccagttggataccaggccctttccctcccgaatggaatggaaatgctgcttcagctgtgttcctctgctcctcccccttacagcagtgacatagcctctctcctgctattgtgtcctgtggctccaccgagcactggggagcttttcagtatgcacttttttttttttggagaaagagtcttactctgtcacccaggctggagtgcagtggtgcgatcttggctcattgcaacctccgggctcccaggttcaagtgattctactgcctcagccgcctgagtagctgggattacaggcccgcaccaccacacccagctaatttttgtatttttagtagagacggggtttcaccatgttaaccaggctggtctcgaactcccgacctcaggcgatccaccggtcttggcctcccaatgtgctgggattacaggcatgagccactgcgcccggccatctagtgtgcactttggactgatgagctcccctacctgaaatcctgtagcaagtccctataggataggcatgtggtacagtgtgaagctcctgagtggtcaacagctaccccgtgacaacatgccacactccatgtgccactccctccygcctgcctgctgtgtccttggccccagtggtgctctcccgtgctgaccagccggcacggctcacctggccgaactctagccttgccttttcctctcaaggatgtaaaggctctgcagatttcgggaggcctgtctcccagcacctgatgggacactttttgccccactgtaaattctgggtgtatcctccactgtatgctgtcaccccaagggcaagcactgcatctgcttagtgaaggatttattgttcggaagatacattttccccttgagcagagagtrgcgtatcctggcagtcttcggtgagccagttgtaccaggattatgaaatgcagatgtttactgtgtcattgttgctgtcattgctactgaggagtactgaccagaatcatctgcaactcttagttggcagagaggaccactatggcgggtagctcttttctttcctgccattgtggggatgattccaggccaaagatgatggagaagtatggaaatcatctgaaaggttgaagcttggcacgtgaagccattcatgactttgtaaggcagttttgctgaaggccagttctgccctgggagggacggaggtgaatcctcctgagtacctgtggttttcttacttcctgctgaatttacctaagtgcctgttgtttgcttgctgtggaggctttctggtatttcatttcaggtgcagatgccttcactttcccacaaaaaaaaccccaacaaaacctaagaccttactgcaactaagtytccaagtactttttaaccyawtgggatgaacagcctgtggtctgctcagatcaccctgagtgcgtgtgagaaggcctgggctttgccaggaaatccaggaaggcagggccgggctgtgttggaagctggcttagctggtggggcagccttatttcaattaaaagggcattgactgggagcagcagtcctggagtttgttgcatttcctattgccctcaaaatgagaaaccaggaaaatagcagattggagccttcgagaaggcagtaaatggctgtttttattgacaaaaggaaaacattttactgccatctcactgatggcatctcactgacttaaaatgaaggcaggttgtagtaaaaaaaaaaaagtctacatttttccaccgccacgttcttatatccttgtttgtcagccactgctcacaagggcagtgttgtcttgcggagtagaggcgctctccttccctcgttttcctctataggttggtgtggctgacctgctagatcaaagtggaggacctgtttaagaatgtgtaaattgaaggctgggcgcagtggctaacacctgtaatcctagcatttggggaggctgaggcaggaggatcgcttgagtccaggagctcaagactggcctgggcaacatggtgagaccttgttcatataaaaaaatttaaataattagctggttgtggaggcacgtgcctatagtcccagcactttgggaggctgagatgggaggatccgcctgagcctggggagatggaggttacagtgagccgtggttgtgccactgcacttcagcctgggcgacataatgaaatcctgtctgagaaaaaaaaaaaaagattttgtaactaagttttatggctagctttgagaaaggaaaataataataaaaaaagaatgtgtaaatcacctgctggatggggggaagaggggcacattgtctttgtagtgagacttcactcatgtgatgtgcagtatttcatcttaacattttttttttaaacttaagctacttgtgaagagctgagatgtttctgttaagcactgtgtggtctgctgctggtcttctgcaggccactgttccccagactgctaagacgatcatgacacaggcttgcattttcaggtggactcttgggaggggcttgtggaccctggaggagaaggcagccaggagaggggcatctggctttgtgttgttggtaggaacttgtctcggttgccctggaaggcctctgctctggtcagctgctcccagtgtgggggtgatctttatttagaagggggtcacatgcccccaggcctcattgctatgccttttatagtcaggcgtggagctcacattctcttctgcctgattgccgacgcttgttgccgagatggtgaagcagtttgtgtgcaggttccctgggacctggcttagcccacctcatttcttggggcgtgtgccttgtgcctcaaagactttgcttttggctaattgtcattagtgatggtgtcaccatcctgggcctccttcagaagtttttaatagggatctcgtctaagagaccaaaaagctttcagaaccactgacttgtggtgatttttgcatgccaagtatttggaaaatatctggagccccttcagctctcaccagttaaacctatttgtacawttgttctggtttcttcctgtgcttgaaaagcctctttctttgttgcgttaatacctctgtcttgctttcctcatgtgtatgccagtgtgacattctcggcagagtggggatgacgtggagcgtgtgggcccgtggttaatcttgtcctgaattgccttgctcaacttgcgtgtatagggtggttcaaaagttaagtttggctggtggtgaagttggaagcatcacttagaaacacgcctcctttgggcatatggtgtgaatcagggactctggctataaaaggtggggtctctgagcaccatcctrgttggaatgttcccctgactyggaggtagcgagagacagccaaggtgtttgttccagggaggctggtgggtgggagatgggatttttctgtctgtggcacaggcagtattaagtagagcaggctgtttaaatcacattttaagtaaaaaccaaagtgcacagatgatctgcagaacttctgggggataagaagctgctttcctcgaagaagttcayctccaaaccagcgcccatggctcagcagccagcatggcagccccaggggtacatgggacttsggcatgtgaggctggtgagggacagggacagctgggtccagcagtgcctttcctagggacggttgccacgtcacctgtctgccctgtacttccatttcctttctttgaactcggggggcttgcatcggactacctgtgccgtttcctcaaactctaaaattgagtaagttactgagggtttccgtggtctgctctgagaagatttcttgcttcctgatctgcctgtgtgttcgtgttgcttggtctctctctctgtctctctctctctcctctttgatcctagtacatacaggcaaggtatgcagcatttaaaatgttcataactcatcaaatggcacactgatcatcatgtataatttgggaatcagggtttaagaaatttagagatcatttatatggaagaaggaaccccaagtagaaacccaaaatctagaccattctgggttctaatctgtacctgccactggctaacatatggctttaagctggatgttacaatgagagctggagtttcgtctgattgcacatagccttgcttttctgtctttggaaaagtagctcactgyagagccctggtaaacgtttgaactgcattgcgggagtaggcagaagaacagaacagtccttggagcttggtaggaggtgtgagggcttatgggggacagttgtcttttcaagtcaaggaggaataagggcttctggggcsggtggaaagggtgagtcttaggcagggaagggtgaccatccaggttagatcacttcttctgcggggtcagcttggccgctgttaggttttcaggatgtcatggggctggccaggcctcacccctgatatccctgagcatctgttccttacaatattgtggagtccgtgggggcagaagctaccatcctgtgcctgccctcactctcagtgtgactggtcttcaggatgtttaggtggctccacatgcggatgtacagctttcccctgcttgttttccccatggcatattaacagcgagatctgcaagaatacatcattttgtacagaacaggatgtatttcttttaaactacgttcctgtgtggacaagtggtatcatatgcaaaggtttaaggaccgttgatgccttgagatagtgccatctgtttgcctcaggtatgtggtgctaggacaaagctgccagacctcaccttccttcagtgagacaggaataggacagtatttgaaaagcatctaacatgtttccaagcacataggtttttggtaaatggtggcagctgctgctattttttttttaaattaaactatctaagagttgcattctragaccatctaaaattctgagtcttaagctgtgttgactatatatgttcactaccataactaaatggtccttctgtattgcttttctaaattgtagaatttcaattattgtaaatagcgggccatactgtaggtgtggttcttgctaatttgattcgtactgttcaaattcttgtgtctgtccagataaactgtatctttacagaacattcagcgaggtacatatgtctatatcggggtgccagtggagtcaccctagtcatatgtaaactctatttatttggttccgaaactgaatttattttgtttgcaagtttggtrtttgggagcatttaagaaatatccatagattcttgtatgatactgacattaaatcattaaataccatattttttaaatgcctctgtctgtttgcatggataacattaaagtggttagagtgggcacagttattggtaaagattacaaagatgtgcatttttatgacaactttaggtctcacataggtagccaaccatctgctccaggatgaagcatgtgcctgtttatcctcttctttggtaacgctaggtatatgtgtgcacacgtgcacgtgtgcgtgtgtgtttgtgtatgtgcgtaccactttattctcccacccagcctcttctcctgttttgtttagtttcattttcctcctctcacccccattgcaggaaacaaacactggctctctgtcctcccttaggtcttccttccgttcaaggggatcaggtgggtgggaaaatgttgtgcaggaatgccaggcctctgcccgaagccgggcttctgtttcatctcattattgaacagaagtcgctttttgtttctttgccttggtcacaaacaagcgcccagtcctctcttctttcttcctgccatttttcccagaatccatgtgggatgggaacagaggcagcgtatttagggactgtcggttgcttgatacccatggccttgtttagagaagctgcacccactgccccaacgtgtagctgcatctgatttgtttttgcaagtcctaatgaagggacctggatgaagttagtgaggttgccgttcctggggttaatgcagagtggcccatggagcttagccacccttcatgcagaaggtggggctgagggcagccagtgtgactgaggctcgctggcccaccctgagctgcttgtgcccatggggcccctggggaggagggcccagctgcagtgcgsatacatctgcccttggcagcagatctgtgaacccaggctgccattctggatttccggatagatgcaaagtgcttggacgtgttttagcagctgctgagaccaggagttgggcttagtagtaaaaagggggaacaaaataaaagaagatcaggagacaaagagcctacagtacaaaaaaggaaagacgaaggttgatattattagaartacttcctgggcagccttactgtttgaattaggatcacccccacccccacctcccagaggtattagttgtaatgcagagacaaatggaaactagtcagatccttgggtcctagaaaagaccagctttgttcctggggtggtaacctagtacaacgtttccgttcctatttcttgacctctgaatggccccttctgctttgctaagtagatgatattattaggtgcttagactattcttcagataggatgtaaggatatatttttgttctcttcctcagtgaacttgaaatgattggattattttgtaatacgtcgatactacttttagaagcttttgaataactgtgtcaaagaagctttagaagaggttttaagcaggrttgcagagaatgtactgagtgtgtttttccactcacaaggaaagacagcagctgaatgcagaagtgtgtrtctggttctaactctttatcacttcagggactgtccaggcagcaccatccgttggrtctcctgcccttcctcytcccacccctgccttayccctggccattcttttgtgaccagtagtcstttatgaatggaattctgagaatgtataattttctcagaagaatgcttctttagctcaccaaatatttcttgtttgctgaggggggaaaaagatcctccttggaaaagtcactgggtgccaaaggtgggtgatkaggagagatgaacttctgggtgtgcctagcaaagctgtttctgttgataggcrattaayaaaacagccaaacttgacctaacagactgccattttgagaggaatttgttttgcaggattaattggcttcgaggtgtactggtggctgtgcagtgatgacggctgtcgtgcctcctgtgtcttctgctcattgtgatgcagggcaagtgcttaggcctcagacacaggctccctgaacttcgtgttcagtgctttagggtggggggacttgagacccttgacttgactcggtcccactggaaagcttctgttgcttatttgggtaaccccaactctatcttattgggcrgtagtgttatcctaattcttggaaatactcagtgtagaataaagagctgatgaaaatgtgtaagaagggagtaagtggtcattagagagaaatggtaattgggatgatgctctgaccccttcagcaaaaaataaaaggtgaatggtttattatgagctagttcagattctgtttttggaaaygagcttggttatacatagtgcatttgaaaagcgtgaagcatggactttcagatgccagctcctcagcctcctgtaactccagtcgcaaaatccctccagtgtatctaaataaatgcaaactcatcagtgccttaccattataaagctgggctggagaggcaggtggcctggagaatcaaatgacaagaagtatagggagcagcccagcttcatgatcgggggaatttgcatgaaaattgtgtacacttaagcaccattgtctattgcagaaagcacgatctggcctcttctactgactttccttccagctctgagattcagttttgaagacaaggttgttggggacctcggatagatctgttggccgtggctttcagtaaacactactagagactgaggacatgttctagacttggaatggtatgaagcagtcgaactttttaggatgggccctacccttagggactgcctacgaaactagatctagaagaggaggctgtggacattaggaggtggctgcaattgggaagttccagagagcttactgagggataacggatgtaggacaggaggctggcaaagcacctcagtgatagggcagaaggaaataaagtggttagggaaggagttgagagcaggaaattcaggtaggattgatgttaagtcttagatctttgaagtgactttctctggtctggcttttgctgttaccaaagtgaattattcataagtgcatatgagaaatgctgatgtaactcgattatgtggaatgaatttaaattcatttaagtcattcttttccactaaagtaagctttccctcatccagaatctgagcagcccgatagccaagcaggagtttccttgtgccatggccagtgattgatgtcttcttctatgatgctgctgaaatgctggggactctgaagcgcagctggagtgatcaaagcaaaattaaaatactttctcagtggtttgggagttgggtgcgttctgctgtattttttggttttcggcatctgggtttggtgtgcatgcatggtgagctctagctggagcagacgttacctactgaggctacgctcttcgtggtttctccttaaccatcacccacttgatcttccatgaagccccccaaatcttccttactgaggactcttgcttccaggttgcttttgtgctcatccattgctgggttatttggtcagtgatgatggtttctctgtactttttatcagtaggttcagaggaccttgtttactcctcattcatctctctccccaaacagttgagaaaccacttgtgggttaggactcatgctttgtttataatgtttgattctccaacctcacagctaatgggaagcccgtggaggagatactctgtaaaaatccatctcccatgtgggcttgaccccacttagtgtctgagtggtttggtcctcatagttctcttgggggaggaggaagggaaggaggaggaggtggcgatggcagtggcagcagtggtggcatcttggaccagagtgagaaatcttggaccagagacaaaagaggtcttctctcagggtagtgcaccatgagagggagcacctgtttacattttgtatcctggacaccaatcttgccttgctctggtgctggccctgagaggtgcaggaattttataaagagatttacaaaacatttttggatgaccaaattggtccctggttctagctggaatgaataaacaaactaaataacagtagagtgtgagagtaagtgtgtgtgctagagaatgtgtgcacatgtatggcctaggtgagttcttcactttgctgacttgtgaattatttggggtcctatggtcctccccatcattcttattcatgtcagtccaccatcattaaggaagtggaagcgaacacattgtgtacatatcactcccatagagagggagactggggaagaggtttgagttataagtcgcacctaggttaggtctggatgtgtctttgcaggtttccttgctagttccttggccagagtttccatcgtgtccctcagctgcacaattaaggtgcccccgttttgtgcaagtctcatgctaggcagtatgagatgacacaaactaggattctgttgtgagataagataaaaacacttgacatttaaaagagagagacaacttatgcggtgtgacgagacactctacgacttttgccagaagagaaatagaggcaacaagtgctaggagctcagaggagggtaagttccacatttggaactttggattaaaagaatatttgggtctggttgaaatcgaggcctttcatgagaaatgtccacacttgctcagtactgtttgccgaacactgtatacaaggccctcgactcgtgaatgagttgtaatgcaaaactttgccaggcatttggaatgtggagtatactattttgtaaagatgaggtctgaatggtggtttaggtcccaggccagtgtccctctgccccccacctccatatgtgccctcaagccggtttggcttagacattatttatctctgactactgtgtacagcttagttccatggggaggaaaaggcttgatgaaccctaccctggaaggctggtggctctgttttctgatggatgaggtaggagtggtggaaagctggtagtttctactttgtgcctgtttaaaaagccccctctgaggccttagcacttaacagatgttcaggattgggggaataaaggagctgcctttgcagaggtctgtgggcatgcagtgggtgagagagcaggcactgagtgccccgagtttcctgcctgtgtgggcaggaggattctcagtggaatcaggagcatctccgcctggtgctggaggaggtgtggagttgaaggtgggattcttcctcttgaaggacttgaatgagtttctgtgtggctgaacagaaactggttcaacacccatgtcatgatttttgtgaagcgaggacttggggtcccaagtctaggttttaggttccctgctgtaacccgtggccaccgagagagagttttatgataaaatgtcagcaaagtayctgacaacgtctcacgctagaatgagtttcgtacatgtttagttccctctctytttattccacgcycccccaccccaactttaaatcagaaacgtgagggtgctgattgaagctttttataacttttcttattgagaattgttctctggagttgtctccaagaacaaaggaattccagacgttctycttctctccttgtctcttctgtcctccagtcaaagaaaaactctgcatatgatctttggcctggagaaatattaaatctatgttaagtatgcagacaygaatgggcaratgaaggatttgtggcaaagaagatctgccgaaacaaataagtcatgtaaatgggcagagggmaatattaaattgattgcatctttcagctcctggtacttaatgcaaagataaagtagtgggaaaaggttgtcatttgaaataatggaaagatgagggagttttgaagctagctgggatttttctgcctgttaatagagtgacttggattacagactataaagataaagagtagggccgttgcatttagtatggatcatgatgctgattgctgtctgagcaacctctgtactaagggaggagaagctaacatccccgggcctggaagatactggatactagctcattaaactcttgtgagaagccttcattagcattatgggaagacttgctgtatctatattatgaaggcatttagattttttttwaaatgcatgttcttaacattttttgtttattaagtggggcagtagattaggactgaatggatttgattctctcatcctacatagtgtgcccagaagccagaaggtttcccagaatttgtattatggcagcgagggcaaatttaattagcagataggaaaagctttggagcagtttaggccaatccatttaattgtatcagcaattaatattttgagaaaatggaaataattaaatttacatttcttctaggactttattttgttatcctttaaggttattgtaaatgaggagacttttgaactcacagactaaagcaaactacaccagataatcattaactttttctattgtgtgccacccttcccaaccagattgttccatagtatcacttatgaaccaagaacctgtgagcttgcaaaacgcatttttaaggagtctcaacttttctgatttgtgttaaagtttaggtgtgggtcccagaaatgagtttcatggaggggagagsttgtctctctgggtgggtaatacaggggccactgggggctcactgtggctttctggcacagacakttatgaagcaggggtkactaaagtgggagagagcagccagttctccagcagccccagtgagagctctcatggatctgcctattgcactggggtaggagccatcaccgtcagcttttctctggcccacagtgccattttctgattaagctgagacctctgtaatagacacgttgtcattttttcttgtgtctaaaagtttgcttgactgcagtgggtctccagctcagagcaggtctggctagagaaaacaggaggtgatgactggagcactttgcccttatggaacgtgctctgatgtagaaagcaagaggattttccttgcagtcactgaaggtaccttgtgtacacagaaagaagacagagggagccccggatgcctcggtatccctcagagccrgatccttcagacctgtgcagtacctgtggatttggttagtcgatgatgcgctgccattaaaacaaaggcatcggccctggaatagagaagttcagtgagaacctctgtactccatgggcattttctaggaaataatttcacctgccctgtgtaattctctggaagaatcacagtgagttggaaggaaacttaagacttggaaaaggattgagaggttagcccagaccayaccagggctctgaaggcccagctggggttagaacctgggacaccctccagcccactgtctcctgttccctggccatttactgccccactcccctttctactctcaggggccctggatctaatgaggggattcgtgcagtttgctgcactaatacattgcaagtggtgccaacctaaaggtattctgatggtggaatcagagcagtagcatcttattaggtcagaatctgtatctcctcttccaagatttttacatgatttagtgttttctgaattggaaaaaaacaaaaacaaaaacacacaaaaaaaccatgtctaaatcctagcatttcatcccatgttgatgaaagggcatcttttttttcccctaatctgtggttagaactctcagaaacttttagaagatccctcctatgttttggaggtttgcagatttgaaccccagttcctcccacagtgcttctccaactcctggaatgaggtaaacctccaggcagcctgttgacccaacccatgcatgccggtctttgggactcctagatgtggaccctggagtgaatagggatcaggtgggaaatgagttcctttgatsaagatccttgtaccagtgaactgaccccactccccgtctggattcctgtggtgattaccctctgtattagtctgttttcatgctgctgataaagacgtacccaagactgtgaagaaaaagaggttttaattggacttacaattccacatggctggggaggcctcagaatcatggcaggaggcaaaaggtacttcttacatggtggcagcaagagaaaatgtggaagaagcaaaagtggaaaccctgataaacccatcagatctcgtcagacttattcactatcatgagaatagcacrggaaagaccagccctcatgattcaattacctcacctgggtcyttcccataacacatgaaaattctgggagacacaattcaagttgagatttgggcggggacacagccaaatcatatcaccctcttagcaaggactgtgttcgtgatcatgactggcattcactgaacaatgactaggtgccaggcacctcgccagtattctttaatctttgcacagtctgtagggtggatatggatattactgttccattttttgtggaagaggaaatggaggcaagagacctgattataacttgtgcaaggtgccatgcagctaagcagccagcccaaatccagacctgctttcctatgattttcctgcccattactctcccatcgtagctcacctaatacttcctagtgggctgctgctgaacacacacccagggatgacttagtggcttgtcttgctctgaagaaggctaggcaccatgttggatgagttcttgaagatgtcttgctctagtcaagaaacttttaaatctttggagtttttgtccacatctgcctagttcttagtaaacatgatgtgggttctattagcatggcgccctccctcccttcctaccacctttatatgagcggagaacatctatgactcttatgagaaaggaaagatgaaaatcagagtgacatagtatagttaaattgcagatgcttaattataaaacagcttgtttctgaattttaattccttgcttttctctgactttttaaattcccctccttaggcagaattcatttttacattgatgattttttttttttttttttttttttgagatagagtcttgctcttgtcaccccggctggagtgcaatggtgtgatcttggctcactgcaacttccgcctcccgggttcaggcaattctcctgcctcagcctcctgagtagctgggattacaggcatctgtcaccatgcccggctaattttttgtatttttagtagagatggggtttcaccatgttggccaggcaggtctcgaactcctgacctcaggtgatccacccaccttggcctcccaaagtgctgggattctaggtgtgagccgccacacctggcctgatgaattattttcatgtgtggaacaaaactttgatgctgatcagtgattaggtacctttgtttggttcatttttaactaaggagatttctttctttttaaaaccattctttaatcttgtaaaaatatcatttaatgggtggatgttttagctgtgatgaatgacaggttgtcgtaaaggaagaaaggtatgtggtttccagtaaacttttaattcttttgcaaaataaaaataacagtcgtacagagagtaaaatatatgaagagtcaggaagtgatttatcaaaatcagatcttggactgctggttttaccatgaattaggctcttggaaagtgattgggccagtgtaggtttacattttttttttcttgttttatttgtcaaagcaaacttgtggttgcctgcccgtagtttaattctgcctcctttgggcaaacaaccgacttttactgggagtctttctcagggagataaaggtgcaccctgaaactctgctctctgattcctcagcaaagtcagtcctgagtatggggcttgggtgtctctgcaaggccttgcaagtgagatgggctgtcacctgagctcaggtggggctgctcctgccttggacagcctccccagcttctcctgcattatacccaggggctggagggcagagagcaggtcttcttctgctggtcggggcagtcacaggctttcctctcggcctgcttgtcctccgggtgggtccagcacccgctgggattcctgtgggcttagtcactgtgtggcggcggcagaaggactggggaaaccgccggccggccctggtgcgctgtcaccccgaaggaatgcgggccaggccggggctgctgggcctggaaagttctccagtccctgttgcggatctggcctgccgactcaaagtaaatctctcttcccctttatttcccatcaaataaaaaaggaacacgaggtagccactgtactcactgaagatgcattgttttttttttttttttttttttaagcgagcagcagcaagatttattgtgaagagtgaaagaacaaagcttccacagcatggaaagggacccaagcgggttgccctgaagatgcattttttaacttgctttttaactaagtatttttgctctgagctttcctggatctgtaaacacacccccagctattcaagatgggcttcttggtgaaaagtgatgtgtcctaggagaaatcacgcctgttgttgccgctggccatcacagatcccggtgcctgtctgtgaaaggctggccgggctgggtggggatgagaatggtcgggttgtctagactcagcctggactgtctttgactggaggggcctgagctcctcctccactgctcaagaccccggttaaggggacagcagagcagggatgagaagtggccctcttcacatcacctcccagcaagagggcctgacttagtgctcccaccattgccagccccagtttcagggtcccactcagttgtatttgaataggtctcatgacatgtgctttgcttgaagagcggctattagcagcagacgttcaagaggctgagctcaagcaggtgagcatgttctgagccattgtgaacccagtgaggtgcctatgctgatgcccagggccgcctgggcggggtcaggcccccatcgcttcttcatcctagctctgggagtgcattctgcactctcccgaggccagctggtggcctttggtgatcaccctctctgtaagtttttaagtggcttcctttcctctggtggagaagccagcacctttatcctatgacaagaaagctctttgtagtaggtggtagtagaatcagacagatctggcttaaaatcttggctgtgctacctcttggctctgcacattggtgaagagaatttaccttcctaaggcctctcagctacacgactgtggacactcagcttccttctaaggtcgttgtgagaggtaaagaaaaggggttagtccagggccagacatggcacaatgcctcaatgaaatattagctgatactatcrtaatttttaaattcccataggactcactgttaaaggattacaaggctgacacaaaaaatactgcattttgaatttgtgtctgatttatacatttccaaagagtggaattctcactacaacagctgttctttgaaaggttagatctttgttctgagataaattaagtggaaaaaggtgtagagcattatatgtactctgattcttcagggcttaatttaaaaagagcatgtwtgctggtgaatgctggttcaatcattaagaagtttttgagaaggaatcccagaaagtaataagcacttatttttcatggaaaggaaccggaagtgcttggtgacctccacaggtaatcttgtattatttttgcactgtttggarttttttaaccatgtgcttttatttcttctattcttttcaaaggtcagtaggtgttatctggacaatagggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacagtatctgggggcctccctgcccttcccagtaagagctgggccttcacaggaatagaggcctaggattcgccttcatcctcttgaagagccctaacagtaggtcctggctggggtctggcatagaatgcccttggcacgaygtgtgtgagtgtgtctttccttagtaaatggccttgaaaatgycatgtgcttctggcaggcctggataaggtttgccctgcataacccttggaaagcacagttctcacttgtaacaccctgtctgcaggtccatgatattgtaattaaaaagttatgggatcacaagggcctatttaaagggcatctggtctaaaggcacagttaaaagcagaatttgtgtcagtggctcccttaatttctcaaatatggttctgtttctaaattcatcccactggatgtctgtgttgagttttctgttgatgaaagaatgtttaaaaatgaggcagatccaaattctaatgtctgagtgtaccactgcttaattactttgggcaggtcacctcacctctcttggaaagaaaggtgatatactacatctgtgattttcaatttttttttttttaactagacccacagtaaaacatagatatacaccatgatcccaggacagaataagtatataactaaaataagtgttttgaaatcacttcttgtctgacacagcactcacgctttctattcatgtagtaccacgatactttcttctattctaatgctggtaagagatgccttaaactgattttgagaactaccaatgggtagcagctagcggcttaaaaaggatgttattaaggtccttttcaccctgattttgactctgttggctctcagctgagtgccccatacttagtgcacatagagttggcctctgaggtcagcctcctgttttcctgtgaaaatgaggatggaagagagtcacttgtttccctccttcatggctaccccctgaggactgggaagaatttaagaatttgagtatatgttcccaatagcatgatgtgtttcattgttcatctgtaagcatttttaaatattcgagatctgtatcttgggtaatttttatcaactttttatttgtaaaataatttcaagtcagttattaaagtaacaaaaataatggcaaacttgataccttcccgtatttttttttcatatttttccttgaatgcttacaaaaatattaaagaatattatcacatcattgtagtcaccgatgaattattttctggtggcttatgattagaagagcttgactcggagtggaaacagataacatttgagtgctctttctgttaattcatccttgtcaataaccccattagctaacttccagcaaggctgtgttaggaatgtggaatcaattagatgaattttgaaaataacttggtctgttctaaaaggccctatgagatycaaactgttgtggcctggtgcctggtaactttgatggccattttgaaatgttaccgtagtgataattcttctggaatctcaagtcattaaaagtgatatggctaactctgggccctgtgctataaaaatagatgtcatgggatgtgtgaatcctttcttcagtgttatagttaatagcaactgaaggaacgttttggtcaaatcccgaatacttattaggggctcactgcttggctgcatttttctcctctgcgtaaatcatctatccatgtaattattaacccctaagaatgaatagcatttttaaaagggttccattttcccctcatatgactttggttcattctcctccttgtttctgtctctcagtgaactttccaaaagatgggttatgatgaaagrtgaatcgtcgttgataactgctcttacttatctgtgtatcgaaactgcaggtagtgctcttcagctctgtggctggatttagtgcctcttctagggaggggtgggtgttggcacaaagcgtatcccatttccctgaatgtcgtgtggacacgtgagaggacagtgcaccctttgggcttggtgctgcccccttcacgctactgaaccccagggtcataattaaaagctgtgttagctcttctctggttagaggcatacaggttggaggcttgtacatagccgtgagccggttggtctaggccaggaagcaaaccattggaaaatgtggttagcagtgacagttgacagcatgtttgcctgcagtagtggtggttggtgctgcgtgttgactggagttgcttgcattgggagagcctgacttggccaagtgtgtagcttgagaccagttggattcctctcasagagacagtcttcacccccaagctctgggtgttgggcgtgcagcattcgtattcagcaaacatttgctgatttccgcctctgcaactactgagctcagctttggggatctgaagatgaatagacacagccacacttctggggaaatctccctgtggggaggctgacatggaaaccaaccaaatgggagtgtggtgcatatcttattagagctttgtgcaaagtgccacaggaagcaggagaaggggtagattggtgtggagggggcaggggaagacttgcctaggagcagggcctcgcaggatgcagaggagtttgccaagtaccagagattgtggggtaggtgaataaaggctgagtataaggataagtcaattcaggcagatgtcctctaagaatgaaggtgagaatgctggcggaaaccagttgtggccctgtctgccttccctaggagactggacctgactttacaggcagtgacggtgaagcagggcagtgccacgagcagatctgtgtttcctgaagggtctctggcagctgtctggggaaggagggaagctggcagagccgtgggtggaggcagatgccattgctatggagtgagcatggggaagggggtcggaggccttttggagatagatacagcaagacttggtgaaggatgaagttggggcaggtagaggaaaagcaatgagcttacggatgactggagactgactggagaagatgaccacccttgccattaactaggataggaaacaacaaagggtaggagtttgacaggggagaatgtttgtgctgttgagttgttgagtttaggtgcttgtggcacgagcaaggggagtgagctggtctaggaggtttttggaaacactgacctggctgcagagagggagatcctgggacacctgttttgggagttatcccagtggggaaggatcactgggaagggggccacccctttgggaggggtcagtgggacgactcccaagggaagaggttggttatagggagttaaaagaaaggagcacccctcacgcgagcccatttttcaaggatacatgtttgtcttttagattctataaggagtagctgctacacagaaagatgtctacgtgtgggtgaacacctggcgtatcccatgcagggaggcttcagcagaccttggtggcgatggaaccaccacagtgatccgaggattgggtctgaaggctcctccgagtctccaataaaaggggttgttttgaagggctcaggttcttcctgggcttttttgggacagtcttgctctgttgcccaggctggagtgcagtagaggcaatcatggcttattgcagcctcagcctcctgcctctgggctcaagtgatccttctgcctcagcctcctgcgtggttgggactataggtgcatacccccatgcctggctaatttttaatagagatggggtcttgggctcaagttatcctcccacctcagtctcccaaagcgctaggattacagacatgagccactgtacctggctgagaaggtttttttttttttcccccttccaaacccccatgtggtccagacgaggccagaggatctcaggggaattccctctccgaggagcctccactgctattgcatggcccccagcatagtcatttgagtgaagagccctccaaaatcattaagctgatttgtagaatcagtttgctgtctgactacctgatgaagatgagaagtggtagacctccccccactgtaaggtcttaacaagatctaggtggaacatgggactgtttgcaagctacttctgtttctgaaatcacatgcttgggatcccaaataatctactgaaagctgtcttcgggaggcaaagcccagggatttgttttgtttgcccctaatcatctcttccatcccctttctcaaaagtcttatatctagataatttagtacatttgatctactaacagccagggccataacaggagctgatattacataccccggaagtcctttgcaaacacactgtagtggcgattgattagtgttccgagccataggtaacattagcctgcctcgtaggaccctcagatgctgaccgtatctgctgcaattcttagatgtaaaagagcgcgcatcgtataaatcaaaactagatgattattttcatttgaaattgttgttgcactgtaatttctcagggttttgtattttccaacagtggtgtcacttaatgggaagatcgctcaggctttgtaactgggcataataccaggtattctcgtttaggcattctgctcagtagtattaacctgaagccataggacatgccaatgtttttttccgtgttttttaaaaaaattaaaatggttggctacaaatgcatccttttttacttcagagtaagtcggccttggttaagtcttaatatttctcatgcctatttttttttcttcaaatgaaaacatacggagagaaaayagcatgtttatgccttttggttgtacccagcactgcccagaatggcttacagagtttatacccatggaggtttcgtaaaggtgacattaacttcgcagtaaagtcactgaccccgaacctgtgtcacttcaggcttagccaaatgctaacagagcagctcaaagcttaagcagaggtatgtgcttgctaagtaagtgtgtgttttggactaattggtgactaccattctgaacattaactgccctttgtgttttaatgttgccaggaggccgattgtgtaacctttggaggcttccctgagtttggagaactgaattcatgtggtgacttcctatttataatgtctttgggggagctatgaaataacttttcttctaagtgtgatttttgcttttttaaaagtttttatgttgttgtcaattgggtatttcccttctatgccaagacgaattgtaggttcaggtttctatgcagcctgtatgtaaacactggccctaaagaaggactctatcactctactttcagtttcttgcattaaaacaagtatgggtagcggtatccttcttatttctgcttcctggtcctgtgtgagaccctgaaaggtcctaatggcagtgctgattagattgtggccagggttcacccacaagttccgaagctggggaaggtggaagtgctgttaactgacttgtcccatgtctggggttttgcagcctggggagaggtgaccacccctcgtttcagtccaggtagggttttatgtccctgtcaaaaatgtgttgtgtgaagtaccttgactttcatttcccagggaagaaagcccgtttcaattggctcaagcggaaaagagcactgtgggtccacttaatggaagagtctaagagtggcttcaggaagtccactgggggctccccgtgactctgcccacctgcatattgtcttcattctaaggatccakgtggtagcaaaagggttgttacaactttaaccctgcatccccaccttcaggttcagtacccaagggtgagcaatctgttccagtggcacagacctgtttcaagaggtctctagccgtgatagtgctaggccactgccctccaccagtgtgttccagagaaagatgctctgatgtgccagcccaggccatgaggttcccggcctcagtaaggaagaaggaggacaaggtggtcccttaggagaaaatgtggatattcaagaaagagggtcgcaaaatagcaaacacccactatggctgggcagtacagggttgcagaaatatattttgatgtgtgatcgcattggagctacttcaaagagcaaacacaccactttgatttatttctcttagtgatacagtatttagagagggagatactttttatcttcrtgggatacttacagtggtgctctagaagccatgtactgcttctggcttctccttcctttcctccaaggctcctcctgcctcctcccaaagctctgtgccctgaaagakccttgagccattgctcagatgtcaaaattgtattaagcagacacatcaaattaaaacttttgggatcactcaccaatatggtttcctgtacagtactgccctgaggggggattacaagtagttatgcatccatttcattgatgtatcatttttattaaaaagaaaaacaatccaaccaagagaggaagtgtagccagctgcctaaagagtggcgatgatgggagatgatattttgattacattaatccatatcctgttagttcactttgcttctgtcgctgctgctggtgaagttactaatgtgaactaattacatttgctctgaaaagccagaatttttaatgcatctcagcaagaaaggttaatattatcaatttaacagcatgaatgaaacattgtgtgtattgaacttgaactgtcctaaaagcttggataataaaaacccagtggcttcttttataactcactggataaacagttattggtgagacatggataaggctttcttctctttcagttttatggggggtggtaggcagtcagcattagatgctgtctgtttacagggtgatatcgtaacttcgtgaaattggaggccacatttaaaaaggcactccttccttttaaaagctttgcaagggggctgcatatattttcctaattagtgggaatattttcttttttctttttttttttttttttttgagacagagtttcactttattgtccaggctggagtggagtggcatgatctcggcttactgcaacctctgcctcccgggttcaagcaattctcatgcctcggcctcctgattagctgggattacaggcatctgccacctcacctggctgattttttgtattttagtagagacgacgtttcaccatgttgcccaggctggtcttgaactcttaagctcaggcaatccgcctatctcgggctcccaaagtgctaggattacaggcgtgagccaccgagcctggctggtgggagtattttcaaagagaacaacaattcaccacaccccaacatggtaacagtctttttgttttagaagcatctgtgaattgccaagactcgtagaactaagatgtattcraagtcagtcgattttctggaaacgacccagtccctgaagatagtcttttggggagttgagtgttttgagagggacaccccctctacagggacttaaaatggaatggctttttgtgtgtgcacatggtacctgcagtgatttcttgtgtttaattacttcctgcactcatctgacttacacagtggtaaacaatgaggatgggaacaggcggcagctgctctgtgccatccaccgtcttgggaaccccagcgtggcattctctctggggcagcatgttgaagtgtttggctggtgacattttggtgaccagttggctcctcattgtctttcaatgtggagattaggaaccgagcgaggatttggaacccttgcgtttgttctgccaagaacatgacttgcctctggcctgagagcagtggagtaagctgataggagctagaaatactgttttgggtaggacttacccaaaagagtgggctgagtcacagaactcccaagtttgagccctgtcaaataaattctgaattgttctcaggtatgtttctcaattggaatttttttaaaaatttaatttaaaaaagacttcgaaaagttaccttgttctcatttttcttctccctctttgccccgtccccacaatatcttagggcgaagaaaagcaggtttgagaaaagctttttttcatcatgtatttgtaatagctggagcctgctgagatgatgaggtrgagtggagggagaaagagaccttgaggaggtgtggagggggaaggggtggaaagttctgtcgtcttctgtgcctctctctctctcttgctcagggtctccagtcagccctctgggtttgtgcccttcgtgctgcactgacaggtcaaagccgactcaggcctttgatgtctgctctaggagcaaaagtgattcctggtcccgcagccgttyccactgccttgtgtatgaaggtctgctgctctgaggtggatggtggctctaggcaggctgtttccgctgggtgcggttgttgctgcaggtttttctatatagcttggtcatgctcctgtatctagattaaaatcctatgacagatgggcctgcttatatctaaacttattcagagagtcttatgataggcaacaggttaccctttaccggggtaaaacatggtttattctacagtttggtcccgttgtaaggccaggagatagagtctcactagtttgccccggctgaactcaaactgctggactcaagggatccttccgactcagcctcccaattagctgggactgttggtgtcaggcacacaccaccttgcctagcttgaagatctttcttctaaatgagcgggctttaaagtgatcagtgggacctgggcaggttggctcttgcctataatccaagtgctttgagagaccgagacaggaacatcacttgagcccaggagttcgaggctaaagtgagctgtgagcacaccagtgcaccccagcctgggcaacagagtgagactctgccccaaagcaagataaaattatcccacaggattttagtcctgacttgtgtattactatgcagttgtgtctgtstgaggctcagattcccccccatttaggatttgtgtggctaaatctcagatctcattttcaggtgaatttctctattaaggttataaaagaccaaaataactggaaattcaactctgtacttgaatacttggtaatgcccagcattctcttgactatcccatttcacagtttgccggtcatttccccagtgtactcactggattcttcccgcagccatgaaaggtaggtataattaactccagtttacattcaggacaatagaatgttcgtcaaaatgcttttgcacatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaaacagtgtgttcactatttttatgctgtggctgtgctgtgcaggagctgggcttttcgtgcattttagacagaattgaccttggttaatgcttgacttgggaactatgcagaaacatccaggaagtggtggtggctgatcctgaccgtcctcagttttgtgaagcaacagcctctgtgcctctttctctgcatgctctgttgacggtctagtcttgagagagaacctgctgctgtcccgtctgtcrtagccttcctagcaactcttaggcctgcrtgctgtgttttcatgatctcccccaaagcggcactttgatgttttttcagagtcaaagtatcactgtggatatttatcccaaacaaaattgcaaactgatcaaatgttatgtcttttgataccaaatcaaaaacgattcttggtggctgatcaggttgtctcctaaaaatttgccttttgaacctatactgcctttatgagatgattatgaaagtagaaaatagcctgtgaaaaatggtacctttgctaaaaagaaaaaaaaattttttttgaaactaagagtctctgttgtccaggctggagtgcagtggcactatcttggctcactgcaacctctgcctcccaggttcaagtctcccgagtagctggaactgcaggtgcacgccaccacatgtggctaattttcatatttttagtagagatggggtttcaccatgttgcccaggctgttctcgaattcctgagctcaagcagtctgcccaccttggcttccgaaggggctgggattacaggcctgagccaccgcgcctggcctgctgtaagaaaatattaaacttaggatgggaaatgtgatctgaacaggattcctgtgaaggtacccagtgtaggtcttagtctcctctccagtgtacatttatggaggggcaagatttcaccattctgtgaagaactctgcgtgttgacgactgctcacgcctagggaataaatttcagagcatgygtagatagtgccattttctacttaaaatactataatccattatttacttcggaaaataaaagcattaaggctgaaagttttgggttagtaatcttgatgttttaaaatgccttagcattccttcatttgttttgcttgccacgtggttttgctctgatttacacacctctgtgcatggctaatccactgtgccactcttggggctttattaactcttctctgccagtttttcccttagagaatatcatggccattctctaagatgataaatgggactaagagtaaatgcaggctgaaaaagcatttaacaggtcaaggatctgaagcttttaagaaggcaaaacaataaataagaaacccaaacagagtcttgaagcacacccatcgaaacccaagtttcagaatttgctgcagccttgctgccaaatcacagtaaaagctgaaaaggcttttgtggttagttacgtgtgatacaagaaatcgatgtgtctgagagaagtaggatttctctttttgagggggaaaaatacagcaaggggaaatgttttattaacaataaatatgcggcttaccatatctgtagggcacagatttggttagtagtattttgraggcaggataaaggaagatcctaaaatctctgtgctgtgtagcttccattcgagctgcacatgttaaaaacattctaggatccacacagtttaaacaaggtggctggcttaggaaatgcttctccccattccttggcatccccacaaccctattcycctactttctcttatgtatctggactggcttttaaaagatatttagtgaaatttaattttctagggaaactccactttgtcaaaagtgtagtattcctcaaggatagctttgctggtcggcaaatctcagttgagtgtatttgtggtttaaaaaaaattctttctgaatagaaatacaaagagtgataatgtttaacattttattttttaaaaagctttacgctgtgtaaattgtgggttgacttcatgtttctaaactttgtcttttagaatgactctcttgggtaaattattagcagacactctcgtgttgacatgtccattttcctttccattaagctgtctccattgcagttctgttgatatggctttatatagttttcctgagcttttttttttttttttttttttttttggtaacaagatacctatgcaagctgaaaaactcttggctttttagtttgtatcacttccagaaacttttagatgctacgtatagaagtggctttcttttagggttaggtaagatacttccttttttggaaatagttttgccatttggtctcgctgcctgatttgtgctttttcttcttcagcaggtagtaggaggctgtgtattgtattgccttttaccagacacccagaggggtcatgttggaaaatagcatcctcttagcaaaaacacaatcccttctctgagaataaattgccaagtctttccaggtcattgatggactctcaggtgctgcatttctgcacgtcggggaacaagggtgaagaacagagctagtccagcactgctccgtcctcccgcatttcttcttctgtagagtcttttgcaaactagagagtcttgcagagagttgttgggttttcccaggagatactgtatgcaaagaattgtcatgaagacataaaatcaagtcttggtgtaaaacttttaataaatttaaaggcatgtctctgtttttctcctcctcyatggggattttcatgtggttagtaataaaactgtaggcagttgtatgtctagatttctatgtaatttgtttgtgttcgtatatgcacacctgtatacatgtgcacatgtattcaagaaagacctgcagtatgcttgaaaggattgaggtgcctagtttgtggtagtagctgaacagagtgggaggtcaaagttaagtcattgtgaggcaagggaacttgacttagccctttaagaattggtctgtccctgctaagccaaggctattagtgttttcttccctagctgtgttctgaaatggttcacctgacattcagctgggttgggggagaacctctttaaacatcagatcttattccggaggagtgtatccagccttctcacagcatatcctgttaaatatctgttcaaggttagcctaggcctggagtatggacagcatgaagccagatctaaaacagatcagttcatggataaatgatgaatttaataaaatttgaaaataaaccccacataactagtgctgctattgatcattcatatagccagcaggagtggtgagaggcttggtctgcctgaggtgtggagatgcttgtggyggggggcaaggtggacgagggctggggctgctcctggagcatctttacgcgggtggaggagctctgacacagtggcagtgtttgtaacactttccaaagggattaaaataattctgtagagttaaccctaggctagtgtggcttgatctgaaacagtcccagccagaaggtaagaactcctgtgttatgttgttagcatacaatttgctgaagttcacattttaaattttatatttaaaaaccaaaaagtagtactgatcattttggactgtttcaaagtgatattgtttttacttgttacaaacattggcttgcctgcatctaattgcactcacaatgggccggatgtggtggcttacacctgtaatcctagcactttgggaggctgaggcgggtggatcacctgaggtcagaagtttgacaccaacatggtgaaaccccgtctctactaaaaatacaagaattagccaggcttggtggtgggtgcctgtaatcccagcttctcgggaggctgagacaggagaatcacttgaacctgggaggaggaggttgcagtgagccaagattgtgtcattgcactccagcgagtgcagtgtaaatcccttaaggaaacagtgtgttgtggtaatcrtgatatcatagtaaataggttttgttcgttatttttttcttttacttccttttctaccagtgactagtcctaatgtgttctaacttttgaaaataaagtacaaattagatggatttaaacatacgggaagtaagacggaaattcattacttttaaaaaacaatttgttgtggataagatttagaaatggaaacacaataaactgtgtttccatgacacaggtatactaccaagttcttacaatgtacctttgaggtaacgaattttcatgtcatttggagtagggctgggccagtgagtcactcatctccttgttcattcattacgtgaatacctagtaaatgcccactaggcaccctggagtcatttgtgtagagtggcatctctatacaactgttcgactaactgtcggagacaccctaatcaccccagccacaaacaaatagaacattgtatgtgtgctgaatcccacaaaggccagacatgatgscatgagaccaagaaggaaaagaaataatgtggaaagggtttggggtggaaaggtggggaacctggaggcgggccacatggggccccagaagccatgttgagggttttgtcttcaccaaaggatcagtgggagattagtgtagaacattaaacagaggtggggtatgtgtcatatttccattaaaaaattcatcctggccacagtgtaaagaatagattagggaggaagccaatcaggaagcaattggagtaggcaatgcaaaaggcaaagtgaacttggactagtggtggagataagttgactgcagagagagtaggaagtaaaattggccaggcctgtgttgggggtgggcttgtgagcaggatatcaaagataatgtccaggattctggcttggatgacaactatggcaatgcccattactgagctaggagatgctggaggaagatcaggtggggactgtgagcatgagtttgatttttgcagatactgggtttgagacacttctgagtcaagcaggcatttggaaatgtggactggtgccgagaaggaattcccagcagtgacttggtttaggtggtcctggaaagtagaaacacacacgagataattctggggatggagcttaaagggacgtcagcgttcaagggccaggtagaggatcatgagctgtaaagggacccaggtggytccagcacagcgaggaaagcatgcgagtgtgatggccaggcttccagggagagaggagggttttaaggagaacaacgtgctaaaagccactaagaagccaagcagagtgagaaatgaagacctccactgggtcttgcaagaggggaggcctttgaggacctcacctgagagctgatgaatgaagtgatggctggaagcagctctggagagggaggaatactgtggggaggggaggaactgaagaagtagagaagcatggctgtgcacaggggaggtgggatggcagccagggaggagcagaggtggaatgtggatcttgttttccccaacagagatagaggggggctaaaagtccatggaagggactctgctgagagggaagggtggatccatgagacagaaggggagagctccagtaaggacccagaggtctgaggacaggccaaagcacagatggagggattagctttggatggtaagaggaaggacagatggccccttaaacatgacggtaatgcaaactgctctgttttttttttttcttttggcgtttgtgatgaactttgtatatgctttccttgtttgatccttatcaaaccttatgagaagaaactaccattctcctcatttgatggatgaggaccctaagccctggagaggccaggaaacattcccagagtccctcaggaggaggactagtgctgggctcctttcctcctgttctgctgcctctgagaggagccaggattgaatcgtagccttgtcctctgacctggaggtctgggagtaactctcttatgacttttttagcctagtagaattgaacatgaacttcatgttttaagggatggttgcatttgtttgaatggtcacttctttttctatcagtattagctaatatagggagaaggaagtcatgcttctcaagtaaagcaacagtatctgtgtatccatttacttgattgagctttctactgaattacaggagttaaattatactttgttacactcttgrtattacaaaatgatggccatgcctttattataaaatgacaccagttattctttcctggaggatgtgccttgtgtcactagccgcactaagcacttccccactagtggccccatgtggttgtgtgtcatcgctgactacctgttacaggtgaggaagctgggtggtgcagagacagaaagccggtggcccagtcaggagctcctaagtggcagagccctgtctcctgggttccttctcctgtctttcttgcctctcacttgaaataagagaggacatcagaactggcctgaatggggccctggtagggcaggaacaggacacctctgtggttttgttatgatgtcctgaggataaaggagtgaaaaaaaaatctttgaggaattgaagatttctttatgaaagatggctgaaactcctgacagcttttcaaattcatctttggagaaacttccgttttctctttcctgttccgaggcttaaagctgccctgaaatctacacatttatcaacagtctcttgtcaagactccagggagacaagaactcttatacattgctgttgagagtgtaaaacggtacaacctttatggaaggcaaattggcgttataaatgcgtgttacctttgacccagaaattctacttctaggaatttatcttaccaatacacctgcccacatacaaattgcagcattgtttttgatagtaatacgttagaaataacccacgtgttcttcagtgggagactggttaatacactaagatatatgcacaaaatggaatgctctgctgctgagagaaaccacaagtatgccctgcacccctgtgaatagatctccagtatattaggtggagaaggcaaggcaggcttcttttttgtaaagttaaggagggtaaataagactgcatgtttgcatctgcttgtatttgtgcagactgacactagaagggaaaccaagtaactgaaaaacacgatgattcaccggggtaggtggggaaacatctaggtcgggacaggtatgggagtgacacacctcagtgtacatctttgtatcatttttaaaagtctgtgcttgcattatgtatcaaaacttagtgctatctcctcaggtgcagggttctctggaactctgtctaggttggtctcttggatggcattcttgsagacttgccggaaaaccaaacaaaaggtgtgagtgcatgcctcctggatagatgtctttttagtgtaacttagcacaccttgtacactgtcagggcgcctctcagatgagtcatcccggcagcccctgctccatgagtgtcttccccacagtcctgagtgcttctaaaatcatctacaccagtggaggcaaaactagatattttcttagtttgcagaaaggaatatttccagacaacatgaacttgttctcctttggtctccttttccttgtcattgttcaagtcacaaggtctgctgattaaatttccccttgggtttcaaaagaacttgcttgtttggttgttgtgttttgccttttaatttgagagttgaggcccccaggtgcatgtggtaaagaattcaaagggctaaatgggtgtgtgttgttcgttatttctttgaacctcttggcacttgaatggtgtcagtaatttcactaattatggttggcaaagaaactctgacacatggctttggagctgtgttgttcttacatcatatctcttgagttgaacctatgctctcttgatggatgaactcgtaattcaccaggtgcgtggatcgctgtgattaattgtttcaagctatcagttatttaactctctagtgccaaatgttcaggagaaaatgtaagtgcagtgtaatgtaaaatcaagccggcaactccagcaatttgctcttcaaactatagctctatcagttcccattcatttatacacttacactactcaatttgtcgttgttgttgttgttgttgttgtttttgagacagagtttcactcttgtcacccaggctggagtgcaatggcatggtctcggctcactgcaacctccacctcccgggttcaagtgattctcctgcctcagcctcctgagtacctggaattacaggcacccaccgccacacccagctaattttctgtatttttagtagagacagggtttcactatgttggcctggctggtctcgaactcctgacctggtgatccgcccgcctcggcctcccaaagtgctgggattacagccactgtgccctggcactactcaatttgtaataaatcagggtaagttatttttggtgccaagtcgattaattgaatataggttattttgcatcttagattccctctgacgactaaatcttataagcagaggtatgtgagcatgagaactgtgtcgggtggtcctgaagagattagtggattagaaggagatttggagatttttaaaaaagcctctggacagtgagttaaatggtgggttgacactctgtggtcgggactttttggagagtctrtaaagttctgctgtatttctcaagagctagagagagatgatactatgaccaaatttggtttgaatgtattataatgtactgagtatcactaatttgttgggaaatgactgttaaaaatacttactgacgcttaaaaatatcacctatagcattagtataagtagccaactgatttacatatatttcatgtgtgtgttgggagaggggtgtggattcgttaggccaaagatttcggtaatatatttggaagagataaatgaagataaagagataaattaccttttgaataattccaaaactaaaaatgcttcccttaatttttatttctgattttcttatttctatcagagaaatgtttctcatgtgacaaatataatgctttcatatttacttctgcatgcacaacttttaattaagtattaattgattaattttttagagacaggatcttgctgtgtcatccactttggagtgcagtggtgtagtcatagctcactgggacctcaaacacctgggttcaagggatcctcctttttcagcctcctgagtagctggaactacaggcataagccaccttgcccagcaaatttattattattattatttttgtagagatggaggtcttgctgtgttgcccaggctggtctcaaactcctggcctcaagtgatcctccttccccagcctcccaaagtgctgggattacaggcgtgagccaccacatgcagtccgtgtacactttcacaccttttaatttctttactcattaggtgcattctttagcaattatgtgtaaagtggaaatgagcgtgcaaatcgtcattttctattgacttgcactccagaattggaaaattggaaaactgtaggaaactggaaaattagaaaactgtaggatctaaaacaaatcgcttctatgacttataatattcacttgtagaactcactggcctttgtcagctttcagagtatgtgaacactttttgccatgtaagtagttagtccattggyaatggatatatgtaagttggtatcttcactgcaaacatttagttaattgcgtttattcttgagccattcttgctctacccttaggacttgattttcagtagctacagtggttattccagaagttgttagaattaagagccaggaggaggtactatgtaagctacatttagactccactggacactcacatattgcacgtggaatatcttaaaggggttgtgtgctgtggtcagggtgggaattatctcttttctttccatgagacctccactgtgcattatttaagggcctgtcaattgcccgttattcaagttttgttgttcttggaggacactattgcctatttctttccttgtttaaaaaatttcatttaggtaggcttagcatagttgcagtagaatttaataaatccttttttttttttacagaataaatctttttattacgtaaataccctttaatttgcctatttttaaaattcttgtttctgtgcttaccttgttgttagacagccaaggggatatgctgctctttttagtgccaaggtaaaaggtaaagctgtatcttaaatatttgtatttctctttggtcttggtgacccaaagtgatttgggtcattctgacatttaatcaagtttaaacaacatggctcttagaagtatgtttaccaggtaatctgagggctggttacctggtaacgcaattgagaaatttcatcaagactaattgattaatttattaagcacttattgtccagtttgcctttaattttcatttttctaagtttccattagctatcatggcctcacttgttatttmataatgaatggttacaaattgtttgtgtgtttttgtaattagaatgtaatagcaatcgtctaccagatgagctgacattgtaatgacatgaagtcagtaacaattatgccttacaggaaaattaattctgtaatcctatcatcccatattttgcctaagagattcgatttggctgctgctaggctgcttaggcaggtgacagcatggtgggacacttctcatttttctggttagactacttaaccataacrttcatggtgccacctgaaaaaataattttatcgttttagacttttaaaatatttttaggctttttttttttttggcttaaaaaaagaatctgttctacttgggtattttgttctccttatttcttagtgaacaaagatatttgctcgacttctatcccagaaggaccatcctttcttcttccttttccttacctctaagggatatgaagctgtgagagggaattgcatatagcaataccattttgattccagtgaaagttcttacctttctcttttgtcattctcaacctcttacctgaagagtccattccctcagtatatagagcatctggaagtctaaggtgcaggcaggactgaaagagctgagaaaggcctcacatcaggtgacactggggcacctggctgtgctcccttgttggggggtcccttggcctgggcagttttgcgcttctccctgtttccctgtgccctgagactttgtgggtcacaggcargggggctggcctccctgatcaagggcccttggcctaggagggcccctggatttatctagtccagcttctcgtcgtccaggtgcaaaactgatgctctgagatgtttagggatttgtccaagagcagagttggagccacagtccaaatcttctgagcctagtatggtattctgtcatccttggtttcattttgttctgttcataaaaattgcccaaaactgctgggcaaagtggctcatgcctgtaatcccagctcctcaggaggctgtggagggtggattgcttgaggccaggagttcaagcctagcctgggcaacattgggagaccctgtctcttaaagaaaataattgcctaaaactattcagggttaaaaatttgtctctaagcttaagaatttggaaaaactcagaaaagtagccacctataactccagcattctgagaacagttaagtgtattttcttctagttttttgtttgtttttgagacgggatcttactgtcacccaggttggagtgcaatggcgtgatcactactcactgcagcctctacctactcaggctcaggtgatcctcttcacctcagcctcccgagtagctgggactacaggtgtacaccaccatggccagctaatttttgtgttttttttgtagagacagggtttcatcatgttgcccaggctcatctcaaactcctggcctcaagtgatccacccacctcggcctcccaaagtcctgggattacaggcgtgagccatcatgcccggccttcttctagatgtttaaaacaaacacattttagtgyagttgagcctctgatcgttacatgtttatttcctagcatttaaaagcctttcagcgacatacactccttattagcttaattttttcttttaagagcygtgttcttgctctgtcacccaggctggggtgcagtggtaccatcgtaactcactgaagccttgagctcctggcttaagtgctcttcccaccttaaccttctgattaactaggattacaggtgtgcatcaccacgcccaggtaatttctaaaaaaaaaagttttttgtagaagtgatgcctcgccatgttgcccaggtgtctgtcttgaatgcctggcttcaagcgatcctctcccctcaactctcaaaaggctgtaaccctgattttaatggtagtgtaaagtgacatgggatgaaggaaccgtaacattcttaaagtttccccattgttgggcatttgcattggtcccagttttttataagtaaagaaggctgcagcaaactctgttgtactacttaatctttgtcctttatttcaaattatctccctacaatacgtcccttgaaataggatttctgtggaaaggtatcagtttaaagctcttgacccatatggccaagttgctttccaaacagcttacctgttgagactcggacctatgcttctaaagcctatgtgtgaaatgttcacattgtctttgggagaagcttcccacgaataagaaaaataagggaagaacaaataacataattgtttggatatatgctgtggtttgtgtggacgtctcccaccctttcccttccccagcccaagtcagtcttctgtataaacaacttacataatacagactcttcactgtttgtattatacatgtattttgtgagtctgtgtcagtatttgtttacacgggaattagggcatcaggctgtcttcctagggttcctctgtgcagacttgtagacagtatgggttctttgcgtgctgagttgaggtggccccaaacctttcagacagttgctcagatacctggcagttgctcatttacccttccagaccttcctgcctctatattagccaatgacaagcagatgctttccacaaaacattcgtgtgtgaactgttgacatttatgactgttttctgagcccacaccaggtcatttttctataaaatcagaactgtgagagctcagggcatgtggccatcctggataatgggtcctgctgtctggggagtcrttttcatcaaaattcacttttaaagaatagagtgtttattaacgaaaatatgtgagccttggctgggcactgtggctccygcctgtaatcccagcactttgggaggccgaggcgggtggatcacaaggccaggagatcgagaccatcctaacgcggtgaaaccccgtctctactaaaaatacaaaaaaaaagttagctgggcgtggtggcgggcacctgtaatcccagctactctggacgctgaggcaggagaatggcatgaacccgggaggcggagcttgcagtgagcggagattgtgccacttgcactccagcctgggcgacagagcgagactccgtctcaaagaaaaaaaaaaaagaaagtatgtgagccttatcccccaaatgtacctgacatgtgaataatatggctcaaactaatgatgtgtataatattaaattgactttgttattataagtgatacataattcaattttagttaaaatgcattatttcaatcaatatcaaatattgcagaaggaaaacctaaaatagtagccaaagttactcagatgagataaagaatatgtttagggctggaaaatcatactttttttttttttttttgagatggagtcttgctgtgttgcccaggctggagtgcagtgacatgatcttggctcactgcaacctccgcctccagggttcaagcgattctcctgcctcagcctcccaagtagctaggactacaggcacgtgccaccacacctaatttgtttgtgtatttagtagagacagggtttcaccatgttagccaggatggtcttgatctcctgacctcgtgatcacctgcctcggcctcccaaagtgctgggattacaggtgtgagccattacgtccagcctttttttttttttaaataaagagggtctcaggctggcgtgcagtggcacgatctcggctcactgcagccttgacctcctctgctcaagcaatcctcccgcctgagccccccaaatagctgggaccacaagtatgcaccaccatacctggcttttttttttttttttttttttttgtattttttgtagagacggggtmaytctatgttgcccaggcttgtctcgaactcctggcctcaagcgatccacctgccttggcttctcaaagtgctaggattacagatgtgagccactatgcctggccaataattatataaattttgatataaattcctgctcttcaaggagatgtgggttttttttcctcctgagagtatatttataaagttaattggattttatacaaaagaagcttttgactcatttcatttagcttttaatgttatcatctgggaggagatggtgaagaattctgttagccaaaccatggcgaattaatgtttcttacagatggttttattactttttatgatattatttggatcatgaaacaagtatcttggaaaatgtgagatacaaagatgtgagttgggaggtctctcttgtatgtgagttccttctataacagagaaaggatactttcagtttaagctgagatgctttttccttttcactcttgaaaagtctttgttgcaggaattttctgtgccctccctcctctgggacagatctgcttcttgatactgcagggctccagccttccttccagccagctcatttctcagggaagccttgttttcctttttcagaaaatttaaaygtatatttaacgcacaatttaactccctttcctgttgataatttttttcttcttcatattttgttattaataatagcttacagaatgggatcagtatcaggatcgggaggtaaccaggtctccaagttttccctttcgtttttcttttctgcttttaatgagccttaattaatccagggagctaggctgcagtatctgtggctctccctgatgttttctttctgcmtttctgtcttggaggggaacctgaggatttggaagtagagggctctactagtgcttcctttttgtccttttctcattgtccaaaagagtcttaagcgatctccaggaaatcccctgctcctgccaggaatctgcctgtgagtatttgagtgagttgctgctytttaagtaccagttgagaagctgaaggttggtgttgtggttgtgataaactcccaacatgaaaactgaggaccaccagcgttttcagctcacctttgactcacgctggcagctccaggaacactgaacaggagtccccactgaacctttgctgcgttccgaagcagcacagccatggttaggcactgccaggcagctcttggaaaccacagggagggaagttttggttccttctttctgtctttgtttttgagaggaatgagcttggaataaaagaacgctagtaatgactgatttgcaggttaggtgtaaacattaaatcctcataacaggctaatgagaggtgggagaaattatccccattttacagatgaaggaacagaggctcctagagactaaagaacttgctactcaatgaggtcaggattcacacctaggttgacctgaggatagctgctgcagtgctcacccttcctaccttcccaagaaacaatacgcagagaatttcttttctaaatattgtgtgcctagaaggtgctttgtgttatcgaaacagatatatatgtgtatatctggtctctttaaaattctctttaataaaaacaaaaagtgatgctagtgtaaaataaaagatatatatagaaaattgtgtgtcctcgttaatcttctttaggaaagatatatgcatatatgcagtatagttttgggtttttataaaaatgagatcatgctattagtatagtgaatagcctctatatagtctttcgtaacatttttactttttctcggtgtatggatatcaatttaggtcagttgctgcggagtttgaaacgagttaaaatttcagcagttcacaaaatggatgattcatagtttagtcgagccatcatctgttgatggacagtcatgtggtttcttgttttttctttctctgtgtttcactaatgaaacaggattacagtaaattgactcgtgtatgtgtatacatccatctttgctggtactatagaaaagtgtattgctggctgggcatggtggctcatgcctgtaatcccggcaatttgggaggctgaagtgggtggatcacctgaggtgaggagtttgagaccagcctgaccaacatggcaaaaccctgtctctactaaaaatacaaaaattagctgggcgtggtggcagtggaggctgaggcaggagaattgcttgaacccaggaggcggaggttgcagtgagcctacatcgtgccactgcactccagcctgaatgacagagcaaaactccattgcaaaaaaaaaaaaaaaaaaaaaaaaaaaaaaaaaaaggcattactgccttgttcctgatttaaataaaaaaatgtgttttaacaaggaatatgttaagttttggtaaatatagtttatcatatttaagttgtgtatactcattcatgttttaatttttatcggaagaggctgatgaattttatgaaatgcctttttggcatgatataattgtgagcttttgcttttatttggtggtgtaataaattacgttgattagatttcccaatattgaatcatctttgcattcctggaataagccctaatttgttatggtgtgataatctttggatatgttgctatttgatttgctaatatttttttaaaaattgtgactgtagcctacaaagccctacagataggggtctttagtttttttccttgtttgcattctatcaggtattgatattaggattatgttttttaaataatttaagaagaatttcaccctttcccagcatctagaagcatttacataatataggaaataacctgtttttttttttttttaagttagagtaaaattaactggaaaacttcataggcatcccctgtagtcccatcccagaacattttaaaacaaattttttagtttttcagaatatattatagttgttctgttcagcttttaagccttttctctggattttgatattttctacttgctgggaaagaatttatctacaatttgagtttatcgcacagttatttgtaatattgttatcatttctctggtaatcataaccctttctcattactaacacatatttttgctctttttttgcttttttcccccttaatcaagtttgttagaagtttatatattttattgtcttcaaaaaactaggtatattaattttatatttatcctgcttttaatttcatctcagtatttaatttttattcactttttccattcctttaagtttattaagttgaatgcctgtctcatttgctttttagtcttcttaaaataatggcatttaaggctatacattttctttgaaaattgcttttgttacgtatttttggttttagacagttgatctcctttttgttgttttctagatggtttgtaattaaaatatttatttgatctttgattctgacattacttagaagtatgtctgtccttgaatttttcttttgcttaccttttgatattgtttatatgatttatgaatgcagctctgaggtatctgagrggatttattaacgtttacttgcgtccaagtacatgattaagttttaattgctttgtggacattaaaaaattatgcccttggtaaaatgcaaaggttttattttctgtatttagtaaatcaaacttactgattgcattatagtcagatcttccaaattcatgtatgttttcagttgtcaaattgacagttaatgatgcaccttttataatttttttttttgagacagagtttcactctgtcgcccaggctgtgtagtgcagtggcgtgatcttggctcactgcagcctctgtctcctggattcaagtggttctcctgcctcagcctcctgagtagctgggattataggcacatgccactgcacctggctaattttcatatttttagtagagatgaggtctcactatattggccaggctggtctcaaactcctgacctcaaatgatctgcctgccttggcctcccaaagtgctgggattacaggtgtgagccaccacaccgggccccttttataatttttaaacttttcatatttccaagagaaatgcttagtgtatttatctgccgttttgcttgatgcatcaatatgtgtaatttttttatttttcagggattacatatttatcacatgtaatatccctctctgtccagtttaatgcttaatggccttgagttcttggtttgattttactattgccagctttgctttctttttacttgactttgcttggtatactcttgttcaattgtttgtttttaaatagagctggacttttaaaacccattgagacatttttgttctctaatagggacgttctgccttgtctttctttactgtgataatgcatacattttgctttattgctttcatcttattcaatggttgccatttattttactttctgttattctcaattcccatgttaattgaacaagtcctttgctaatttgaaaagtgtgttattttcaaagctaccggtgcctaacaatttgaaaatctgtatttttctcctgaaataggtaccagcattaaattactaattcttccaccagggtttgcatttccgcaatttctgccgttcccatgactttctctgtctcctggatgtgttctctgtcttttcactcatggattctagtagattcttattccttgctcttgggcgctcgcatttcttcttcttaatcctccagaatctgatactctagagcaacagatcttttctgttcaatttaaaattttaaagtgtttttttttttttaattcctgaaagtttttatactccaattgtgtctccacatatgctcttagactcctcttcccgtctagttctcctttcttggttcaattagttctgtttcagctggtgccacctgttgcagctgagcttggtcaccctccctcaggctcctgcgtcgtcctcagtgggtcatggtttttctttgcttgccgatggctgccctcagccgtcacacaagtcatgggttagtgtcactcaaggaatggcagaccagcagatggtaggtgataagccaggaaacagatactgtgccgctgagttgctctgttcccagtctcttccgacaacataaggcttgggaacagttccaccttccatggaagccccccttccctctggtttcacctgggacagcaggatgagcagggtgcagggccttcttccctgtggatggactctcagttacaatgaccatggagaactgtacccgctctctgttttggagatttgggagatcctgagggcctcagaaggccctcactctcatcccatgcactacctgtaagctcattagattactgtccttgttactttagagaggggactgtgagggaggcaggaccaagtatgtttattcaggccactgtcttccccataaagactatatttgtgtacatttttctttgctgtattgtgagaaggaggtagaaaaaagatgtgcatgtctgcatttggaaacagttctgagagtggtgctgcatcagcggggctggattgccctcaactataagaaagtgggatacttatataaaggaagcataatacagcatgtttctcttacaggaaggactgtttcttagagtcctcatcctctgtctccatcactcagtatagcaaatcatacattccatcaatgttaatgacatcaattgtatgcctgtaagtatgtacacacgcacaggggcagggggcacttcttcactccacagctggaaaacttgggacaaaatgcctagccagcttggcccaaatttgagggtattgccatctgtatctcagtgcaggtgtttctgtctgatgttcacagtctgtttatccagagtgccccagaaaggacagtagtgttaggttaaacctgtgtatgtctgttcttggttttaataacagtcctgtctttggaattatttagtgtgttctctcatttctcaggaagtcaggatgttagtgccgaagcacttctctgacttggtccgacattgaagtaccttcccctgcattacagaagaacggccccccagggggtctgtttgatgaacacatgtattattgcagtgagatactctagaaatagcttcatgtccttgcaaaattgccagcacaagtaaggacctggaaattgttgctatgcatgtatgtcagaagatttcttaaccaattctgtactgaataaaataaaatttattttcaagttttgtagggacctggggcaatatgtcagatagagttgaatattttcaaggcatttttagttcatggggcacatagttggcttaagatatctatgtgtatcaggactgaaaggtaaagtgcccgaacctgctaatgaaagaggtgtctgtgtggccatctgaggttcagccacaatgtgtcttgcagaattattttattttgctagtttttaatttctcaaacagttcagctgcctgtcccgtggtaccgtgagacttctaattcaagatgaccagtatttgcagacagagccactgcctttgctgccacattttgcttggttattgtgtgagaacaccatttttctctttttaaatgaattgtgtttctctttttaaattgagcatcygactgggcgcggtggctcacgcctgtaatcccagcactttgggaggccacggtgagtggatcacctgaggtcaggaatttgagaccatcctggccaacatggtgaaactcctgtctctacttaaaaaaaaaaaaaatgsaaaaactagctgggcatggtggtgcacatctgtaatcccagccacttgggaggctgagggcaggagaatggcttgaacctggsatgcggaggtcatagtgagccaagactgtgtcattgcactccagcctgagcaacagagagagactgcctcaaaaaaaaaaaaatccgtttacatagtgataaataaagtaattactatagtggtggcattctgcctaagtcatcttgaaaactgaatgcaaaatctttttaatagctccataatggtctcttgaagtgttacagatttttataacratagctgtaatacaagtgcctttatttactgtgagacttgaacattttgaccatttacatgggtacttgtgtgtctccagctgagctgagtgcatgtcgctgcggcattgcaggcgtgtgtgcatgttggctcttgcaacggggcgtctgccaggggttgtctcgggcaggagaaggaggccagactggcaccacttgtagtgattggaatgtgtctagtccagctcttcagttccatgtaggaggttttaggatggagattgtgttttgggaactccaagtcactgtccaatttggagagtattatgtaagaaggcttatgttttctgattacccatccttcgatacagaccaaataataccacagtgataaaaatgggaaaggagctgtcgctcagctcttcttggccgtgttgtttgcttttcgatgtctaatttatgaaagcatttcaaagtgacatatatactgaacagcttcgtcttgccaaatgtaaaataaactggagatgagtttagcacagagctttgtagattgttgtcctcttggtagagtcggggcctaaacaccacctggcctctgtgccagtggacaggtgacctgcctgtcctactgctggtctctgcagctctctgtcttgggcaaccctggctctgagttccagagtgttctccagtaggagagtctgcaggggcactgtggagcacctgggtatgtgcacatctgttgttggctggcgttgtctctgatggcttggggtgtcacagagacatgacagtactgtcactgcatacctctcaagcttttgctgagtcctacatgagttgcaggggcagagagggagggagaaaacaatgcctagccacactgagaaaggggaaagtgctacagagtcctggaaggaagcgaggatggacatggacggggaagcattcataccaggcaggaaaagtgacttcatggaccagtcacagaggacagggccagggatcaaaccttccgtaatttgcctccacagtttgtctgagactggctacctggttgagtctgccagagccctgtgtgcaggtactaccactcactgtcacctccaggcaggaaaggccatgtgaatgcatgcatctttgcaggaacttgcccctttccactgaggtttgaggcagactccaaccacatttccatccagtggcttagtggtcttacccgtgagcttgaastgttgtccctgccaggacagtctttgcctctgtaartatctccatattcctccatcctttcaggtcccattcagtccctaggtcctccatgatggaatattggttgatgcacttattccacaaacatttgttggccacctttcaagtgccagwcaacccttctaggtatggaggggtacagtgatgagcaagccactgtttctggctgcagagggctcactgtttagtgggagaaacagacaaatcatacatcttaactacactgcccttgattgctctttacctgttatatcagtcgatcttgcctgcctagcatttgttccctgtttgggggcctgtatgatgttcgtttggatacctcagggtacattttcccatctttgtgatgatgtagctcacttggtctgaatgatatgtaatcctgcacatgtagagtgaccattatatttgcataaatagcattggaggaatatataagaaatgaataaaagttgttatatcatttgatttttcttttcttttcttttcttttttttttttttttgagatggagtctggctctgctgcccaggctggagtgcactggcacgcgcatagcccatcgcagcctcaaactcctgggctcaagtgatcgcctgcctcagacttcattttgatttgtgaacctcgtgattctattacttgttccacaaaaaattttaaatgaaaaagtatttcaaaaatacatatattccggccaggcatagtagctcatgcctctaatcccatcactttgggaggccaaggcagacagatcacctgaggtcaggagtttcagaccagcctggccaacatggtgaaaccccgtctctactgaaaatacaaaagttagctgggcgtggtggcacgtgcctgtaatcccagttactcgggagactgaggcaggagaattgcttgaacccgggaggtggaggttgcagtgaaccgagattgcatcattatgctccagcctgggcagtgagtgaaactctgtctccaaacaaaacaaaactaaaacaaaaacaaaaacaaaacaggctgggcacggtggctcatgtctgtaatcccagcactttaggaggccgaggcgggccgatcacaaggtcaagagatcaagaccatcctggccaacatggtgaaaccccatctctactaaaaatacaaaaattagctgggtgtggtggcaggtgcctgtagtcccagctactcaggaggctgacgcaggagaattgcttgaacctgggaggcggaagttgcagtgagctgaggtcgcaccactgcactccagcctggcgacagagctaggttccatctcaaaaaaaaaaaaaaaaaaattcctccacaacatatattccaatgtttagtttttctgttacagagatcacatgtactctaacttgtcaactaaatttaaaaggaaaagacaactttgagagaaaattaaaaccaatgcagtgtgtgtaaatgccattttgataagctcttatttcatgttgacatattctatggtgctcgtcttacataacctagttagggaaatgttttgttccagtctggctttgtttttcttcatgtgtttaggtccttccactttccttttgttaatttttggtgttgtacttcaggaaatgaattgagggttgcaaatgacctggagggccttagtttgtttgcttgtttgattttagcaacagtcaccgtggtacacctgacgtggctgggactcctgattttttttttttttctttttgagaacaaagaatgtgtccttgtcttggcatggactgggtagccttgttcacctccccacccatctctccttattggtgaggcattgtaaaccgtgttaacaggtagcatccacagaaccctggaaaggttgtgaagtccctttggaagcctaagggttttgatctcatccaggttgtaatcttaaattctggtacaaattcccttgttacaactgggttaagtggttttaacctcttttgtgccttcattttgaatgcttagactggaaagtcgttcagagactcctgaccgaataaagcctacttccaaatgagtgggttgtccaggtgtgcttgtagatgtcacatacttctaacaaggctctgcagctgcgatgtcaccttgcccagcgtgacctcmttagcatgtatgtggctttcagtggccatgtactttgcttctagagctttctttcccattctgggttcttaggagggggctgtgctttgtgtgtggccaggcagaagtccatgttttagcttttcaattctcttgaagaaaacaaatgttgttgataagaacacttgtcatggcatccgatttgttcttgtgagggctgtattagcaataaatagacatttagtttgcatatttaacacctcatcttctttcagcccacacgtcttcactacaggattagcttttcattacttagtagagcttttaattacctgaagctttcgtgtctttactgggatataacttttctccttattaaccagaaaaagtcacagaaaatcttgtaatttataatggaatggagtaatattcacaaacaggctttggcaggattttttttgttattgtgttttttgtttttgtttttttgttacactagttttatcacaagacaagaaagaggggaacttttagaaataaaaattatgtgctaaaataattaaccttcctgagtaacacacacagaatgttggtatagtgtttgcaccagaggaattacatatggaagaatgctgggatcttttaccaaataagggaaagtagagttcattacaaatagaggcttctagcacagaaaagaggacattttataagtactgtgaagcattttcagagataattaaataatagaaaatattaaaccaatttaaacaatttgtagtttttttctaataaccagtaagttcttcgtcttcgaataattcttttatactgttctatttccagctccactgagtgcccctgtgttttcagagaaaacaggagtctgttttggacttcctctttggtatatatggtgggagatttgtttaaaaaatttttttatagaggtaaaattcatatgacataaaattgtccatttaaaggtgaacaactcagtgacatctagtatattcatactgttgtgcaattgccatctctatctagttccaaaatacatttgtcatgccgcaaggaaagcctgtaccccttaagcagttaatccccattcccctttccgctcagctcctggcaaccaccagtctgcattctgtttctatggattcacctattttgcatagtgcatataaatgcagttatataatatgtgaccttttgtgtctggcttctttcacttagcataatatttttaaggttcatccatgttgtaatgtatcagtacttcatccctttttatgggtgaataatagtccattgtatccagttgtatccagaagatttgcttttcattgcctaacttcagggcttcagacacctcaatctttgttctgagatggatgtaaacttaatgtatatctctctctctcacccaatgatcatgccaacaccttttttttttttttttttttttttgagacagtctcgctgtgttgcccaggctggggtgcagtcttggttcactgcaacctctgcctcccaggttcaagtgattcttgtgcctcagcctcccaagyagctggggccacaggtgtgagccaccacacctggctaatttttttttcttttctcttttttgkttttgtagagatggagtgttgccatgttggccaggctcgtctcgaactcctggcatcaagtgatctgcccgcttcagcctcccaaagtgctgggattacagacataagccaccttgcctggccatgccaacaataattatttagaagtatgttgagaatacatcccaataatagaagtgaaagctctttaaaaagaaaaatattcaaaacttaccagctgatcttatgtttcatttagaatggctgcattctttgcagtaccctagggttgtagaaattctcccccatgattgcacaacccactccttctcagccagtgtgcacctggagtcagctgtgtttggccttaaggtgtccatggkccagcagggagagggcagatgggtcagtgttgtcctgctagtgatgagtatcccatggtgggcatgctgatgccacgcaagggagagggtgtctggttctgtgcagtggcagtggtgcaacyccttaccaaggtaccgtggggacctgggttagggcaggaggaggaaggtgttctctacagactgcagggcttggaggcagcctgtcatggggaagggygtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatgaatataaatccataaggtttttcaaatccccagaaatccctttcrtctcccacctggttttgctgagcgcctgtctcttctgtctcttttctgattcccacctttcacttttcctccatttttcgcttaatggatttatactttaaagtaggtattctgaaaattccaattttatgaatggtgtgacggtgagaactttgattcattgaaagataaaaataatcattacattttatactgcaagggtcatccttaatattcttcgtatttttaatatagctgcatgatttgagtagttgagttggggattggataatgtatttattgattgattaactctctgggggtccatacatacccctctttatatccctgtggtccctttttagtccttttgtaaaaacttgataatgttaacctctgccaaagttgatgcggtagttgtgagtggtgggacgcaagcgtgttgatttattcttggagacagcagaaacagcaccaccttcaactgttttgtcatgatcatcttgtaaccataattctgtgctaagtcagaattaatgttattttgttaattcaggttattgtgaaaatctccacaggaggttatttaagcaagtcacaaattgatgwttctgtttgtagaaaaactccagctcatccagccagccacattattccagggctgcatggtgtcagcgtagggaccaggctcggtgtagagaccaagggtgcctttccccttcctttccgcccgttaattgcctactcgcccagtggtaccttctgaacttttagaaatccagataggatttccacatggttcattagaattcatttatttttttccatctgtatttctttttgttgtactccctagatcattatttttagttactttttacatgcattggttaggtttttcatgtaatctctcagtaagcgtactgggggatgagtgacctcagtatttaaatttttcataggtgggatgaaatgtcttttctgagtgtgagtatttctgttccattcttcttttccaggcaggctctcattctgtgctgcagtttggattcagggagcactgacccttctgtcaggttgctcctgctatgaaggatggaagggcattttgatacatgaggcataactgtaattatccggtggggcttggtttgtgctgttttccacctcttcgtcatattttggaaaactgaggccaaaagcaaagttcattttcccctttaaaagcttctttaaaaaaatgatgaaagagctttatcaatgttttgaataacccagaaaatatttcttattgttgataatctgcagtttgcaagtgcagcgaatcttgtaggtagatttaccttgagttttttgaaacggtagaattaatrtattaaaacatatggtttttagttaaaataggatgttaaaggaatagagcgcacgaacaaagaactttccacttgaacccatgttgtttcatctgacagtgggtatggtgtccctggcaggatagggcttccacctcctgctggtgccggtaggacagggaagaggtggggaacactgtgtctccatctcccaagcatcttacctcccaagtcagatccctggcattgtttgcatacttgcgtgtttgtgtgtggggtgatgttttcctgagaatgtggcaaaataatagaaggtcccagggttcctcagtctgcagaccatagctgagtggtgtgtgcctctagccatgaggtgaagcataggtgaaattcagatccataggaagacagacagactttgcaagttagtaagctaacttgctagaggaaacggtagactcctgtgctggctgccaactaaaaagcctttctccacagttctgttctcatgtacaccctcaggaccttggatgagcttgtgtgttcaggaaattgggcaccgagattttttttgtatctttgattttagttgatatgtagtccttccaaggaaagtattcgttggatgccctttctacactttggcattgtgcaagaggtatcaaattttaaagtaaaagtgcacaacctggccaggcgcggtggcttacgcctataatcccagtactttgggaggctgaggcgggtggatcatgctgtcaggagatcgagaccatcctggccaacgtggtgaaaccccatctttactaaaaatacaaaaactagctgggcgtggtggtgcgtgcctataatttcagctacttgggaggctgaggcaggagaatcactttaaccagagagttggaggttgcagggagccgagatcgcaccactgcactccagcctgggtgacaaagcgagactccatctcaaaaaaaaaaaaaaatrcccacaactgggcatggtggctcatgcctgtaatcccagcactttgggaggctgaggcgggcagatcacgaggtcaggagatcgagaccatcctggctaacacggtgaaaccccgtctctactaaaaatacaaaaaaaaaaaaaaaaaaaaagccgggcgcggtgccgggcgcctgtagtcccagctactcgggaggctgaggcaggagaatggcgtgagcccaggaggcggaggttgcagtgagcggagatcacaccactgcactccaacctgggtgacagagtgagattccgtctcaaaaaacaacaacaacaacaacaacaacaaaacctcacaaccctggtctcccagagcttccatattaataaatctagacaatgtgaaatgcaaatccacttaatatttgatgcaaaaaaaatttatttgacctgttattttaactctttgacataaaatctctaaatcaaaataatcagcaacagttttaagtgtataaatatgtatttctttcagtgcttgaacatttttagacaggaagattcttgatcttctttgtaagcaaatagcatcaaagagtaacatttctgtacctttgtggtatgtaccttgtggctaatttgtccatgaagggataggcattgtgttttgttgcttaagtcgcttaaggcctttaaagcatttccaaactcacctatttttgctctaaggggtataaggtgttaaaaaatgaatggaagttaactcattctcaccttgtctgctaacttccttttgttctttttctgtaagaactcataaagctgtatgcatcagctgctcccaggggccttctaaggcctcagtccaacaacagtgctacaggtgaggaaaggaaagaagrcactatgtcatcatgtcattcttttagacttggtaagaagtatattcaagcagatcagatgctctcagaatcacagcgtgttgtactgctagtaattaaaactgaagtccacrttgaataagaaataattttttattgattgctggcatttgtgagaaagggtttaattagaccaggatatggaggggacttatcgacagttccgttgtacattgttgacatggttattttctgtatctcattttgcctgggaatttgtcattctcttctattttcttatcagtagcactgcttttacacttattagccctagctgtttgtcttgcttatttaaacttgtacatggcacatgctcaaagatttttccaggcaaaatttctttaaagcaggatttgagattttcyatccccttccgtctgctggattattccggtgagtgttaatctcccgcctttgtcttagcctctctgtggtcttcggttgcttccttgttctctgtagatctcctgagttggccattagctgtcaacagtcagcacttgctgcctctcaagtctcttcccctcctggctctgccctggttttgctctctgacggggatctaaattgggattctttccagtgtggaatcctgggtgtccaccatgtcactctgacttccagatgataatgagtgtgaccatgggctgaatgaatgtctctctgctgggattaaaagttagaggaaggcaaaaacagayattgcgtgttctcacgtatacgtgggagcaaaaaaagttgatctcttggaggtagagagtagagtgatggttaccagagactgggaaagggggcgatgaagaggggtagagaatgagtacaaacattcagttagatagagggaatacattctaatagggtgactatcgttaacagtaatttactgtatatttccaaatagctagaaggttagaaatgttcccaacacatagaaaggatacatgtttgaaatgatggatatcctaattattctgatcattatacattgcatacatgtttcaaaatatcatattaaccccataaatatgtacaaatatcacacatcaataaaaaataaaggggaagacataggtgtaggcatagatttttaagctgagaaccttttgacagggaagaccagggatggttttagggtgtggggaatctgtgtaagttggccgttagctgtcaacaggcaacaatcactgtctctcaggtccctcccgctcccggccgtgtcctggttctacttgccggcagggatctaagttggaattcctttccaacatggaatcctgagtgtccaccatgtcaaaattgtgtcaaaattcgtctgtatgcatttttcttggtagaagggtccccaaaagtcaccacattctcagagacttctgatccctaaaactttagatcaacagtcaataaaaaggtcccagttgtgtcttagtccccatggcagtacttttgaacatttaaaggtggagaattgctactgaggactttgttctgtggatgaaacttcgaatgaggattgttggtgagagttggattgttgttgtatgaggaagtgcaccttggaatctaatggggtcttcacggaggggragtcagttgtggcactgtttgtgtattccattcatcattcatccctccatccaagcacccacgtggagctcagaaagatgactaacacataccccctgctgctcctgtttttctaaggtgtgctgggaccatttacatttagttctttggagaacacaactacttaggatttttgttgttgttgttgttttcctgtacattgtcttcctatctcccttctggtacccattccaccctctctccccttcctcactgcygtttcataggggttctcagattcctgtgaataaagcaaaccgatgtgcagatatgtgtgcttacacatgtggacgtatttgaggaggtaagagggacctgcacaaggctttagtgagtaagcagagaagttatttatatatagtgagacccagtaaacggcgatgtcgcaggtgaggcagttgatctggtcagaatatgcctccagagacatcactggtgaggcctgcatgcatgttgaaaagagtgtatcttacatctaggcttgggtttccccctgcagctcacttatgaataacaacgtatgcaagagatttgaacattttcatgttcaaatgaaacatgaaaagggaaaaaaatttaaggttacggttaagtttggattgtttgcttattggtttggttattggcaattgctacaaagtccagggtgttctttatcagcagcatgcttatcaagttactgacrttcaagctgagtttccttccctccctccttccttcttctccactgacattttttttttttaaataggtagggaggcatttaatcttgtagcagcatgagagtagcttaaatgtccctcctctagcagtatgtttatagcagcgtaggtaaggaaagcccagcttgcacagctgagctctaaagtgcatacatcccttaagttctcatacacacactggccagtgagacccccaaactgcgaacagagaattctaattgaagtaaaagcatgaagtttttctttattgaccatgtagcaactgtggaatcatttgaaaatttctgaaaacatgaaacaggtgtttataaggagttttctgacttaacaaaattggtgaaataccaactttactaaaaactrctaattcataattttttgattaataatttctagtctggaaaagaggaattttttgaaaatcactgatatttttgatatactgttgttttcaaattgagttctcatagtgtggtcggctctgttctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctcactgaagcctcgaactcctgggctcaaacagtcctcctccctcagcctctctagcagctagaactgtatatgtacaccaccacgcccagctaatttttttttttaacttttttttacttttgaagaggtgagattataggcactagccactgtgcccagccaaaaggtcactttttttttttccttgttggggaggaatcaataacaggaacaccagtcatgatttggtgttttttccagggcagacaaataaagatgatattacgatgtttgttatcacagaatatgtttgcttttgataggggttgggtgctgaagggtaagtggttagaatcattctttttctaagggtacagtcattaatactccttgattcaaatcactatttaagttataaatacatggatttattttctaacctcaaaattatagcatcttaccacatatttgcatgcctctcttgagttaactactggtgatgattcttagctcatctgtggccaagtatagataagagaattagaaagttgtttccagcgtgtgaacttttatgattttcttccttggttactgtactcagttcttttttgttttgtttctatacaagatgagtagctggtggctcagatgacccccgtgctgcatgtacagtcccatccagagagtgttgggggctgtgtaaacctcgaggctcagagtggctgccattttcctaaaagagaagtatggctgctgttggcctcaatgttcagctttacaaaaaytcccgtaattaatgaaggtcaaggcatctgcaaacattaatggggtcacaagggacaaatcagttccttgaggggaagttaaaatgctagattgcttaccgctccagacaaggcrttctcaagaagtatgtgcagtttcagcacaaggattaacacggagcattacttgagccatggggtgccttgggggacatggatcagcaaccatttccttttgctcacagcgcccagattttgttctggggaccactcttatctgcactgcatagcagccacacattttgagtgaaattaaccccaactagcattcgagcgtcctcccctcccccaaaagatggactgtaccccacactgtaatcagcagggaggcatttcctggccacagttcaggttggtcccttagaacgctgctcagaactgtggtttggtggctctgggaagcagtgctctctctgagtgtgaataaggatccacatagctccagtaggtgtctgacgacatcttgtgatccggggggaagccagcctaaggacaaagccattgtggggtgagagacaggattggcacaatcactgacaaccgcagtagtagcccagaataaactgtgcctgaaacctaccctatttttgtattttttccagttttaaggaaataaatcccctttattgtatactcagtttgaatcaattatttttatctctttgggattggtttttggttaatctcagcaattcagaaatagctgaagaactatgctgtgggtttagacatcatgcygtgacaaaaagaagaggatcttagaagcgggggacattcactgaagctttatgagcctttcctgaatcccttcaaatcagatcaagttctctctctcctgtgcttagaaatgctgcctgttaagtcacgttggctacagcacccatctcagatcccttgtgattcagttgtaaagtagattcttctggtctgaattagaggccaaaacacaagacagatcaaaaatggggaacatattgcaaatttccccacaaaagactgaaggatgtgtttaccattgattgcacagggactgcagtgtctatgcttttaggcatggaaaatgcagggtttgactatcgagtttagattttaaagttgaggattgtttctttaagaagaaatatagaatattattcagtcctaaaaaggaaggacattctgacacawgcaacagcgtgaatgaaccttgaggacattatgccaggtgaaatcagccagtcacaaaaggacaaatactctatgtgatttcatttagatgaggttccctggagtagtcgcattcagagacagaaaacagaatgatggctgcggtggtgggggggtggggggtggtttggggaagggagtggagtgatggtttcacttttgcaagatggaaaaagttctggaggtggctggcggtgatgttgtacaacagtgtgaacttacttaacattgctgcactctatacttaaaaatggttaaaacggtacattttgttatggatattttcccacaattaaatttaaaaggaagatgagtagtactcgactcattattggatattacatcagggaactggaggtagggtctcacttactagttacgtagctcaggaacctggaaccagactccttctccagctgggcagtcccaggtttgagtcctggctccactggaggttgtctgacttggakgttaataataacctgccttagtcccagagtccttagagggaaaataggttataatacctgagtccatgtgtatcaagccattgctggttccaggcccctggagcactcagaaatggatgacccccagctgggtcaggccaagtcctccctgctgtagcaagcgggaccattgcctcgttccccccacctccacatggaaggtgccttttgtgtcctgccccatctctgttttaacagtcacaagactgtaggcagatctaaacttgtttgcacattattatcacctggggagctttgacgattccaaagccaggctgccacccccacctctagaccaactgaatcaccatttccaggggtgggactgggcatccgtgttttcgaggcttctgggtgagtaccttgtgcaaacaagttcagggaccgttgccctagacactgttcttcccctcatgtctcaacctgggcctcctaccactgccaccaccacagctatgccacctgggatgtgtcccaagcccccacttgtcggggaagcagctggggaggggtctttggccacctctgcagctataaggatcagagcaacacctggcttctgtgcctgtggcccctgctggtgctgggtccctggtccgcactgaaggatccaggcagagtacagtgggtctcccaggtcagaatcccctgggttgcttgttaaagctcacagggctgggccccaccccagggtttccgattcagcaggtctcgggctggttggatgatgagaatttgcatttctgtcaagttcccatgtgatcctttttggggtctgggaccacactttgagaaccactggtctattaaacaaatctttgcaaattagggaggtgtgttgtgggaggaagagactgatagttgaaagaatatttgcctaaatacagtgcctagtatttgccaagtacgcagccttctttctggctttaatcatacagactttctcaatcacatgtaattgcacatcctttaagcagcttttgactgactttggttttctcttttgtggtgattttccttaaactcccgaagggagggtggaaggggcaagagaaatttttatttatttattttaatttaattattttttattatttatttttttattttttttttgagatggagtcttactctgtcgcccaggctggagtgcagtggtgtgatctcaggtcactgcaacctccgcctcccgggttccagcaattctcctgcctcggccttctgagtaacagggtctatgggcatgtgccaccatgccgggctaattttttgtattggtagtggagatggggttttgccatgttggccagactggtcttgaactcctgacctcagatgatccacgcgccttggcctcccaaagtgctgggattacaggtgtgagccactgcgcccagccagattttatttctttaaaaaagaaacttactagttatcaggacacttgtgttcttggtacttgattttgtcagcattatttttaagagcctcktccctccttccccctacctccctgttgagcccaggctctgaaataacataggtgcatgtgaagttcccctacctgccattaccagacattggtgctgggcggccctcacctccacctcctctcacctgaggccacagcggtgtgcaaggatgtggtctgtcttgagtgtgttttcaaagcagctgtttggtctgtgccttggatgtttttccacagataagcccaaaagagaaccacatcttaaaacgcccgtgaccttgaatggtctttccggaggggcggctggatttgtgctctcatcgtctcaggtatgtgtcaagccactgttgtttcagagctggacacaggtgcttaggaaaattcctcactgaagggttttcaggatttacaagttcttgctgtttttgtgaccttstgtggtttctggtttcacagaaggctttgtttcttggttcttgttgctgctttcagccttggcctgtaatcactgggcgccagggagggctgcggtctgtttcccggggtgtgctcagataccgtgtcagttcacatgtgttgctgcagcggcagggggccaggcaggaggggcgggtgtcctgaagcacgctcaatttgctgatcagggccttcacttggattttgcacttgccgcagtggagacattcctcgtagctactcagtgtggtttgttttaagtgggccatccgttaattcatgtgacctggaacttggttaatgtacttgccaaggttaaagttgagacgctgtttgttaaacctttcaaagagggaagaaggttgccttgaattcagttccagggtttgggagtctgagagggaggtggtgaggggcccggggaggccctgagaaacaaaatgctggttaaggacacagtctgctcaccgacctcggaagtctctagacgtctaaagaagtccaagcaaggaatgatgaccgaagaggaacctcaagggtgcaggcggctctgggatctcagcacatctcagtgatggaatgagctgccggggaatgacccctgtgggkgctgtccaaagtcagagcagacacaaacgtagctctccaggccccataccttggtgggcaagagggcagcaagtgcatcctcacagttgatggggagagcagcatttcagcctgcagaaaagagaaccacacagatgtaagatgaggtctgcactcacttgcctggtcatgcagagacggagctgggagcagctgcatgacttttcagagaagtggcacacgtttactgtaagggtcccaaatgtagaccactgcagatsgtaaggtctagatggagggaccaatagtagggaagtaggggagaagaaagtaaaaccttacagtataaagacccatagatgctcttttgtttttgatgtgtgtacgggggttagrtatttattgagcacctactgcatgacagagtgttcagcaatgacaatgcagagcttaataagaacaggttctagactaatcttttagggggtgaggatagaacagaaataggtaattatgtcctgagaacatgagagagtgttggtggacagaacggcgatgtatccccaagggcaactgaagccttcacagaagatgcaaagcctgtacgtggtcctcggagtcatgccacatggtgactggttatcttagtcgtaggaaaactgagaagctttgaggcatgttctatctgtctttgtgggcatcatcttcattatttgaacaattcagagtgcttgatgccttttgcttcgttctcacaatccttgacactaagctgtgggcttgggttatagtcactcattctgttattcatgtcattttgcctatccttccacttcacagatgagaagactgagacccagagagggtcatggttttcattagccaaatggtgcagaaacccagtggtcacagtggcyctctagctctttgtcacccacagggcccttgataagagtacggtctttctccaggggagcagggttgaggagtgggggcagccctggcctgggtggccatatcctgatttcccctcccttggcccatagctctctatcttgggtgaggtgagaaagtaaggctgctccttgactgtggtcccttttgtgtctgtcctgcactgggccaccttcccaggggccttgtgtcagcctggtagtggtgctagtggccttgaagtgagagtgggtggatcacacatggcagatctctggcagtgaccttttctgtggatttccggtgactgatgatagcctctttggaagtcagcatatgcatagctctctgtcttttgaaaacaatggaaaaacccaccaccagccccaaaaccagctgtctttcttcttatgaatagatatccatgaaaagcagaagagtagtttcttgtaagtactctgggagtgcataatacattttaaataagattaaaaattatgttttattcttactagcatcactgtcagataattgagcgtgagagcattcagtgctgtgtgcttggtacgaagtagtaacatcaattcagtgttcagtacatccactttgttccagaacaatgtattcaaggtcggtgtattttggctgtgccacakagttctggaaattcccaagagaataagttttcacctgttatataatccagcacaagtgactgtgtagcagcaacctcatgtttcatgatgactttaaaatgcaattgattctaaaatttagcttttaaaaatttcgacttcagattttctctgaaggtttaaggtaggcttctcctttattaattttttcaagaaatatttaagaacactgctctgtgctatgtaccattctaagcactttacagatactaattcatttaatcctcagcctggttaggtaagtactgctattcccaccgtacagatgaggaaacagcctcagaggagttaaaacaagttgctcaggttacaccgtcagcggtttggactacttcagtttcagataatcactgtgaaattttactgttttgagctacacgtttcaaaatcttttctgatgcggaactatcattaaatcatataatccgcttctctggagtcagaggttgacaacacattagcacttgactcgagcctctccctggaggaggacattccgtctgcggggagccgagtccgaggctggagcaactctggaaccacagccctccagtagagggcacacgagagcaggctatctgtggagatakcctgttggcacaggggtgaagatgacagaggcgaacccaagcaaagagagttaattagcagagtttgccctccaggctcggagggcaagtcagcctggggacctggagttagttcccttttcagctgtgaccattgaagacattcatcaagttctctggctccgggatgtcagctgtggtagtgacttgcatgggaggttatccgacatacctcacacactttaactccacctcttcagagtttgtggccaagaatggagccaggtggctattttttttttttaaatttatgtaataacaaacattcgcatttattgaaaacttaaagtataataaaaaaataaataaaakaaaaaaagaaaaaagaaaacttattcctgtgtcaggcacttttctaagtgctttgcagtgtattgtctcatttaatagttgtttaaattaacagagtaggccgggtgtggtggctcacatctgtaatcccagtactttgggaggctgaggcgggtggatcacctgaggttgagagttcaagaccagcctgacaaacatggagaaacctcatctctactaaaaatacaaaattagccacagtggtggcgcatgcctgtaatcccagctactcaggaggmtgaggcaggagaatcgcttgaacccgggaggtggaggttgtggagagccaagattgcatcattgcactccagcttgggcaaaaagaatgaaactctgtctcaaaaaaaaaaaaaaaaaaaaaaaagagagtaaataaaattgtaaggtgaatatgttatctacttgatggaattttttaaactaccttgaaaagttttatagtttcctatttacagatgaaattaacatactaattataaatcatgcctcactattcactttaggcagtctatctccttaaggatctccttacggtttagatagataagtgaattgcttaatgtttttggaagtaataaaactgcatttctttttaattaaacaatccagataacaagaagtaattctaataggaaacttgtaggatgtatttacagaaaatctacacaatcttactgaacaatgtagaaaagaagatttaccagcctgggcaacatggcaagctttgtctcttaaaaaacaaaacaaaacaaaatttagccgggagtcgtggcatacaattgtcatgtccacttctcaggaggctgaggtgggaggactacttgagcccaggaggtcaagactacagtgagccacatttgtgccgctgtactccagcctggatgacagagcgagaccctgtttcaaaataaagaaaaagagatttaaatgaagcgaaatgccattttctctaggtgagaaactggaatattatcaatgtcacttcttcccaaattgatttataatttaaaaacaatttyagtacttctgcagcttgtttggagcttgataaaatgattgtagagtttgtcttgaagctttaatagtgaggcaggtttaaaattgggggcaaaaaagaaatgggttttagggtgtagaagggacttgcctgatcacttttgctagaaataaatgtccctccaaattaaattactaatgtcgcacatcagatcgtatttaaatccattagaagattttactgttccattagagctacccatagctggtgaagactctgcttatagtggaacctagtttctcagttttccatttatatttatttacctgagctttttgtaaagtartaagtacttgactgaatttctgctatttatcaaatgctttttgaatagaaataatgagttaataacatttagcctttttyggtaaatagtataaacaagatagggcaaatatgtaaactacttagaactttatctaccttgcatattttgtacctcttatttgcatatgcatgtcacatgctccttatgtaccatgtgctattactgtgccggggtactggggctatattgagtctatttcctgtctttgtagacttgatggataatttggacagcattgtgatattccaggtttaagagtcttaaggttcaagactacattaaatgttaatgtagtccaacatttcttgaactctgaaatcctctgagcatcttttcatgcactggcctaaaatgttttcatagcccagcaaaaggctgattacttatttccctcctattgattttttttgagatggggtcttgctgtgttgccctgtctgcttgtgaactcctgactccggtgatcctcctgccttggtctcctgtttatgttttaaatagcatttctcaaacctatttgagcaaataactttcctgttaatatgtagtattccttgaaagaattgaatttgtgagtccctaatctagacacttttaaagaagaaacaaaactcagtaacacatttggataaaaacctgaatatgtccattttgggatgaaaggaagcagctttgtttaccatgttgaattaagtggaaaacatcttattttaatcatgattgatagaaatctaaatttgtaaattctgatttttatgttttttttacaatgaaaatacattttaaatgtcaccatccccttccccatgaagtcttcattacaactaattttgaaaatactctctcatttatttatattatatatgcatatgttctactgtataattttaaatacttaaatggggttatctttttgcattgttctgtatcttttttcagcttaataatttaccttgcttataattattgtcagtgcttgcggacctgctctttatgcatttttaaccattgcataaagctggaatgatggacatgatttctttaatcactccaaattagtcatttagttgtttccagttttttagtattacaaataactctgcaataaacrtgtcttgggtatgcattcttttagtttaaaatagtcttgttccttcagaaagttgctcaataatagacttagaaattcttttgtgctaattactgtaattgctcattttaagatctccttttattgttttcatagtatataatcctaaactgttacaactgaaatagtccttgagctaagaaagcaatgtggcttaaagataggatttctaaatagagacttaaaaattaacctttttggagctgtgacttcctgatgaagtggcagcacacaggctgaatatgttctacatctggatggcccaacatcatgatgctgtgatttgcgagaagctctctgcctgcctaggctgctggaggatggcaagttaatttatttgttgttgggagacctccccctgcccccattaaaaaaattattttgaaatacttgtagattcacatgcagtttcaagaaataataaagagtaattccatgcaccattttcctccaatagtaacattttgtgaaactagtacagtatcacagctaggatattgacgttaatatagtaaggatatatgtcatcaccacaaaggtacacctacttcccttctatctctcctctctccttcatgcctggttacaaactaacctgttctctctatataaaattttatcatttaataatgttctgtaaatagactcatagtatgtaaccttttggaactgaagtttttccatcagcataattccttatagattcattcaggttgctgtgtttatcaatagtttgtttctttttattgctgaatggtattctgtggtgtaaatgtactrcattccatgagcatggcatgtccctccatttatttagtttttctttgatttacttcattagcattttgtagtttttgtagtcctgtgtatgttttggtagagttacaccctaagtatttaatttctttgctcattgccagtatatagagatacaacttattgaactcactttttagtttatgctagtttattactaattatcaatacatgctcaagatatgtcaactccttttatttttattaggtgtcacttgctacattttgtggagaataccgatgctgttgctagaaagtgctgctgtcacaaagtgggtttatagatagtaccacgctatccttcttcctaggctagattagaagttatttatgtgctatatgcacatagagtttttgattggtctattgcaaatactatggcatctgaaattttttttttttttttttttttttttttgagatggagtctccctctgttgcccaggctagagtgcaatggcgcagtctcagctcactgcagcctctgcctcccgggttcaagcgattctcctgcctcagcctcccaagtagctgggattgcaggcacccgcaaccacacccgggtaatttttgtatttgtagtggagacagagtttcaccgtgttgaccaggctggtttcaaagtgctgggattacaggcgtgagccaccgtgcccggcccctgaatcctatttttaagtataaaaagtcttttttcagctctggattatggtgctgcaagctgatattcttctcatggcagtaaacagagaagtcctaggggtaatcttacccctctggggagtccaggatatctgagcatctcccttttctttttactgctagaaagaatttctgctagtagaatttttattttggccaactctgaccccttaggttgatgtcagaatgaggtgtaccaacctaggtggtcagagttggctcaaaatacgacattttcctgctgagcaatttagtctaggttaagtcatacttgaccatatgccctagtttagcgtccagtttgtgaacattctttacctgagttattgtaattctaatctcttatgtaaaactgcaggtagtcagccctttgtctccttcagttctacatctgcggattccttcaactacagattaagaatatttggggggaaaaacagtaaaaaaaaattacaatacaacaataaagacaacaaatttaaaaactagtataacaactttttatacagcatttgtattgggtattgtaagctagagatggctgaaagtctatgagacgatgtgcatacgttatatgcaagcgctgccattttattgcagagacttgagcatccaaggattttgtatccgtgggagtcctggaaccaatcccccttggatactgagggatgactgtatttacaacatgtctagattttcgacaacttgaattaaaccagaaagaatatgaacacacagaagttcatgtgtatatatatatgtgtatgtgtttagaagggagcaagctgttaaacatgggaaatagttgctagtagtttgtaattttatgattacaattttaaaattcaattttgcaactggaatttgacttgattggttagtgccttacagtaattaacctccaaatcatcagaatgtcatcttgttatttaggtaattgaatctacttttcttgtatacagaatgctttttggaaacaatacactgtatatctagtttgtaccaagaactaattgtacacagtcagatacttgcagttcttttggacttgagtttctttatccttctatcagatgtcacaattccctcttccctttgtagcatatgaaagtagttgtgtgtgcactgtatttgagaatgtcaagtaatagaatctctagaaaacattcatgatttcagtcccaggtaatccagagttaaaaataatgttcataaggaagggtagcaaaatttagattttaatacttataggaggtgtgttaattggccccagggccgcaggctttakcgttcagaggactttagccccaaaggttttgtggaacttttccagagtcctcaccagtacattgggaataaatggaatgcctttggaagtactttgaagattgaattcgatagtgttggtaaagcagtctagcctgctgtgattgtgctattgatgcaaatattctctagcctgtattatttttccttggagctcaggaagtgatccccacccacctcaagcagtaaaggaaagagaggcaggagggtctgaccatgtgaggtgccccaataaagcatctgtattgtaaatcaggaatgtaggtattgggtttccttaaaacaaagcacacctacgtgaccactagctggagcacaatgtgggctcggtctgctgaaagagtcagttggttgcggctgtctaatccaattatggatggtcccagcgctcagcctttcagctgctgcccctcccctgcagactctgcctctctcaccctcccttttagggcttggtctgtggctaccccagaaatcacgtgcactcctaggcttcagcgagtacagccttgttaatctcagacatggaaagcaagttgcctaggtctacagatgagtattcagtttccccaccagttgacctcagtgcaggttttgttggttccagtcatttggggtcagcacctgtttgaagccaggacacttagaacaaggtggaggaaaacctgagggtacatacagtgtggtttccttggctcatctaatgcagagtcagaatgattagccacattgcaaattgtctttactcagtggtttaattgttaaccagggagttaatttttttttttttattaaacaaagaagaaaacacctctagatttttctgggacagatggccccattgaaagaggccatgtgctgcagcgaatggccaggcctcgggtgtggcaagtgccttccagctcagtgcttgctttgtgctcctttgcctatttgaagacgtggatgaatcaaaatctataagcctatttcagtcaagtattctaaggaacctggaaacacaggggatttctctgttgcctctaatacagtgaaaaaccactgtctttttttgttgttgttgttgcattgggggaagaaagtccaggtttgcatgtacattttcactcataggatttttttttagaatagtttggggaggacattgtgctctggccaataactgggccagtgtctggtcacaagatgatcaggcaggtgcctgcatgactgtaggacagagaactgggcagctagagagcctgtgtggaacgtgaagcctttccccactttgttgccgtcctaaccttttctcaagtcatggagaattgatccttagacattccttacctctctcacccacttgaggattgctcagagcctgggtttcggattgaaatagcactatttctggttgatgacgacattctgtgagccagcartgtagtttaaatatccacaagagcgccctggttccatcagcgccccttcgtaattggtcatgagacttggacctccttcggggctgggactcgggcaagggagttgagtagagcttctctttctgggctcctgggaaggattcatggcataaaagtgggacttcagcattctctgggcacacctgtctctgtttttgtcctctcctgaatctttctggcctgcagagcagaataaagtcactctgtgccaacctgacttttgttcatgactatattaggggcatggatagaaagtgcccccatagcactctcagataaaacaccttcaaacaaacccagaaacccatgctcacaaaaccacccaccttaaattatgaaactttcaggctgactaaatcctgaaggcgttggagcgtgagcaaagggaaaatggtgacacagagctttgcccttcctaatccaaatgaaaagctctgtaaccctccccccacctttgctatcaagaaatgttggacctttgggaagcagatgtagagtattgatccttaaaacagagacctctcaccctaggtctcttaaaacagagaccttaaaacagagtattgatccttaaaacagagacctctcaccctaggtctcttaaaacagagacctctcaccactttctaactgaagtgggttccacattggaagtactttgcagaaacttctattaccgcaattacttttgcaccaacaaatagtatcctcaactcagaaggaaagaattggaacactcagctggaggtgtctggtagggacatgtgtctgctttttgaatcagtcgtatatgtttttgttcctgtgcctggaggccctttgtggtgtgagaacattgaatttggagagggaaagggagacaaaagagaaatgggggtgatgcttaagggaaagtagggtttttagtttgttcaccacgcttgatggcagatttgcctctggatcctcaggccacgttcctatggtgggtagggatctctctctctctctctctctctgtstgtgtgtgtgtgtgtgtgtgtgtgtgtgtgtaaatagtgatttctctaagttaataaagaatgtggggtgacctcctacacatgcccgtatgctattgtgtaggaacaaatgcatggtaggaatgggtagactctaatctgaaagcatcaagttgtatgcatcttctgcaattaggaatctgctcaccagcacgagtgctgtggtttctgtagttctgggattcagaggagcattttaaagatgtaggatgttrgaggaggaggtgcagggatctccccttgggtaaagagtgggagacagtctctgagtcataatctgggaccagtggaaggtcaaagggaagaactgtcctgttgtctgctaagtcacaggcttccttcctgttctctgagccctgtcacttacccaaggtgcagcaacaattagtgtctgtttacacataacagacatctctttcataaaataatttttaaggcatttgtttggtagaagcttccctgtttgggggagtcttttccctgaatgcatgtaaataacttcacagtttgcgcaagtttgcaaacggtctatactgctcagccttgattgggctacccaaggatgcgcccgccctgctgaggtctgacagctctgggaggccagtgaggcctgtcctaatccctgttctggccggtgattcagctccaggtggaggctgtgcagaaacagccccggtcatctttgtgtgaaatacatttgtcgtcttcattttcttttttcttctgctggtatcttcatggttttcagcaaaactgtgtacattacatttttttctttaccatttctccgtagttatttctagcatttttttttcagctgatgaaagcaaatgaagaatttktatgctccatagtcagtcaaacattgatttctctgacttttaacttagaaagtcattttgcagtggcttgcgtgtgtgtatttagactgtgcttctacaaaaaagcacacgtaggcttatggctcagtttacttgttccagctcactttcctgttcatttaccttcttgtaaaatggaaagacaaacataccttaaacttaactcagatcgtgattgccaactttgttctctgtgtgtaagtagttatattattcctaggttatggcatcttgatttatctttgaaagaagaaaaccctcactgagttgacagggacacattgttytaggcttctacaattgtgctgatgacgctttttcccattggaatgacagggatgataaggtcggctggctagcctttttttaaaatgtagaaaaccacaactttaatttatagcatcatcattttccttatgtatgtagtatgtttcaaaaataatccaatgtcagattcttgcttctgtgatcaaggtcttgtttttgccctttctttgctcaccacttccctgcccctgacgccgagtcctcgccttagaggaggtggtcagcttatattgcaacattgaaaatgttataccttacaaagaaggtgatatgccatttcttaattataatgatgtgcaacagtgacttctgatgtagacctttaacattgggccacgcagctttttctttggaggaggggcatttcaaattggatgatgctcttatagtttaataaagaaacaagcaaacaaaataggctatacagggcatgtgttcttaaactctgtgacagtggaggtgaacccaggcccctttcatggccttgggagggtcctcagctttgggggcgagttatctgggtggaaaagcaccatgggaggaagaagtcagagaggcgggttgctggagctcagagaataaaagcaagtctctgccctgaaaatggccctgatttgcttcagatgtactctgtctgccaacatttagtgtctgtgacttagccaaaggaaatgtacattaactgttcagtttctatgtagtttgtgctctaggattttgcctccggaggatttctgtgaaggaagctctgttcaagtggctctgttccacttgggtttggaaagaggccgggacaggtgatttcgaaggaaggatgaggacaatggaggagatgggcttggtcattgcagtgtgtgaggtggcccagcttatctggcattttggggtactatatgtgccatatgaggtgggtatgggtgtttgaagggaaagggggtggcctgggcaacttgtgtccttgcctagaaagatcatcactctttttatttaaaagaaacatgtgaaagagccatcagggatagttttgtcctccctcttcttacaagtgatcattcccttggtagggcagtgccagaccctgcttgtgagcacagaaaacgccataagctcctcatgaaagcatgtctggggaagcttatctcaaatgcagtttgcacttgcaaaggtcctgtggtatagcgggggagcaggggagatggagtctgggagcggtgaaggctgggtcactagctggctttgtagcctctgggcgtgttgtttttatcctcagaggggccactgcacctgctccatggtctcttcccacagcagacccttctgtctctgtgcctcgaggggctatgtggaaagcagagaaagactcaaccagagtcttcccttaaggaaatcggaaggaaaacaaaattaacggcattagaactgagtatgtattaaaacttctactgtcttacaaaatttagttttctttcttatttttctttccatgttgactcagtaggtaaatggactaaacacacattcatttagggcaggaagaacttcatcatttgattacctttagttcatttaccttataatgcctaaaacaaagcagaaagtgacgttggttaatcaaaaagatcactttcttttttgtgttcttttgtgctattgtgagatgcctcttctccagcaagctgtagttgttcacaaagtaaagctgttcctaagccttcattagattgaagcttgtcccagactttctttaaagaagtttgcatagcttagttcatgctcagatgattcagtgatgatgatgggttgttggttagaaattacttaaaaatgcctaatacattattgactgataaatgttaagacatattctttaagggtctaaatcctattcttgtggagctgcaaagatcttgggggtgtggttgcccttgtctgttgcatcatctttcaaatgcaacagctgtaatgatattctgtatcttgaaaaacttaaaaaagcaacaactaacttatttgtatcttttcctctaatatttagtttttacttcacttgtaacttattacatgtattaaggagtttatttttwtatgacattttactcataaaaggatgaaaccaagattggtgatctgttcacatagattaaaatcctgtttgtgaccacttaggtgtgtaatgtgtgacttgtggactgtgtcagaggaagattttccaaccaaaagtacccattggtatcacagatgaaaagtccttataccatctgaaaaaaagtagaaggtggggagaagcttgaaaacctaaggaggccattaggaaaggctgtatattttctgattccgtttaaaattttaagttggtgaaaatactatgtgatcgaaggatgaacatattttagtaaatagagttatagtgctacaatgagataaatttcacaggtaaatgtgacgtagctaatgcataatcattctttgtgttgcatggcaattctgtacaaatrgaaggtagcatgtttaacgtycctgttatttcacataaatacagactgagagtttcagtggtctggtttgaaagggaagaaatagaagaaggaaggagagaagttggcagaggagcaatctgctctaatatcctccagtacacaatctagctataggtcctcacctggcagggtttgaggatcagaatggtggctcaggtttagacaattctccctgtttgtggggcccagcagctagttaagagaaaaatcttttttccttccctattaccctataaggtccccaaattcattgtatgtagaatacttgagtcagaataactttcctaacacttaggtttcaggtttgttaggtatgcctgacagctctcttatcaactcccatttatttgctaatctaaatgaaagtttgatggtagagtattgtaaatgtagggaaggtgaagtgttcaccttcagatggtagctatttatctcagcaagaagagcagatgactaacacccaaatacataaccattattatatracttagcatttataaggcatttctatgcatcctgagagactagagcactctcaaatgaggtttcagagtaagattmatctttgcaaatgaagacaaattagcaaaatcttcctatttttaaagtgtgccttttgatttgatacctatttatttgtttggaaagaagcttttaaaatcaaaaccatgaatctgtggttatcttcaaaggataaattatgrtaggtrgttgttacccaggttaccattttaagatgattatggctggcccaaattaggggatcttttcatatatgtattatatattttaacttcagtcttttaaaaatgaatattcctaggtggcatgggagggtgggaaggtcaaaagcccaaacttctcttacttattggctgcttccttgaacttagcgtttttcttttggaaaagtgagcttttgtttttggatattttgtactgatactctgtgcctacacagattttgttttggttcaataagagttgatattttgccaggggttgcctcccatgagattccaaatacagatgtaagtttaacaggcttctgaactggatgtttctatgcgctgaaactctgtaaacgcgtgtagctttgtctaccattgtatattgctgtattgatttgttgggttgttttttttcttcctcctgaaaagctctggtctgtcctctgctgatacaaagactggtccattccccagggtcactgcaagagaacctccagggcctggccactgttagatattactaatctgtgaagttgctccaaattctcttgccccgatcataaagttccattgagttcaattttatgtgaaggttctttgtcaaaaggaataaatgtttattcaacagatccagttgttgtcagcattgacagatgtgaaaattagcaaatagcaagaagtctcccctttagaaaaggaaaacaagtacttaaaaaaaatcttgtgttgtcaataaacaagtccattttaaaagcatctttgaaggtgtgtaatgaaaatggaggccttaggttgtatcagggtttatgaggagccagcttatmtgtaatcagatgttcctgttactgttatcactgtagtatagggcttagttctgccctttaagtcacagactcaagttactcctgattttaccagcagtcagaatacatttttctttaaaaggaaaagagacgatatccyagtgcttctctatactaaaacaggaagagaagcttccttgttgaagtgacagtttagatgttgttattttgacagaaatattagtaaatatgtcacattatcccttgctaaatatttatagcatagaacgtatactctgatgcataatattttatgaaagaaatatcttttgcctcaaatccctttcactgttttgacatgaatctataatttatacccagaggtctgcaggaaaaagactttattaagacccttttatttcagccaagataaaactccatcctaagagggaacaccctggaatctttgagacccttaaaggtggggtattctgaaatacctgtgttcgttcctttgctagaatttagatagcttcacttttgcaaaaaggcacaaaatgagggcaatttttgatggaaaattttagtttttgagatgaagcagggggcacagtggcgaagcgccctatcttagcacttaggtagcagccgtaacaagtgtcctgggtattcctccctagaaaggaaatgttggtcacaaatggcagtgtcctctgcattcagttcagctatgtgactgaaagacactgttcttcagcagctgtgagtttacaagatgtcgcacattgagtatttttctctagcttatttagaaacgccagtctagacttccgcagttttggattcgtggscatagttttggcctttattagatggccctcaaaggtacttttcaggtggacattgatttcatgccagctgtcagagatgattttccctagaaatggctgggtatatggagacattctgtattagaatggaggtatacacccatctcttctgtattagagagcaggtgttgccccccgtggtgctcagattgctkagtgtgagaaggaaaagaccagtgataagaggaggaaaactgcgccttccatgtagctcagttaacagcatcatgattctccaggatggccccatttctgtttttatttacaaaatggacttgagaattaattagtaagcaaactgtctccattaggtaagtggcattctgatttgtctgtgtaaagttccatttcccaagtaatgtgttccaaagcatttttatgtacaactactggaaactgctgtacaaatgtttgctgctatttggttgtaacaaaatcagtaatgagtttcaaaatggaataatttcagagcccttcatctacagtagtttgggaaacacttgaaataccaagtgatctgaattcactacaagctctccaactggaaaatgtgcctggtgtcgtcttcaagcaagaatcccccgccccttaaccactgctgctgtggacttgagtcttcaaccttgttttgtagactttagcatttgtattgtgtcatccttgacacctccccaaccccagccttcccagctttgattgcttaccttagcaatgctctcagcttggaccagaaggcacggatgtttccctgaccttaacctcactgtgtatcagctcaaggaagaagccagatttgctgatgttgtaagcactaaattatgttcataacatttaaccctcacatccataagcaaactaagtgggaaaataaagattgactattgtagcagtcatagattgtttaggaagcagcaaaaaggcaaatttttctttaaagttcaaaatggggcgaaagagggtaggaaaggaaaagtttattaagaaaattgtatactacattaatttgactttgccgtctagacttaaattaaattcatgtatttttttggtcttaacacattgacatgtatcagtaagttaaaaacttaaaaatacacaaatgattagattagcattattatgtgtttctttcttgttttttgttttgttttgttttgttttgttttgagatggagtctcactctgttgcccaggctggagtgcagtggcatgatctcggctcactgcaagctccgcctcctgggttcatgccattctcctgcctcagcctcccgagcagctgggactgcaggcacccgcaaccacccctggctaattttttttgtatttttagtagagacagggtttcactgtgttagccaggatggtcttgatctcctgacctcgtgatccacctgtctcggcctcccaacgtgctgggattacagtcatgagccactgcgcctattatgtgtttcttatagaaaatctctctaattttttaataagcatgtttttacaaatgctgtttcctgagaactgtcgcaccacatgcgacatgccatgcatgcgactggaacatgccagatatttgtgggtggtcccttcgtgtcacctgtgccttcttaccaagtaatttgaaacacccgtgtaaactacctttggcaaataggatagctaaatcaccgctaagatttataatttactttttggatatctgaaacatcaacartayagccatccatggcgtgttcctctggagtgtggtccgtgccrtctctgcctgctccatctggctgatcccaggcaggcagctcagctctcagcagacacagatccccagcacatatgaacgtgaaagaggcttctccrtgggagcgaagtggccagcaggtgtcacaggctgtgtgggcccagcatcgtgtgggcactgctgggggaatcccatcacagcatgtgctggcgttagtagtagactgtgtgtgtctcagagggtccagaaagtaatacagtaaaggcgcctgggggtgtgtgggggtggttggttggggtttgcttgttagtttgttgtaaaagcccagcttttcattcttggaaagatttcagccaactcgagagggtkacctgccaggaatgctgcagaagcaagaactcagtgggtgagcacttccatttcttcaacaaatgcttctgagtccctgacctgtgccaggtgctcttcttgagctgagaatcctgcagggaraaaagagataaagaccccatagtcctgtggtttaccttctaatgagcatacttttgtcgatcaaacagggtgacctctctggtgtctctgcacactacctgtatggtctttscgtagctgatggggtctcctgactagtgattggtgattttaatctggattttgccacagcacttattttctaacatatgacttaatttacttaataattgtgtctattgaatgtattcttatacatacacacaggcatgcacacacggacacgaatataagctttacaaggacagaaaccttatyttttatttatttcttccttgtgtatcctgagcactgagaacagcctggcacaaagcagggctcaggaaatgtttgctgaatgcatgttcacactggatgtgttcgaaggctctcactcgcgactcctgttggcttgtggagagtgcatctagctgtaaaagccatggtgcttggatgtcttggggtgctgagcctgttcccccctcatttgggggtgtggtgctatgctggcgtttgggtccatgccccgcatttctgatggctgccccatctgcyctgtgtggggtggcagagttctgtgtacacagagttacatttcgttgttcctggcttctctatggatgacagcagcactgataaatgccacacctgctttctcagcagtcttgcggggtgatttttcctcttaaggaagtcacctgatgtccatgctgagtaggaaatgcatccaaagctttgggagctcagtgttggcccctgggctgcagcccgagccccgttttagagctgtgtctcccaggcagctgtgatgactgctcgaaagcccactcagggggaaggtaaacctgatgcccgggtgtttggacagtgagcatggcgagtggaccgttacctgtgcatagagttgttcatatgtggtgacagatgttgggctgttatttagtaacttcaaattgtttttctttgcgtcggagccatgtctaggttctgagtgcttctcccaggtcagatggagagctcttcatttggggttgggggagcggggtggtgttttcaggtgcccaaggcattccatgcacatgcacctgcagggtatgtgtcatctggggtaagacagagccctcccggttcctcttctggatgtgtgcttttagtttttaaagaatgtcagtatatacattgccatttattcaacaaatacggactgagcattctgttgtgctgacgtagctacttggggttacagagacaaagccaactccattctccaaatggaaaacaaatggaaacattctagtggtagaaacagacaacaaacaagtagacagaaaataatgtcagacagtggtaagtgctatgaaaaaaatacagactcactgattgtgatggagacttttaagttggattctcatagaaggcctttctgaagaggggacatttgccctgccactgtgaatcagccatgagaagacgtggagaggaacatgaggtggtaggccccagcgagggaaagatctccatgatggcatcgattattcgctccacaaatattattgagcacctgctgtgtgccaggcactgttcctggtgtcagggttatagaagtggacaaaatgaggcctctgcctctgtggagcttttattaaagtagggaaggggatgggagggctgggtcacatgttaggtgtggggtacagggtacgtggtgccaggcaggtatccgggtacctttttacgtagggtattcagagaaggtctctagagaggtgacatttggacgaagacctaaaggaaagggargggaaaggcgaggagcttggagagcttggtgcatcttggtgggggatggggtaaactgagtcagttatgtagggccctggaggccacggtgaggacttcggctttgactctgaaaggagatggcagagtttggagctggtgtgtacgttaacaggaccatgctggcagctgcgttaagagagactgtaagggcaaggacagaagtagagagaccagtaggagtaggctgttgccccagtgtagggcagagaagatgaaccttagaccaggatggtggagatggtcagtggagagaagtagtcagagtctggaagcaccagcaagactgtctggtgcacacaggatgcacgtgggatgtccagtgaggaggatgagatgaggttgggtggctggagcctggtgagtgacaggcagagagggctattagatcacatkggccctggagccatggtgaagaatttggattttgttctctgtgttggaaagttagcagagagcttatatggggggtgagatggcatagggacaatgttaataacagcaacgaatatttattgagcacttactgtgtaccagctgttgcaacagcctctcaagggttcgttctgctattagagccatgttataaatgaagaaactgaggcacagagaggttagctaacttgtccaagatcacacagttagggacaaacttgacagaattatgtgtgtcctggtatgtatttcagttttctttagggaaggtaccacaactttgggtaactatgcccctaccccaggatttaagatgttttgatggttgaagggcgatgtttaagagtgggaccagagaatattgaggtattaaaatctcactaaatctgtattcattatatctgtattcatggtataattcatgtgcctccccctttcgtgagcccctcaaacatgatcatggatatgttttctccacccgtaaagtacgttcatattcatagaaaacccacagagaactgcagacctgaaggtttctttgtaagagctttcattggatagctagaagggctgcagtaagtttaaaaaaaaaaaacccaaaccaccctggattccaggctgcacagcctctaggaggtgtgggtaatccctttataaagcttggcataatttctgttaagacttgcttattttgctctcagcttgctatcttgatatgtttgcctttgaggaggttagagttattgtgatttaatcacagaccatgtatttcgcaagattcatttggtatctccagcttgttttcttgtttcctcggctgtcagtccacaggcagaggtgggaggcggccggcatgggggaccgagtgtggtagaaaggagtgtttacttagcggaggggagtgctgagggctgctgttaccttcccagaatggctgatccccagcagtgatgagcaggctgggatcgtggtgttaaatttggtattttctagaaatatatagcaggctttcccctccacctgccccccttcaaggtttcgaagccttgtgttttgcaagagttgagaggggaacagttaatagcttggattatcttgtctctggagagaatttatgtatcaattcaccggaagactgctctggtattagggcaacaagaatggttttatttctcccttcctttcctgcactctgttcttatgtaattcttgtattaaaaccattcctggtaaattagaacatgctcttgtatttgggccctgctttgaagaaggctgctgagtctaaaaagtttggtagcctctcgtttctcatggtgatttctgagatttctagggacttggtgttttacagagcttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagatttctagcaggctgcataaagtctgtagatggtaatatccatttaaaagtggacaatgaaaaaattacctctttgggagttgtgttgctatctctaccccaatttggcaatctttaattaacttggcaacccccgttttaccaacaaagaacaacctttgattaaaaaaaaataaaatgtcagggagtgaaagatacggagtgtgactcagcagatgggaattcctttaataacacgctgggtgttagcgttagaaccgccactgaacagctctgcaggatgccctcccagccctccctccrcctatttggattagaccaggagactgcagcaaacttctcaaggggaggcgaacttggtgttggtatctgagcgattgtctgtttcaattgtttccctctgtcttggaaaacaccggcacaaaacacaaatccagtcccagttcctgcagctgctggggcgaagcaggctttttatgaatgaggcccagaagggggaggagagggcttgtgttacagcagcagttgggtaatacatttcattcacttgcagccatctagcccaggcttcattttaaaggatattgttcatttttggcaattcagattagactttttttcttccttgtgcaactgttggtaagttagaacacgaagcatgtgtgtgcattctttttgcttgcttttttgagtgtttgctcctttagttgggataaatggtaggagaggtaggaaggctttgtcatccccggggaccttgcttacttctccctcccagcaccacttaagagaagaggaggtggcctccctctccccaacctcagagccctcaaagcccttgatagtgagcctgagcacttgttaggaggtgacttctacctggggtgtgctggggtccacatgtgccagtctctctgccctgctccccgtgagcggctctttatttgtggcccttgaggccccattgttgtggccaccaaaacctgaattggaagctgtgtgacaatgctggtccccctccctgcactgcttcctgctgggggcagaacaaagagagcgggcattgtctctggcataaatgaacctctatcaaaacaaacacccagagagaggggcagcctgrttacagctgcctgtgtgagcctcgacagtgggcctcattcctcacaaagggagctttgaggcccggaagaggcctttccttgatgatcgagctgtgcacagggagcaaaccccaagccgactgcttgtctgtgccaccctcaaacaatgatttccccaaattggacagcctgggtttgtatccttgagcacrgttttgggaagagcattctgcatgaggcattgtagctatgtrtatggagtataattctgttttcaggttgctctgccacagaggttaagaactccctcttccaaggtagacattgagaacagagacgaccacactgggttttcactgcagcttttaaacaggatgactcccagcccccatccccgtggctagcagcaagcagggactctgaaacactgcaagccaatggactgagcatcttacttttgctgtccgtgttttggtgttttgtaaacccatctggtaatgaccctgatgccccatgtcccagcaagggcataggtacctgccattgtgcaccaaagtccctttcctcatggccctggctgttctcctgcatggggtcatgtgtgtcccgttaccaagttrtggccccttttcaaccttgagtgccacatctgggctgttgtaggcatgggtagtacaagctgggtttgttactctaaaaatgaaagggaggatcagttgttaataccttcctgtaggtgcgagagggaatgagttgaggattcgatcactgtttatagccagtctcggatcctgattgtgaagtcattctttctggataataactactatatccagcatcttgagagtataaaataaaggcacatgttgtacgtcatctctgagatgtagcgatggcttggactttggaggctgatgagagaaaactcatggtggtgagctggagcagggtgtggctggcggattctgaaggtgctagccctagttttacagctgaccagggaaggtcattgaaccctacagtcttggccctgagagaaccttggaggacttaaggatggagaaaggtgacaaaagagatgcaagccaacagcaattttgtggaacaaagtgtgtacaggatttgaacttaactctgcgaaagacaggggttgcttgtatgcacgaattcacatctgaagaatgcatctgattgtggctgcaatttctgtggacgtgcaaacatctacctgtgcattttatttgtctagcatcattgaaagagttttttgcttgagttgatttcccaggtaattgaagcttacttctcaaagcacaagatattttttctcatatattarcggtcttaagtgagtgagacccctaagaattcttaattcctttatcttacttttcctacaggaaacttattatgttttcctagataggaattgtgctaccaaaaatgaaaagtaaacgtaatatgtaatgttctactggtaattgtttccattttaggttgacaccgaactaatgatatttaaattgtagctgacttgaaacacagtgaaaaaatggtttcctgctgtttttttaaagctggattcagtaacatgaaggtaattaaaaatgtacagatctcagtaatagacagtcatatgttgcttaatgacagggatatgttctgagaaatgcattgttaggtaattggattttatcattatgccagcatcatacagcgtactttcacaaacttagttgatacagcctactacacacctagggtccatggtatagcctgttgctcgtaggctgcaaacccgtggagcatgttgctgttctgaacgctgtaggcaatggtaacacagtggtaagtatttctgaatctaagcatagataaggtgcagtaaaaaatatagtgtaaaagataaaaaaatggtacacctgtatagggcacttactaggagtcaggcttgcaggaccagaagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactgcagcctcgaccgccaaggctcaagcgatcctcttacctcagcctcctgagtagccgggactagacgcacacaccaccatgcctgactaatttttgtgtttgtagtagggatgaggtttcaccatgttgcccaggctgatctcaaactcctgaccttaagtgatccacccgcctcggcctcccaaagcactgggattacaggcatgagccacggcgcctggccacagttaacttttttaataagtagaaggtgtacactcttaaataactataaaaagtatagtaaatacataaaccaataacatagtcacttattatcattatcacatattatgtactgtgcactgttgtacgtgctgtacttttatacagctggcagcacgggtttgtttgcaccagcatccccacaaacatatgaggaacatgtacatcttaccacggttgcaatgtcactaggcaataggaattttctagctatattctatccttacaggaccactatcgtatatgcacttcatctttgaaacgctgttagctgcctcatgactgtatttctattcctcagtcatgggctcaccatgcagtacacatgtgtggtcactggagggaatggaagaacactgaggaaatgcatagcctgtttcatatatttattacactattatttatttagaggaatgttaagaaatcttgcttttatgtagttttagaatgccatgaaatatctagttggggcattatctgccattttgcaaggtaatcttccacttctgaataacgttacaagtaacccgcgtttggaggactgatttgggactaaggcaaggaatttaggaggcacaagtagaggggaagaaataaacacatgacttttgtttttgtttttgtttttgttttttgaaagaaggacagtggtttgcttgttgattctgctttgagaggatggggatgcactccagagaaagtgaaacggggctatgggaggaagagagcagcgcacacacagcacctgcatttgattgtgaatgcgattgtgactccttaggcaggaaggagagtgctaagaccgtcatcatggacactcagaaaatacctgctaatccgtttactggaagatacagggagctgcagataattattgttttttaagatggagtttcgctggagtgcaattgtgcaatctcggctcactgcaacctccacatccccagttcaagcaattctgcctcagcctcccgagtagctggaactgcaggcgtgcaccaccacgcctggctaattttttgaatttttagtagagacagggtttcaccatgttggccaggctggtcttgaactcctgacctcaggtgatcctcctgccttggcctcccaaagtgctgggattacaggcatgagccgccactcccggccgctgcagagaatttttaaaataaatgatagattctcacagataagaagwacaggataattatttgccaaagtttgaaactgccattatattcaaaggcattctcttttgggagtggttttatatttaaggtttgaatttagatgacctcaatcttgaggtgttatcggagcattacaggggagtcttatatacatgcaggtgcgatttaatttgaagatacttccatttaaactttatgctgccagagttggccagctaagcaaaaagaattctgataggtcttattctcctccccatcccacacgctgattttttttttctttgtgtttggccgaaacattttacatttctcatttttcacagagctactgtttctctaggattgttttccctgaagtgtgtaccctgtgtttgggcagagcagcaagaccagacttccaaatggcatgctgcgttttaatgtgctttcataattgtctgttccaaaagggtgcctgtgtgtgtatggtgtgtgtgtgtgtgtgtgattcagagcacctgagagcacactgcccgttgtcccctccagcccttctgaaatgcaggccaccctttctgtttcagttgccccttgggtggcagtctgtgataactcaaggtcaggaggaagtatttgttttggttgtcttgtttaactaattaaatctttaatcttggtccttaaaagaaactaaaataaaatcgtaaagtagttctgataagtccttgccataaattattgcttttgtaaacgcacataaaggactctgaactgttgctactcataacatttctgacgccaaatgtgtggggttttgccataccaacaaccagttctctaactctccagacaccaactgggggccttacaattcagtgcagttctgacactcaccacctggagttagcacagactccacagggatgagggttcagtcccacgagtctgcccttgctgcagatgcgagtagcaggtatggggtgcccacacttctgtctgacttgcctgaaaggttgagagtttgttgccaggccccttgctttcaggtctgataacttgctaggttattaaacctgaaacttgataacttctgtagatgttgaaattagaacggcctcactcacctgggctcacaaaattccagaaagtagttgacgtcctattactggtttaccgtgaaggctctatgtccagagtggacaggacaagtggaagagtggcacagggcgaggtgtggggggtggcgtggagctccttttcaggagtctctaagaaggtgggactccagcggcaatgccttgtccatgtgctaagccagccgagggcgcacgaagtgctgtgtggtgtccaagctgacttgggagggacmagtttggggccagccccccagcctcmcttgtcatgtcccacctctgctggcatctgtgggcttaaagtgccttcactcccatccttttcaactatttcttgattaaaaaaaaaaaacaaaaaactgttgaatagtaggagactctctctctcattggtatttgtgggaataaatattaaataaacactttctaataggtgttaccaggacgcctaaggaaattatctcacagagttttcaacactgtgaaaagagaagctgactgccagggagagatccctttttcctagtccttgtgaacatgtgctggacagccaggagtggcactgtggcaagaaacacccgttctctggcattagtaagagggatatagccaagggtatctgtataccagtgttaggcccatacatccataaaacattgatgtgagagctttagggcacagctgaccctaagcctaacgtgatcattaatgtcatgaaaattggagaattggtcaggcgcggtggctcacacctgtaatcccagcacgttgggaggccgaggtggatagatcacttgaggtcaggagttcaagaccaacctgggcaacatggtgaaaccccgtctcaaaagaaaaaaaagaaaagaaaattggagaatttataacgtctgatgtgacctgttctttaggtgttgaaattagaacggcctcactcacctgggacattcttcagctcaygccctgtacctggcttacagttgctcagtgaaatgctttcttgattgtagcatggtgggatttttataaatccaaatgacttagaggtaggtgtcacatttttagcagctaaaatcatactaatcgtaaagctcagattcctgtaagtagggcgctgagcacaggctgcatcctggatatatgaatagatgaaccagatcgtgtacatgtgggacacgttctttgtcctttgggactttcttttgcttggatgttggtagtaaccatgtaagttcgggcagctttctagaaactttccttgttgtgcaacattatgcaataaatgcactgctttgtgatatctgagacgttttggttttcttcagcttgtttgagttaaatttagactcctggcatagttttaggtttgaatgcattctctgagataggataaggaccaaaacatccactcagcagccagatgggattttatccttgtgctgccatttttgagactcatgcctctgtttcactctctgtaagatggcattaatagtgagggattgttgtgctgtgaggtttaaatgagctaatccctgtgaggagtttacagcagggcctgggccatagtgaaacactgtgtatgtggaagccacttcacttttgtcatagctttgttgtcattagtgtataccctgtctccttgccgtttatgggtccttctttcaagcagtcggattttctgtctgacatagtataagtttagaggaaacaatagcagctgtaagataatagtaattttccttctgaaatcattttggtgaatttagtcagaatatctgatccataaactctcattataaaacattgccttatgattggagttttttctgagaacagttccaatgaacatgattttttggtggtgaggtactatttctgtgcagtaatgaagttgtgaggacacacagataccacatccatgttgtttgggaattgtttgggaaaggtacgtgggatagcctggcatggggaagaatgatgttagggtattctccttgaggagctcagaataaccaaaggtaaagcatttggtggtataagatatattcatcttaaaaataagttgaaaataataagataytgggagatgttagccaccgaagtaaataactacagtgaaatagctctttattaattttgaaacctaaagttgaaagagttccgtattatttgtcagtatctttatcctcttcaaaaatgtttccagctttgggataaattgtgaataattgtttcactttgttttttaatattggctatgtagtgattttgcattgaactgtgatataagaatgatcatcagccccttgagattactgtgtgtacctgtgtcaccagtggcatataggggcttaaaagcaagcaagtttaatatatacattcattgagaacacactgtagactgttaggattttcggtgctggagccatagtgatgaatatgacaaggccctcacccttgaggtgcctatagtcgtgtggaacctaggtcctcgcagggactctagggcaggtatgttcttgaaagatttttttttttttttttctttttgaagagacagggtcttgccttattgcctacactggagtgcagtggtgcggtcatagcccactgcaagctcaaagtcctgggctcaagaaatcgtcctgtctcagcctcccgagtagctaggactacaggtgtgcaccaccatgtctggctaatttttatttgtattttatttttatagagacagagtcttactctattgcccaggctgatcttgaactcctatctcaagtgatcctcctgcctcagcctcccaaagtgctgggattacaggcatgagccactgtgccctatgtaaaagattcttatcaacagttaaaataagaagctgctcaagacatttacctatcctgaatgtttcaggccctcaaggtgccaggtagctgcaatatagttctagtgtagaaaagaaaaccctgaygaggtctatatattccaggactctgtctgaggccctttgacactccgggggcaccctgccgtgaccctgactctttcctgcatgtactgaggatggaggtagcctatgggtggcacagagatttgctgtctggctagcagtacttcagggtactgggtggcttgaggacctcctgttagaagcttggattcacttttcccaaggcaaccasgattggattctattagttctgggtcttgagagcctgcaagggcttccttctgcgaaggtgagtctgggagagacgccatggagtcagtgtgagttctgcagcctcccaagttccgctggcgtgagaggcttgcctggtgccagggctctggrcattgggaacattgcctggtctaccgggcaagaaacgtgaaccaccgcagtgaactggcagcgcgttggcatttttccctccatgtttttataaaaccgctgagtagacaccagattataaatcctgtgtaaatagtcttgaagagtttctgggttcagccccagagaagactggtttgggttttgaggaatacttcaagaaaatgtttgttggttctgttttccaacgtaaagtgctgcacaaggactgtgctgtgagatccaggagtgtcttttcagccctcagtgagtgcctgcaggggacacagctgctttggaggaatgtggttccggagggtttcccactctccatcctagttgctaaagtcacgttccacgtattgtgttctgatgatagaatgaaagcccactccccgcaccctggggtctaggtggggaaaggagaggtgtatatgggatagccacggggtttggcatgagctcagtagagacagcaaactgacccagacagactcccgctttagggaagctgggatgaactaagtgaaggtgggtcatgggagcaatgctgaaccactttggtggttacagtgaaggctgctacacacccagctttgggaggtggggcccagggtgtccagctttgtagaaaggcatggtgtgggggtggctggcggagggggtggtgggtggttttcctcttgaatctctgagaamcttgactggtgtactgctctctgctttcctaaggggtccgtagctgtgctggtggtttgcttggtatctgtattacatccactctgtgcttcagcctgtttgtccagttactgtgtctagtgaagctagcattcacatattttagattaaattccacactccacccccaaattaaaaccctgctatttaaggtaaaaataattttaaaatgttttattttggtctctttggataaattaatcttgaggaaagcaatacttactgaatgttgatgtgtgtatatgtctttctctttgtaccatacttaacaggcaagtaactctcttgtaaaatcagattctaaatgattttcttttcttttcttttttttttttttttgagacggagtctctgtagcccaggctggagtgcggtggcgcgatctctgctcactgcaggctccgcctcccggcttcacgccattcttctgcctcaacctcccaagtagctgggactacaggcgcccgccaccacgcccggcttatttttcgtatttttagtagagacggggtttcaccgtgttagccaggatggtcttgatctcctgacctcgtgatccgcccgcctcggcctcccaaagggctgggattacaggcgtgagccaccacgcccagcctctaaatgattttcttaagtgtaattcaggagttggcaaactacagcccatgctgccacatctggcctgccacacctgttgttgcacataaagtttcattgagtcacagtcatactcatttgctttcatattgtctgtagacaacctagaatgttagaaaattctttctctggctggacgcggtggctcacgcctgtaatcccagcactttgagaggctgaggcggccggatcacctgaggtcaggagttcgaaaccagcctgaccaacatggagaaaccccatctctactaaaaatacaaaaattaaccagatgtggtggcacatgcctataataccagctactcgagaggctgaggcaggagaatcacttgaacccaggagttggaggttgcggtgagccatggctcatgcatgtaatccttgcactttgggaggctgagacgggcagatcacaaggtcaggagatcgagaccatcctggctaacacggtgaaaccccgtctccactaaaaatacaaaaaaaaaaaaaaaattagccaggcgtggttgcgggcgcctgtagtcccagctgctcgggaggctgaggcaggagaatggcttgaacccaggaggcagagcttgcagtgagccgagatcacgccactgcactccagcctgggtgacagascgaaactccatctcaaaaaaaaaaaaaaagttatttctctatgtaaacaaagaaaactctccttccttataacttgtatgtgttgggtctatttgtattctgtgaaccataagaaataagtcaactatcagctgggcgtggtggctgacgcctgtaatcccagcactttgggaggccgaggcgggcggatcacgaggtcaggagatccagaccatcctggctaacacggtgaaaccccgtgtccactaaaaatacagaaaattctctgggcgtgttggcgggcgcctgtagtcccagctactccggaggctgaggcaggagaatggcatgagcccgggaggcggagcttgcagtgagagatcgcgccactgcagtccagcctgggtgacagagccagactctgtctcaaaaaaaataagtcaactatctcaaggtaattacccttttgaatacttgaggacatcttttctgtgccctctgaatatttccttccccagataaaatatttctagttcttttacytgttctttgtttcagrgttttaagtctccatttgataaagtatagtttaatagccttcgaaaccacatcgttgagatttaaaaagccctccttgagagacatgaccagtagaaatcataccaggaccgtttagcaccctaactctgggagccatggctcttgggatgcggctgaagattgtgttatcgtcctgaagctctcttggacagctgagtcaatgactggaggtaggaaagttccttgaactctttcttgtgcccttccagctgtgagctgtgtcaccattgtattatttttacattgttgttgttcttgaaaaagcttttttttttttttcaaggcagagtcttactctgtcgcccaggctagagtacaatggtgcgatctcagttcactgcaatctccgcctcctggtttcaagcatttgtcctgtctcagcctccccagtagctgggattacagacgcctgccaccatgcccggctaatttttttaatttttagtagagatggggttttgccatattggccaggctggtctcaaactgctgacctcaggtgatcctcccacctcagcctcccaaagtgctgggattacaggcgtgaaccaccgkgcccggccaaaaaagcttttgaaaacttcgtcgtataatattatggccatccttccaaacgtgacctttttatgttgtattttatctaactaatttgcccttgcccccaacttttatcttggaatttcttacgtattaatatactgtcagggtccctgcttggggcattgtccttgggcttgtcattagataactccaagttggcttgactccagaggagctgccttcacacgtgctgtgaaatgtactgttgttgaccagagaccatcgttatcattaagtccacaaacctgcttcctgtctcttaggctgttccagtcttctatcgaaaaacagtggtttaagtggcttctccgatagtgctggtgaattggaagcttctcgtcatcccccttggctggggcgaggcttacttcctggggccttggcagttttgatctaaytgacttatgttacctttctgtattaatcaagcctttttattttccatacttctgatgctttgacatcttggggccttgctgaccctgaagagaccagcccccctagggttagccagttcctaggtagtgaatgagtacaatgctcatatgcaaaataaccaatccaaaggccacgcccctcactcatatgcaaaataaccaatccaaaggccaggccycttaccacctttattgggatttcatactccaggccaatattgccctaccttaatcaccctagggccagataccaggcaagagacagcccctacaccccagagcctgtcagaattactccagccagctagtcctaaacctgcttaccttgtgtgatttattccttcccaaggaaaccacaataaaggctctcctccatgttttcctaccattccctctgcctcaggaccaaccttggttcttctccgtgtggccccttggcatggtgcactacctcttcttggggactgtgagtaacagactttttcagtggcaattgtcttttaactgttggcctcaccgtacctgaatagcagtaaaccctacatcttaaaatactttgagattgtcacatacagtacccagaataggtgaggatgaaggcaatttactggatgcagagcggccccagtccattccttatgtccgaatgctaagacttgagaaaggtggagaggagcctgactatcaagagttgccttcttggatgaagtgggctgaagacacacgaaccccttccattaatacatctacatattttccaccattgtaattgtattaataattggagaaaataacaatgactgtcaacaacaatagcttaatccagtagagatgaggtccggaataggttctggcctacctcagttcatgttttttactttcaatgctgaagcacaagcaaatgcaaaagcttctcttgaatgttttgtaaattgtgggataattgaggtatgtgacatggttaataacccagtgtctgctcattgagcactgggttattaaccatacatagcaaatggagcacatcatcgtgggttgcttgcgtcactagatcctgttgcaaaaccaagattcaactttaaaatacattttaatttaagttactctttctggcatgaatgatacatcactttggagcaacacttaccaggcagtgaaagctttttttaatgccctgtgtagcactgctttcggtgcccttatatgatttggatggatggatggatggatggatatagccacagggtcttgctctgttgcccaggctggagtgcagtggcaccatcatagctcactgcaacctcaaactcctgggcttaagcgatcctcaacctcctgagtagctgggactactacaggtatgtgccactatgcccagctaatttttaaattttttgtagagatgggggtctcaccgtgttgccggggttagtctcagacttctggcctcaagtgatcctcccaccttggccttccaaagtgctgggattacacgtgtgagccactgtgcccagcctgtttatatggttttaaaaacaaaaatgtatatgctctcaagatggctttcagagagcttattagtgtcttggccatttggaattccatttcacttaaattagaagagtgaaagagaaatgaatggaagaccaaaaatggggagaagaaaytgtatctgatataagcgtggctctacctgggagaatggccattccgaattactggaaacaggaagaagacttgctatgatgcttccttatatctgtgggggaaaatcaaacttacattctgaaaggaaacttaatacttcatgtttttaaacacaaaaggatattttttcagagtagcagttataaagttgttagtttaatcttttagttcagctttttttcttaccagaaaaataattagtagtacaaaaatttatgcgtttgttttagctctattctgatactgttaagaagatacatgacataaaaacaggaatattttcagtcagtgattacaatttaaaatcatattcgaaatttaataaaaagtttaaaagaaatcaccagcataagatgttgtcatttggctcttggggcaaaccagctctcttctggtgaaagaactttctggatgaggtcgaaaggcaacagaaaacctggggaacaatggctgtctttttaatgggagttgctcctattcctggtggtaacaacctcttcctgttgctcctttccgaatggaattgcctcagtgaagttgttgaagaagtgaggagggcgaaatatgcccatccttctacagtggggagaggcctggcgcatgaaagcaggcctttgtgtatgccgggctgggcccatgcaaacagggcacaatcaggctattgtttgtttgggaaaagctatggcatcctattgcaattatttatggaagaaaatatttgatgtttttggaagaggttaggtgtggggggtgatgagggagggaggaaagagactgggcttacctcttgtcccattcactccaaatctctcagtgcgtaggatagggtccatctggtccaaaggagagttttgtgtgactctgtgtgttggagtgttttcgaaatgcagagaaattcagagcttctctagctttggctagagaaggaacaatggaagtgagtcttattctacctaagtttgatgtggggcagcctgttctgtagttgccttccaagcccttcttctttctgatgctttcttggtaccattgcccacatgctgcctccaccctggatgaggtctagacctgttacattgattctcaactaattaaaagtcaatatggtaaaatatttgcagcattccttctccttccctgtgttcatttctgaagctcaacagtcttccatactcaagctgtggggaggtccctttctcctttgacaccagccattttgtgatctgccctttcaggccaccccagccaccctactttcccagtcttgcctctgcctacttcacctcttctctcgaacctcagaagcttctggagtcttcacagtggccctaatcatgggtctcatccttgttttcctgtctctttgaggttccagcagccagctttgcctcatcaggcctttctctgaaattcccatcaataactacaagatctgcccagtaccttgtgcatatcaggtctcaggaaattgtgagtttcttgtttcattaarcatttttctttccaggaatcatcattcatcgcattgccatatgtgtccagatcccccttttcagggagccagtaattcgaaagcacttgcctgtgttgaatatggtggaaaaaacaaatgtcaaccctagccggccatcactccccatcggcccaccccattctcttgtgccagtaggacttgcctgtgttttctttgggcagttcaaagttgggctcttgagaagttgcctgtaaattcaattgaagtgaccagatctcatccttacccactctgtagctgcagataataaacactggggacttcccttgtgcctgtgttttaatgtaaccttaagacttgatgctccctggagtgtaagaatatgaatagctactcgctgtggatattgcagttaattactccttcctgtcccatgtggtccccagaggaatatgagattgccacaaacatggcagctttctttggggaggtgggagagggagatgaatcttggggcaaggcacattctcataaccatgtggctccagaaagctgcctgactcagagaatggctataaatgcccggttgtatggatctgagatcctcaaagccaggttcattcacttatttattaatttaacaaacattaggcagctgtggtgctctgtctgctccagcagtgatcaagacagaaaagatttcttcaatgctgcgtgtggtggctcacacctgtaatcccagcactttgggaggccaagacaggcggatcacctgaggtcaggagttcaagaacagcctggccaacatggtgaaaccccgtctctactaaaaatacaaaattagctgggtgtggtggcccatgcttgtaatcccagctactcgggagtctgaagcaggagaatggcttgaacccgggaggcagaggttgcagtgagtggagatcatgccactgcactccagactgggcagcagagcgagaatctgtctcaaaaataataataataataataataataataataataatagtaagaatactggggtggggatggtaggatgcacagtaaagagaataataagctagtgatgagcatctaagaagaaaacacaaaacagtactgtcatcacaatgcaggagtgctgggttgggggccaggtgtggttgaggggtgctgtattacgctgggtagtcattgaggcctctgtgaaaaggtggcatttagactaagggagattggaaggtccagccatgggaagttcaggagaaaggataagaagaaaaagctgtcacatgggcacagactgatgaccagcaaggctggaacttggaagatgagggaaactgagagtgattgtcagctcaggctgctttgacaaattactgtagcctgggtggcttaaacaatagacattgcagcattccctctccctctctgtgttcatttctgaagttgaatagtcttccatactcaagctctggggagatccctttctcctttcacaccagacatttcgtgatttgccctttctgaccaccccagccctactttcccagtcttgcctctgcctacttcacctcttctctccagcgtcatggttggagaagcatattctcatggttctggatgctgaaagtccaaggtcaggtgtcaacaaggtctggttctagtgagggctctcttcctggtttgcaaacagctaccttctcactgtatcctcatatagtggtgggagagagcaagctgtggtgtctcttcactgattaaggacattaatccaattgtatcagggtctcacccttatgacctcatttgatcttaattgtctccttaacagccctaccttcaacagagtcacatgaggggttagggttcctacatatgaattggcagggtggaggtgggaggtggccggggrtgagacacaattgatttcatagcgtcgagttataagatgggtcacagtattagatgggaccagagcagagagggtctgtaggccatggcaagagtgagaatttactcaatacacagtggaagttggggatgagtgagaagcacaagagtggcacactgatttctacaacagtcagtctagctgctgggtggagaaggggagaaggaggaatagtggaaaaagcagggagaccgcttaggaagctgctgggaccgtgcatatgagagatgttggtggcttgaaccagtgctgggtttctcagcattggcagtattgacrttttgggtgarataattagttggggagtggcagggcggggggtaggggtgcagtcctgaaccagtgccaggtttctcagcattggcactgttggcattttgggtgagawaattagttgtggggggctgtcctgtgtattgcaaaatgttcagcagcttcactagtctctacctgctagatgccagaagcccacccaccccgccccctagtcatgacaatcaaaaatgtatctagacattgacagatgttaacctgggattagggggtggggagaccaaaattgtaccctgttgagaaccactggaccagagtcatagcaatttgyagtggatagatttaggaatatttgaagacttgtaaaatatagcctgaagggaatggagactgggagagtgaaagatacctctgagacattttggcttggacagaacagggggtggaggcttccattcctgagctgcaaaggagtggggagggaggagcagygtagtttgggaagtgtgtggtggagaaggcagatgggrcaggagctctgtcttgcatctctcaggtcagaaatgcctcagacatccagggggggcaagctaagatggagttgaacacagcagtgtagggctcaggggacaggccaggaatggagagaaacatttggcactcatctacttgtagcttccctgtcgagaaaaatgaaatcatccaggggttttcaaattcagtggtctctggaccccttcacactgttaaaaatggaaaaccctgccactgtctacatgtttatgttgccccagtaatctatgcattgaaacctaatcaccatgtgatgatattaggagctggggcctttaggaagggattaaatcgtgagggtgggggacctttatgaatgagattgtgcctttataaaagagagctgctttgcctcttctgctagaaggtgccctccgtgaaccagaaagtggagccctcacaagacactgaatctgccagtgccttgatcttggacttcccagactctagaactgtaaggaataagtttctgttgtttaaaagctacctagtttaaggtgttttgttataggtgcccagacaggctaggacaaacgccaataagctttcgtttatgtgggttgtatccattgatacttgctgtatgaagaattaaaattaataactttaaaaagatttattgattcagaaacagtaacaaaacttaatatgcgttaacgtacttttatgttggataaaaactatatcccaccccagtatatgaatagagtggcattgttttatgtgtttaatctctggcttaacagaaggcaattggatgatcatacctgcttctatgtttattctgctgccaatatcacacagcttctggaaacttccacggcacacattcatgagacaataagagttaaaaaggtaaacagtgtcttagtagtgtatgaaaatagtttaatctcatagaccccctgaaaaagctgcagaatccttacgcgttcacaaaccacactttgagaactaaagatcaaggagtacagttttctcatttttatgctgttcagagtgtggttgaagttcagccatcactagtccttcacggatagttcataccccaagttgatggccttgtggaattgctgaygctattttcatatatatatatatataattctagcctttttctctggtcttataagagtcacatacgtaggtaatttcatatcctacaaatatgttctaaacagcagaatattccaggaaaccttaagtgataactgagttgaaagagtcatattttttaagcaatacaatttaaataatttttaaaggaaacatttmtaaaggacgttttacattgcttgcattaaaaagaatataatgaacataatccaactttttstcaatactcagggtcatcactgtgaaagtaacttcattctatgataagataatgatgctcccaggtgggcaaggcagtttttcatctaaggtaattgagacaccttttaaaagcaaaagataaattcacagaccctcagtgtcattataaattacttggtataaagatacttaaatacctacagccttataaggcctaggtgtcaattttttacgcttgcagatcttttacaactgtaagttaaatgattttacacattaagtgcatmtaaaacaaaaagattcaaacccaaatattaatttaatgacatgggtaatattttgctaaaagtaaaccactgctcagaatgtgaataaactgacctcgaaggcctgagtacgtttgaattacggaacacctctctttgacatcacaattgaattttttctttaagtatcgcaaggccccagttcacggaagtaccacaacataaattggtcttcacttggtatgtgaacacatatttatatgttaaatgtgtcttttctttttggtgtacaacagctagagtaatgcagtttgcttgcaatgtgttttttatgtaaatgctgatgccgaatccacttggcagcactgagttacaagaaggttaagtagatgaactagaagatggataaacgaagatagataaaatgaagaaaaacaaaartcaaggagaactcaggcgtccaagagtgtgtaaacaacttctggtgtgagacgcgctacattgcgctaaatggcctgtgcgcttctggtttttcccttcctctgttgattttttatagttgtcttttattttaaacacgcctcccccccccctttttaaactgattttaccatcactctctctagccctgcctccctagaattagctgcttcttacctcccttggatctggaacttaaatattaacgtgtatataagttaatagtaagtagaccgtgaatttagaagagtaaaacagaatcatgagtacgtagtcactgtggccccttttytgctggatttcaagttcgtaagcatttttggaagagagtcgaaggggaaggggtggcttgccagtcagttgagtgatgcgtgagggaggcgttaaatgtgcatgatgcactaaaatgcatgtttcgagatccagtatgactgctcttccatagatgatgaaaccaaggcagagaaataagatgtaactctcttaccttgattagtgatgagaatgggacagctttattyatgaaacccggaaaccactagcccattcttgggatgattgatatctgcaaggatcttcaggaatagagtacctggggctcaggagccaagactagaagtgttgaaaggtgagcaggaattagctgctggcctcagacgtggagagacacacgggtgtatgtgtgcacacacacacacaggcacatgtatattcatgatggcttcttaattcccactccaggccaactcatttccctttcccttccacaggtacttataccataaaaggtatatgaagtgctaaaatacttgtaggtatgttgtcaatatgagctactctgtaaatgataaataataattgactggtgagtctaggcaaggcaagtcaatgagattacaagaaaagagatgttaggccttcagaaagatggaaatttctctttgtccctgcagggactgttgcagagcattagagccaccctcaaacagttacccagtgagtctcctcaaagcaagtggcactgagatacarccttcctacaggttttcaagtcatctcgtgtggtgcacagtcctsgccctacctsgaaggcccgggcraagttttcctgagtgtgtatactcatctctttrtgttrtctctggcagggagcaagtgagtacaggattggagtaataggcatttttaggcttgagatggctttgtgtgtttggttaatgtcactacatttcctaggggatartaaaagtctagcatgataaaagatctcgtcttacaaggtcccgatgtaaagtttggagcctaacttagaatttaaaataaaatacattttgacccattgtattgagagctggtataatttaatatagtgagcccctcggcttctggttggttgggttataaagcytsttattcattcgctcatccattmatgcatttctcctatgaggaagctttttcctttgagctgaacacacaaaattaatcgtgctcgaactctccaaattttgtgagttccctggtaactgactgtatggaagacagaaataaaaatcagaataaacttttattttctgaatcagaaagcagttgctccagcttytggtggtcacattgctaagatgtaaaaaacagaagttaggtgaaataaattaagaataattattttggagaaagagagggtagtgtttgactaaattagaaacattctctgagtcttagaagcgtgaatgatttaaatgaggttccagcatagtattgcatgtggtttctattttagagttttcccacttgaaaacaaactttgaggatttttattgaagtccatcagttttaacttactcaaagcttagcagccaccttttgcttttcttcccgttccccccacctcatgctgtgaagaaagtcatacaccattgtggtgttgattgaaacctttatttctccaggtctcctctcataaactgggctaagaaacacaaaggacatttgacacttcatgactacataagatgtgctgttcctctctctttctgtttgaaagtgacttggcagggtgaagttgagaaccccttggaaaggaggaagccgaaatgcaaacamagttgaatcatgargtgatgtcactctgaaccaattggagcagtggtgtcatgtgcctggcagctacttcaaatgcccacaaaacaggagtamtggtttaagctgtttccctcttcccctcccaccaccaatcagcagcagactgctagaggacagatgcaaaacagttattagaccaggcttagttagacatggaggatgcatcttaacaagttagtacctttttgcaaagcatgaagactaattcaaagtctattttctggttttgctctaccagtayggccaaaaccatttctttttaagtgagaagtggggatatggtcaggtttgattccagttgaagttgtgagctgcacagggctggtctgagcccagtggcatctttccaggtgtcagagccatgattttaagctcctgttaaattcacagtgcttagtaaccataacttcttggtttcatgatcataggggtttttgcatagctgccacccccattttctgtttgtgatccagtagttaaaactcccagaaaatatttctcaccctggtttaaataaacaaaacagccaccacaaaaacaaacaaaaacttggctaaccactattttcaggcatattctgagagagaaagagggggaaaaaaagactagacatcctaaaattaagcaacattatttttggaattgtgttgtttcttatactcagtcatttgtgaatgatgtggttcaaacaaaactgaaacaaaaatagtttttctcattaaaaatatgtttgtcgcatagccagcactcrgaactagggagggtaacatggaagtattgtcattctcggggctgactggttgacagcagcctatacaggagtggagaatattgacagggctgcccgttctccccaggtygaagagagcaaatgcacatccctgtgtgcacggccacctggttcctctcctcacttgctggtgagtattgaacggctcacataattaggcagaactcaggaactttcctccctatctctttcactcttctgaaatgccctttatgttttcctctgctctttcagtcccagtgccttttctctggtgcagcctcatggttcggtctcaccttcagcttttccttccctccaatacatcctgtaaattattgtcagacttcttyttatctaaataactcgtttaggtaaggtactcatatgttcaaaataccatggtggctccctgttctctgtgatgtgaagtcctaaccattagactcagctttcccccaggacaccttggcttatcttcttgctgctttccagaggcatgggccattaggctggttttctgaaggttctgccaaaaggctgggcccttgtctcccaccccactgctgttactcatgtgttctcccacttgctcggcattctttcccatgctttttccttgatcatcactyactagctaacatctattttttcctaaacactctgttgcagttgtagtctgcagtcactctyctaagacttgatcayctattacgctgtttcgttctttattttttaacttttcttcttcttttttttttttgaaacggattctcgctctgtcacccatgctggagtgtactggcacaatctcggctcactgcaacctctgccttccgggttcaagcgattctcctgcctcagcctccctagtagctgggattacaggcacgcgccatcacacctggctaatttttgtatttttagtagaatcggagtttcaccatgttggccaggaggtcaggtcgaactcctgacctcaagtgatccacctgccttgacctcccaaagtgctgggattacaggcatgagccaccatgcccggttgttttgttctttaattttacaaacttggcatagcttagaagaccatatacagtggcaccatatacagtggcaccatattagtggcaccatatacagttttccctgagaaaactggtacctcccaacagataccaaaatctgggaccaccccaacagataccaaaatccacagatgctcaagtcccttttataaaatggtgtgatatttgtgtatagcccatgctcatctttccgtatactttaaaccagggatccccaacccctgggccacagaccagtcccggtccatggcctgttaggaaccaggctgcacagcaggaggtgagtggcaggccaactagcattaactgcatgagctccgcctcctgtcagatcagcagaggtcctagattctcataggagtgagaaccctattgtgaactgaacatgcagggaatctcagtaatgcctgatgatctgaggtggaacagtttcatcccaaaaccatccctctcccccacccatctgtggaaaaattgtcttctacggaaccgatccctggtgccaaaaaggttggggaccactacgttagaccatctgtagattacttataacacctaatacaatgtaaatagttgttatcatgtattattagggaataatgacaaggagaaaagtccatacatgtttaatacacaagcatcctattttttttcctgaatatttttgatctgcagttggttgaatccatgggtgtggagccctcagatatggagggcatgctatactgatcacccctatgggtgtgaatgttgggcagatcctccagtgtcaccagccatgtggccttggtgacctttccatacttttcaatcagaatgatgatctccacctctcaggaaagttgtggggatgaaatggtatagtctgtgtgtgtagagttgttaggctggggcctgccatgttaaatgcccatgaagcaggtaattatggtagtagtggttgatatcttgaaatcagggggattcccaaatttctaccccaaatctggatgactgcatattgcgggagttcagtaaatatttgttgcactaatacttatgtgcatacgytgaaataatctaaatatttaaaaaccaaactaacggtaggactttcctcagggatttaacgtttgctgtagaagactgaatgatagaatatataagctgtatttttcttgtgattctacacattgyccatgttgcaacttaaatatttttggaatgcaatgtaaaagtgatttactgtcctataattgttttcctgaaagcaaaatgatatttaagtgaactgcaatgaaaaatgcaacgactgtaatttatcrttgaagggcattttcaaagtgtatagaatgactaaagcttaagtgtattaaatattctagaggaagacatatttaggctataaatctagacttcctttggaatttgtttcctttttctcagccaggtgtatgaagattttaagttcttaggcctcagtgggaagaagatttaaggttcyaagagtacatttgtatctcttttaaattttctattgtttatcagtgacatatgtaaatgttttagggagctgtttactgtaacattacctactttagctctgtgcagttgtctggcaaccaatgtgataaagacagaggraagtgctgtattttgttgctgacaagtatatcttaaaagtgcaggtgcacctgaataggcartaaagtattaagagctgctcctggagcagtttgctctctgtgacgtgtgaaaagtctacggggtttataattggtctggccatacggctgcctaggattagactcttttcatatccyactaaacactctccttagaagcaagcacaaggagatagtttattttaaaatgtaattgctatgttactaagatttgaatttgagtaccgagaataaaccatatttctgtttagaggctggttggcttaaaattgtgtctaatccttcccctgccccccaactccgaatcagagaatgaataacaaataaacatgacaatgaagtctcatgctgttgttttcatatttgtatttaggagtttcagagcaaatgacttggaaaacaggcaaatccactgacataggcatttttagccaccttggaatccgaggagggattctgcactatgccctgtaacctcgtycacatgccgtttgaatgtataccatgaagaccccttagctcagggagctttgctctatttaagtaatgtttatattcttaatgaaccaaagaggaagtggtyatgggaaaagagccaggactagatttcattctaatgcttataaggagagttctaggaaaccctcagacttggtaaaccaaggcatttggagatactatgaattggtttaaaaggccatttaccacttcttttgtaattggccttttaaaccaactctcacttagctgattaaatgtggtcatttaaactgctagttaacaatcggaagtgcagtggcgcaatctcagctcactgcaacctctgccttccgggttcaagcgattctcctgcctcagcctcctgagtagctgggattacatgcgcacrccaccacacccggctaatttttgtatttttagtagagatggggtttcaccatgttggttaggctggtctcaaactcctgacgtcatgatccacctgcctcggcctcccaaagtgctgggattacaggcatgagccaccgcgcccggcctaagatttcttattgtggtattctgcagtggagaatgggagttggaaagaaatgttttctcccacacctgtcccgctcctgtctactgaaagctgattaatcagtcagatagtgagttcctattggtagtamgcctccaaaatttggaagaggggaggtggcgtgatgtgaaaaagcaaggctttagggagagattcccgctgggggcattcaccctctggtccagcgtgcctgttacagtgatcactccatagtggttttgcatgaacaagactgcccagtttgcttaggaagaaaacaaaggacataagktagttctcatgtcttcccagcaccctaaatactcgggctaaacttccacagtcagaccgtcagcttcaggaagggctgctgttgggaactttttttttagtttgcagttagttcagctccagccaaaaacctacaaaaagccactgcaagccctctgcctgctcgtataagacaccttggttgggcccctgtgactgtccatccataggatggttggccattgactgcacagagaggtagggcaagataaaacgactcatttgtggatctgactccttgtacttctgtttggattcaaacagaggaagatagagtagtggccttgggaaaccgtggagagagaaaaggcatagtcagaatgttttcagaggagcgcagacttttcaaaacccctctcatcacgttcccactgaccttcagttccagtgctgtggccacagggtgtctgcaccccaacttctttgccaagaaattaatgatctgtgaagacacacagacatgaggcggacttactatttaaaggaatcctgaaacgaatatttttctgatacatatttatcctaatatatttgctgagcatggtttttttttttttttttttcctattttggagtttttgggttttttaagcctagggaatgcctaatatgtactgtggagtgcatttgttcatttatatcccagtgcattgtaaaatcgagcaattcagtgccttagaatcctttctgtgaacttgatgctacgtgaactacttgagaacaactactttcaagccctccgaagcactcagttacaactgtcggtctaattgcacattattctaattcattaaaaaagtccccaagggcttcttaggatactgctctatgttattagaagtccttccaaatagaaaaactttattaatttaaaaataaccgccaattcagacttcgattcaaacaaggcattttaccaagtccggctgaaagagcttcttaccacatctggcatgtagaatggcagaagactatttttgctagattccttgttgctgcagccrtttctgatgtccttttccccttcacacctttcgtgttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagatgacaaacaaggagtctacttctaagaatgcatttgcaagccaaaagagtggtgaaccacttcagagtgcgggtctgtgggggatgatgtctgctttgcttcgttttktggaataatttttaacatttctatttagcattcatgatactctaaatagaagcaggagaacactgtggctctcggatccaggagaggcaggccacgagggctcctgctgtttggggacagtctgtaactctaaatctttttatatgcagcaattatgaccttaaaaatgggtgactctaatactggcattcattgcctaaaaataattttaatgtgcaaatgccagagaccaggtcatctcagaaatggactagaattgaccactgctatgttttggtgaaacctgataaccttgcttttctccgtgtaccttgtttttcattgtaaaactatttaattatgaaaatgagagtgtgaaaggcaaagtatrattgaatttagggggcagttccatatagttgtaacaaactgattatcaaatgtccaccattagtatgttaaaatacggttttctaatactgagacaacagggatggagcagcctatccactgaagtcttgttgtttgtccctgctgtgtcccaacctggaatctctttcttcttccttcagcagacccttcgagatcagcttaagcttcactgccttagagaaactttcctgtctacctggactgtcttctagatttctagagcagtgttcctgcccttttcctttctaaatggggtgggagttctcagagaactcatctcctttatggctttatccatcacagccacacagataggttctgtctggaccatccttttccctgagctttcttctcctttgccatgtgttttcatttctgccagacactggcactggggaagcctcccatcgtctcagactcagggtgtgtgaaaaacaaacctgctttctggactctacagtttgtgcactagcctaagccgaaaatcttgaaatctgtcatcagtgactattgtagtccataggaatacccaagactgggtaatttataaagaaaagagggttagcttttttttttccggctcatggttcttcaggctgttcaagcatggttccaacatctgatcatcatctttttttttttttttttagayggagtctcattctgtcacccaggctggagtacagtggcgccatcttggctcactgcaacctcccacttctgggttcaagcaattctcctgcgtcagcctcccaagtagctaggattacaggtgtgcgccaccacacccagctaatttttgtatttttagtaaagatggggttttgccatgttggccaggctgatcttgaactcctgacctcaggtgatccccccaccctggcttcccaaagtgctgggattacaggtgtgaaccaccacgcccggccaggatctgatcattttctaggaggcctcagggagcttttattcatggcagaaggtgaagggggagcagttgtatcatggcaagaagagaaagagagacgccagatctcctggtagataactaacagagtgagaactcactctttactgtggggagggcaccaagcccttcataagggatccaccccatgacccaaacacctcccaccaggccccacctccaacaatgggaatcacatttcaacatgagatttggagggaacaaacattcaaactatatctacgaccaaattttcctaattcctttctacttaaatgctttcttttccatttatttcacccacatctgaccctaggatttcaacgtgttctaaaatgaatttcttgcacccattttcactttctctccaccagaatccatctcaccacccacctgccagtggcatactccttgcatagaccctgctctagcatgaatatagcccactgttatctgttgtagaacctcacgcccagcttcccaccctgtgtgacatcttcaccctcttgccctggcttgtgccatccacattccgatcttgatgactctggttctcttctctttgacggtggagggttgatcccttccttccccatgatcataaaaggtcatgccaacactcctaaaacaaaagatagattaataagagaaaaacctaacaaatttattatatgtgtgcatgggagtcatacaaaatatgaaaactcaagaaaatggccagatggttgatccttaaatgctttatttattggtgagaaggtattgggggtgtaggagtaaatgattttcagggaaaatgaatatttccctgagacagcaatttacttgtaaatgatgctctttagaatttgaacacgctccagaggcagaaattgtcttgtgaaaaagtctgtctgggtatggttgcattcctcagtcttgagctggtggatggcagggtgcaattgcaggccgtagtgttcctctttggggatctggtttctaggtgggtaagggaacttcagagaacagccttgtcctgtgctttgcgagagacaaaggatgaggaaggggggtcagggaccttgaggctgcttcagcatgtcaagagtgccatgtttgggacgcctcaacactggaaatagccttcattcctctgcttcttgggtctggatccttttctttagactccaagaaattcttccttttgccccaaactcacattgtttttgtcttctgtccctctacttctatgtaattctattattatgcacagattctgtgtgcccaaggagactgtaaactccaggagggcaggaattatgtcttaaaacactagcggttaaacagttaagaggtgtcttaaaacattcctgtagccccagctacactcttgggtgcaggaatcacaagtgccttattccccacagggtccccagcatattccaggagctcattatgtttttaaatgaatgacctactgaaggcaagagaccaggaaggaaagtttgtaaaagtttacattattagattacccctgagatgtgtaaccttctcacgagttagatttcttgaaccactgcccgggtattgtattcctactctaggagcttgaaggattaatgataatccttttacagatatattcacaagtttctgtgaatgtgaattaagtatgtagatcttgattgcctttcttgagtgcatggtttttttctagaaaaacaaatttaagttaggtgggacacctaataaagctctaggctcctttcttttcctcttttaagacacagttaattaccttatgctaagttggaatataggaattatcttccaaaactgtgtttgcttgctgtgtctacataaaaattgatacaaggtatgccatggtttatacaatttctggcacatttacctggtctctgttacaggtttgtgaaaccaatttttttattgtaaatagtacgttaccagcttaattgctttagaacctagacagtctatgtctgtgatagtaattacattctttcatgactttgtttggtaacctgaatgttgaactagctctacagatttaggtcatgtctgatgctagccattcctaggaaaaagtggtgaggactacattatgggcctttccccctagacttaaaactgtgaagaagtcattttgggttgaggtatcccctggtaccctctcctgaacttcaatagaataacatgatgtggtgaatgaaccatattagaaaaaccagccaatcagccragattcttgtattgactcttctgatctccctctacctctcctttccccatctgccaaacaaagggtttggaacagttaaattctaaagtggtgtcattgatggctctcagtattctgtggactttcctggttgattcagtacttgtgattgacctggaccccctggtttggtccagccttagagcgggtttgcaggtagacaccttcctaatgtttgttccacgtaagcccccggagcacagtatttccatcagctattttgtrgaagtgagcgattctcttttggttgtaaaccttcactatttcatgtgggtgacttgacaatggctccatttttgaatggcccattgatagttgtagtctaaaaatttccagagattacacaagggtttatttaaagggaatgggaatagggagaaggtataacctttccaaaacaatctttaaggcaattataagctgttaggaaatgtcatgtaataataacacagatacccaagcttatatcacataaatcattcattttgcatgtttttgacagggagatttattttccaggttaaaaacaaaaaagaaaaatcttaaaagcttaagcttttattgtttgctttttttattaaaaagtaatttggagccagtaacttaacctgtttttcataaacatgctatctagaggcagccaaaaaaatattcatgcttgcatagtcagggtcctcaaatgaacttatgtgttggatcatgataactctggtaattactcgaattacccttgttgagtaatagtatggaccctgaatacaagggtttgatttatgtggccagctctgtgctgctgggtttatgaggacttgccagatgtcatctcctaattaaaatccttctttacccttaatatcctctcctctgtccccaagaaattaatccattctattgctggagcatgtaacagctgatgttgaagttacaagtttacagcttgaactttgcctagactgtaccttttttgggaaagagtttgcaaagcttttaagcctgactcttgtctttagatcaccagcatcaccatggtgcctggcatcagtggagcctcagcaagtgtttatggtggaaacctcagaagctgtcactttctctggctgtaacagttgtcatctttgtttacagggaaaatgctcttgagaaaatggaggtcattaaacactccagcttcagcaatatcatcagagctttccgtcacgtgagttatctcacmaaagggtcagattctggtaaaaactcttgccttcacacttacttctgttttattttgccttatttgacatttcaccagaattgatccataggttcaataaggctccattctgttgggacaaatcaagctagaaagacactgaactctgggggttaccagaaatatctgaaagcaaagcagtgactgtgaggtgggaatctctctgagaatcctttgcagaaccatgtaacagctctgcatcactagacgagccaagcgaagtggtcctggatggttcagtaggctcaagcattgagggtccagagcatcctttgcccctggacatggaagggttttcattgggagatggcatttagggcatccttataaacgagcaggagtaaacctagcaataaaaaccaaacctctgccttcagaggtatatgctattacttctgcttaaaccgttgtcagagctaacagttttggttagggatttttgtgggtccagggcacgcccagacacccagatgcttctctatgtttgtaagatggcgagtgttgagatgtcttataggcttatattgagtgaaaaggaataggatcctttgtcagtagtaacttaggctttttaggtggccagggcaagagaacaccccccctacacacacacacacacacacacacacacacccctacacccacacacacccacccctacacccacacacacccacccctacacccacacaccttcccacacaaacctacacccacacaccttcccacacagacctacacccacacaccaggatttgaaggctctgctaagaggctacaacaactgtagcatacaactagcacacttgttgctattatgtgtaggggactagatggaaagagtgcagataggactacctaccattcacccctaccagcgaagtggaagcactcatcttctttcccttcttaccytttcaaagcaagttgttgagggatgaagaggagagtgactttaatcgtggctttaagtagagattttctttaggagtaattgtttctctcgacagagtggataggcttccatagttgtcttaataccttttgtccaccccaaggattgacccaggcaaggaggatgaaccctcctcaatttgggaaagttaaattttaggcacagcaggtcaaagagtagggaagagctgcagttgttggaaccaagtgacattgatttagtctggaaaggagtcacagaggaatcaaaagccagaccctcctggcagctttagatgtggttggggtctgggaataatgctggtcccaaaatcacctctggaactaactcctgtaaaatgaagcctctgcatccttcagtaacttacttaaaattttgttagggctgcattttcttcaaagccaagttctgaataagaagtatttgttttggrctctagccagattactgaagtattgttgagggagatttgctgtggaaggkgttgggggtacagggattgtgaagataatgtaaaatatttaacattttaaaaattttcagtaagttctctttccccaatgtcagcatgacttcttcattcatgttcttccatcactctccattcagttagaatctcaattgtgtaatatcagtggtagcgacaattatgaaattcgtccagtgaggaaaatccgcagagctagagcccaaaccagcaactttgtagtgaggatgaccccactggccggggagaaactgaactgatttttttttttctctctctctcagctttttattttgaaataattttagacttacaaaaaagttgaaaaagcatccaggcatggtggcttatacctataatcccagtgctctgggaaaccaagacaaatctcttaaagccaggagtttgagaccaagctgtgagactatctctacaaaaaaaaagaaattaagtagccagcagtggtggcacgtggctgtagtctcagctacttgggaggctgaggtgggaggatcgcatgagccaggagttccaggctgcagtgaactatgatcatgccactgcacaacagtcttggagacagattaagaccctgtctctttaaaaaaaaaaaaaaaaaaagtttgtaaaatatcacccagttttccctaacgttagcattttacataatctatacaccaattctcacagccaagaaattaacaatgacacaatactgttaaccatggactatttgaatttcaccagttttcccactaatatcctttttcagtcccaacatccttcattgtgtttacttactatatctagtcttctccagtctgtaaaaatgtgtctatctttgcttgtttttcatgaccttgatatttttgaakagtatggacaggttgttgcatagaatgctccaaattggttctaatgtttctcatcattaaactcatttttatacattttggggaagactactacaagattgacattgcatctcagtgcgtcacatctgtgtgatgtcagcatcttaccactgatgatctcttagccttgaacacttgattgaggtggtgcctgccaggtttctccagtgtaaattttctgcttttcgcattgttactgatatcttagggctgatactcacagtatgyagatgtctcgtttctcttttttcatatttcttttcttttttctttttttgagacagtcttgctctgttgcccaggcaggggagtgcagcctcagacttctgggtttgagcaatcctcccatctcagtttcccaagtagctagtgtgcaccatcactaattagtgccccaccagttttgtttgtttgtttttttgtttgggcagaatctcgctcagtcgccagactggagtgcagtggcgcaatctcggctcactgcaacctccaactccctggttcaagcagttctcctgcctcagcctcctcccaagtagctgggattacaggcaggcaccaccacacccagctaatttttgtatttttagtagagacggggtttcacatgttggccaggttggtcttgatctcctgaccgcccacctcggcctcccagagtgctgggattacaggcatgagctaccatgcctggccttcaccaatttttaaattttttgtagaaactcactatgttgcccagtctggtctcgaactcctggcctcccacctcagcctcccaaccacaactggccraggtcctgtttctcatcacattgtcactcactgatcttgtcatgctttggtggagcttatctacaataattattactgccatgctttaatggcaattttctatcttattgtcatttattcattggaatttttacataggaaagacctgctccttctcaaactctaaacagtttcattcaccatacttttctccaggtaactttctgggtggctgaaagtgactttcaaagaatggagatatcttttcaatgttgagagagtggcagtctgctggttcccaagatgccttcttcacctagcattgagactctgcagaatgccttgaccacagttgtgatttggatctgttggcttgcaaagcccatttgagaatttacaaaatcattttcacggcctgagagtcttttaggtactgatttttttcatcccttctttactaacagactttatttagtagagtattattggacaggtttggggttcacctttatgagaaaaaacttagattttctaatttcagcttttttattttcttccatcagtgggacaaagttgacatcattgcctaaaagtaatttctgtgattatctgtgtatttcagttaaccatgttctttggactcactgtggtcttcagcagggatggtggccaaactatgtttagaaagataaaaattaaaatgacatctgcatccttcatgtaaacccataaaaaatagcacgtgaccctgaagatcctctgcctctcattccaggcattacaattgaaaatgctatctgggatgttaaaaactaaaactattctaggacttagtggaatattgatagttagggaatgctgtttgctttcttgaattttgaacctgttattgagaaggtagatgcgcctgtttaccccaggaaggctcctctttgaagacagtgcccctggagcacatgaccttttcatgcccttgcctgtcaagacttttccagtactctaaggtcaaagggcgttgggccaggctgatctaatcagggtattaaccttgccccactcatcttgatttattcctagatcccagttcccagagcatccctttagagcctcagaaatggaacamaagacagctgaaataagcccgtggccaaaaggcactctgagcatgagggaagtaagcaggcttccctgtcactgctgaggctctgtcatccagccccagctgtcctcttgtgatcactcagcagacccgggaaaaattcaagaatttgttttttagtgtcagtgggagacgtggggatcctgcttttgctgggagagcttcagttgtctgagtccccactcaaccccaggctcctgccaaggccaccaagggcaggagcactggaaggctgactatggagtgaagaggccactgggtttcacaaacagcactgtcagccaaagctgtagcttgttagccatccaaaagaatcttgcacctgctgccagtgagcttacacctagatgacagctggagctgacactcattcagcccttactctatgccaggtactattctaaacacttgccatatactcagttgtcccacagatacaactatttatccccactttagagacaaaaaattgaggcacagaaaggttaagtaatttggccaaggaagtgcagctagtaaatggcagacctggggtttgaaccgaaatcagtgtgactctagagtacctactcttagaccctactctctactgcctctcattagaagtctcccccacctccctaccaccaccatcaccacccaccctcccagccacatatatgctcacactgggtggttcagatggctagaagtggcagctcaaccttgtgtgcctcggacacgaaaatattaggttcagacaccactcagacttcacattttcattagttttgggtagaggaatgagaataaatattcagcgagacagccttttctaactgcaagattgcattcctcttctttctagatgcagtggcaagaacagtaccctggatggtggagctggtagtggtagatgagatagagcagtcccttgattctgctttgtccccattaatgacagatctgagggcatccagaaggaatctccacaagcccagcctccacagtggctgcttccyctacatggtagagtggtgctcacctccactcctccatagatgccaagtcatctgtggtatagatgtggatgtctttgttcaaatggtccttgagtctttgctcagatgatccttggttcttcatttcacctgggaaagaaaataatttgcctgttgtcattttatccataatattaagaaaacttaatggcacaatctaagctttttaccatgttatttatcatgggattacttttttcaggtgtcttctgaacacgcagttgtcccaccaaactttgacactgcccttgtgattaatttttgcctacattaatcactctcccttgttttaattgcacattacattcttttctgtccttcccggacatctttgctagcacagtgagtgcagggaggactgtcacggactctctcccctcttgaatgggggcattccagcagagtgtgttacatgagctcagagcacatgatgtgagagcctcgtgatgaaagatactgcaaaaacagtgcgcactgttatcaaacctgactgccttcacatcttgctttctgtggtgcaaaataaggtttttatagtgtcctgtttcttctgttatcatctaaaccaatggggaacggtgagtaagtagtaatcttcagaaaagaagaaaagacagggaggagaaagtgtactggaggcctgctttaccattaagttgttaagatggagtctcactctgtcaccccggctggagcgcagtagtgcagtcgtggctcactgcaacctccaactcctgggttcatgcagtcctcctgcctcagcctcccaagtggctggggactacaggtgtatgccaccacaactggctaattatttatagagatggggtctcattttgttgtccaggcggggtttttgttttttgttttgttttttttttttttttgaggtggagtcttgctctgtcaccgaggttggagtgcagtggtgcaatctcagctcactgcagcctctccctcccaggttccagcaattctcctgcctcaacctcccgagtagactagctgggattacagctgcgtgccaccacgcctggctaacttttgtatttttagtagagacggggtttcaccatgttggccaggctggtctcaaactcctgacctcaggtgatccgcccgcctcggcctcccaaagtgctgggattacaggcgtgagacactgcgcctggccgtccaggctggtcttgacttcctttcgcttgtagcctcccgaagtgctggaattacaggcgtgagccaccgcatctggtctctaagttttttttgaaagtgtgtgtgtatgtgttgaaaaacaatcttactgccatcatattgaagttacctagtgcatttcttcttcagggtacgaagaaaaaagaaaagtatgtcctgtggttgatagaaatcagtaaaatggagccctgtacgaggaagtgctgatgagactccaactaactccatggagatgagctacaaaaaaaaatactgattgggttcaaatccttggcctgccatttactggctgtgcttccttggtcaaattacttaacctctctatgcctcaatgttctcatctctaaagtatggaaaataattgcatctgtgtgaaaactgagttactatacgtaaagtttttagratagtacctgacatacagtaagtgytgaataagtatcagctagagagagagagagttagtttccagcagcctgtttctgtttggggtcacatgtggtctctgtccacctggctttttaggcctctcttacctgttccctgtttatccttgcctgccccagggaggagtttgagttggtacatcctgactgggtactctgcctgtggttagcaaatactctgcatgttgagtgctttcaaaatacagaaacaarcaacttgtggaggcattggaaaagtgtgtttgagaaacaagcagcctcaccatgartgggagtttgtttccctttctcgtctttctggtcatctgctgcacgggcaggaggagctgtgggttgcttttcttccttggaacatggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatctttctagataaactscttgctatgatgccattagaagcagtgttcttttgtgttttgcttttgtttttccctgtagacaggaataacattttgactagaaacttccctgatgtaataacgaagatggcctccttagaaagttccagaacagaccccttcacctctgtccccagaagcagaagtaggtgatgcactttcttggcaagccacataactaccatttctctacaatcgaagctcaaaaatctgtgcttgtatacgttcattttttgtttttacttctttacttcctttgataagacagaaacttctgtattaaaactgatttaactctgaggggctaagtgaacaacaatctgttgtcctatagaggtcaaggcagtgctcacaacaggatcattgtgctgctgtagttcagtttaggggacggggaatgtttataaaaacaaagttttgaaatgaggacagggaaaggctttgtttacctggggctctagacttaaggtactcattttgcctgcagaataatgaaatgcagagttgtaattagaaaaggttgatgtaattgatgtgttaacaatttttgaggtttttctctttccactttaggacagtcatgcaattatttttctgaaccaaaatcagaaccatcagtcgaaggctaaaacaggcctggggaaacactgtcttttggcaaagaaagacaaagatccttgttctctaggccagtgtgcatatgtgtgtaatgctttaaagaacaattttgacaagaactcttaggatgcaacttgtagagtgatttttaaggagatgcagtaggatttgtgcaagtattctgctatgagcctaagattttcaacatggaaatctagccatgcagtgactcgttcactttggcagtgtctatcttagtctgggggtgagcgtttgtagaaaatatttagagactcaagtacactcatttgaatttttgctgttagcaaataaatggcaatatgtgtaacgtggtgaatgggatgtaaagctgtctttatattaccacggttagaatttaattttgaaagttgcaagtcaaactgcttcctcttgcgtcattaagttgtgcctcttgtttgctcaccggcatgtgtgtccttgtgtcattttggttgctgtgaaattgctcttaccattctttcatccttcaacctgctgtgctacaatcctaacatgctgtttttgttgaaaatgcattcactctttttggcatcttttttccccagaaagttagaatattgggaattcattggtattagtgaaattcccacctaatgcagcagtttttttctcttacctgcataatagacgcagaacaaattaactctaaacggattagagctgtcaactgacagatactgtgcgagatactgaggaagcctcagagatgataccaataaacaggacagggccttctggtcgtgtttctacttctcttattggtttgtcttagcaattttgaattgcactgaaaacgaaatttcataggtacacgatacagtagttagttttaaaagtttttaaaatattaaaaaattgaaagtatttaaaatattttwaaaatattttaaaatctgctgtgtgagatagataggagacctagcttttcttccttcttaccttgatccatagagaaagcaaccctgaaagaagaaaaactcacccatttgagctttcttttgtttccactgagcaatacggaagaaattcaccrctggttataggtcttcagtgctttcttcagagtgggattgttttttgtttcaccataagtagtagtctattaaattaacagttgctagagaagaagctgcatctatatatgcagttctcttcttgtcaagcagtatattttcacgatagcaatgaaaaaattccatcctcaccagccgctgaaacatagtaatactgcagaaattcctgtgaactatgcgtttgctgcttccttttgtttgtttgttttcagagcagatgggcttgtttgctttttgcttaaacattaatcaaaaatcaatttatggctatgtaagtggcattagataattctcattctgactacagtaaataatatctatttgttcatgttagataagtctgggcggcagtggaatgtaaaatagaattacatgagatatgacatatggctatgtgttttataaattaatgcttttatgcatgtgggaggagaagtaatttagcttactgacaaaaagaaaagcaaaggaaattccagagaaagaacaggataccaagtctaaataaatttggaagacaaagagaatatcatartttagttcaatcttttaaacaaattgtcacaatttatacgttgggataagagaaccatgagaaaaggtatattctaagtcctgaacatctttctataccctgaagatgtttttatagctcttctgctgactccctgccaaaaaaactatttacggtttggggtagggggcgtgtcatgccatacagctaaatacacttttttcctaatctaggaggcatgtctacttacaaataaattgcttaaactagttaggcttgtgtaaatgtaactgacatttccttgagatcagaaaaagttttgctgattaactatatttgtgtgtgtgtgtgtgtgtgtgtatttagagagaaggagggattttataattattacaatttgatttgaaatgtctagagaaagtgagagattatggaaattaccataaatgctccctttttcatagatttagatctgttaattgcaagmaatctttttttaagtgaatcaatgggaactttttatttcttccctaagattcatttagccttgaaaaggccaaaagttgaatgaagcttctaaatgccaatctttccctccttctgttaaagagtatgcttcaactataattacatttgcattgtttaaaatattagtaattctacagccagacctctgagatagctgagaaaccaaaaagtgaagttcaaagacatcatcaggcaccctctccacacacaacataccaggcccaccaaggagtttacatgagtgtttttgccttgttagccgtggaacgacctgggcagtacccaaaacttagcaaactcttcttgtaccttgtattcagtagacggtcagtagcaccgagagtagggagaagagtaaatatgtttctaatactttattcaatgtatgttgttaacagtgtagacactctgactttccttgtgaattgcgcctcagtatttagttttcatttaccctggatcagatagggcatgataacctttgaggggctttgtgcatatgtaatttggaatctgagtcagtcgggctgtgtctctcccaacttcccttctcatattcttctctctcctcctcctcccctccctcctcctcgcctccctcctcctccccctccctcttcctcccctccctcctcctcctcccctccttccttctcctgccccctcctcctccctcctcctccttccttctcctcctccctcctcctccttcctcctccccctccttcctcctcctccccctcctctctcctcttctctcgtttctcttctctctcttctttctctcttctctctctaccattgctgtcagttgagatgggcctgtgcggcactttgtttgcagttgattggcaatcttctgttctactactgcatctgaatcatcacttgcttccaccagttctctgaatgtcttacctagtgatcctggtggggaaattacagtgattagtgttccaattcttgtttgcccataagtgtttcaaagtagtatttttaaaaactcttctaagacattctctcttctcatagtagatgcagtgaatcttaaaggtgccctaactaaaatttttgtgctataaaattggcagctttacaaaataaaaggttcgagatatgagcctgatcaaggctctgcatttgcaacaatatccttggtttgcctggccctgttatattttgctgttgtgatatgactcctgccagtgctatttccatttaacctttgtttttctaaaagacagtaataatttttcatttctagggagtctctgacatcagctaaaggaaagacacttttctttgactgtatatacatttctccccatttcattaatatcaaagttgctctttcaaatggcttataaaattttaaaattacaccagttgcataagcctgcataaaaagcagactcctacataagctgacaatgcatttgtaccgtggtgttgagcagttttaacatcctccgtgcctctgtgcttctgctagctactgctctgataaagttatcaaggtatcattggatgcattgaccaggatgaagacacaacagtatggccttattaaatttggaaataatgaacagacgagtagagaatttaggagcaatataggcaagcttaataggtctttactttggggcctgtaactccaactacatatggaagaatttaagtacaggaaaagttaagctcttttcccagtagttctgctgacaagttgggtgacttcgggatggttacctcttcatgataccacacggtgatggtaacagaggcactgtccagtctctggttcatgcacactggtcttctcaggggtccctgtataggtgacacagtggagaacagggcagtactgccagactcagggacccagttcatcgagaggggcagtgtttctcttatgctgccttaaaggcattggatgccttttggaaagccagtggacarctcctgcatccacccaagattaatgttaacagcttaaagaatcattgcaatcaagggaaattttgcaacactttgttgggatatttttaaataaatgtgtgaacaccttgttttaggcttgctgaaaatgacccaggaattccttgacccgggaatatagtgtatggctgccaattattatattccttcatcagacaaaggcggaacagttcactctttttcttttttttggacacaaattctcactccctcacccaggtcagagtgcagtagcatgatctcggctcactgcaacctctacctcctgggttcaagtgattctcatccctcagtttcccaagtagctgggatttcaggcrcgtaccaccatgcctggctattatttgcatttttagtaaagacagggttttaccatgttggctaggctggtctcgaactcctgacctcaagtgatccttctgccttggactcccaaagtgctgggattaaggtatgagccaccttgcccggctaccggacagtccactctttacaggggggcgtcttggtataagtatggaaagctccgtagatgccrtgtcagtccataccctcaccaccttcttgaccctgtgccgataaactaagagatgtgggcagtgtaccatctggaaaggaaaaggctttggagccaggtagtcctgcctgcatttgaatctgctttctaccacttacttacatcaggttttccttgtctataaaatggaagtccttgtacccaccacctagaatggaagtgaggattaatccagaccaacgatgaagagtccagcatgcaggaaatgctcgtttataaccatggaagtttcgaggacttttgaaattcgatgacattaacctttgaggtgcattttagttggcttgtgtgatgaggcctttctacttctagttccagaatcgtctggatctacattatgtgggaatgtttattcccccctttactttcccaaaatttgctaaacattttcattgctatttgagttttttaggagacatactgagatgaagttagggatgtgaaaggtttactgaggataacaccaatgaaaggaagagaggaggaagatgatgggtgtggggagcggtttgaccaggactctgataggacagacactctgccagccctccgggagctcatttgcagagccccctgttagatggatataaccgggccctgggaccattgctgggctcagttactggccaggagctgcctaggaagagtgtgacctaggccaaaagttgaagtggaccctagaagagctagcagctggagggcatctgctagtgacactctggagctggacagcaagtcctttctgaaagaggatctgagctgagtatccctgtggtccagtatttcaagttggaacctctaggtttgaaaaatacatgttttgggtgagagtttgattattcttaaagggacatatctttcaaacatatggctgtggaagaggaaacttgtttttgacttgtaaaataccagcagagccttgcagtgatcacaacttatgtgaaatacagaccatcacccacagtttacgtgttcacactaaagtgccagtctctctatgggttttagagctgatttagatacatgcattgctaatacagtcagcccagccaagatagtgccatcctccgcaagcatccamtaaggcatggagtcagcttccgtcattgttagatcagtacttgtttctttsccttgcttatttttcctaacctctctgaacctgctgtgttggaagcttaaggaacatcatcctctgttgggcagaattcttccatggccaccccagcattatgccccacaccatttgacttactcatttgtgaatgccaactcaraatgtattgctttgattcttgattaggatctcaacctctatttattgttaagactatcaccctttgattcccccccatcccattgtgtccttctaaaggcacagaatagaacatcttctgccagaaataacatacaaatttatcatcatacaactgtacaatatgcaaataacttgctagatgatattactgaagattctacatccaattaaaataaaragagaaaacaccttaagataaccatactattaaaagatacagaagacaactggaataaatggaaagacataccacatttattagacaggaataatcatcattagcaagatggcaagatgtcagttctccgtaagtttttcaatttaatataaatccaaatacaacagatttttttcttttagttagattctgaggttatcattaaaacaaaaacaaacaaacaaaaaactgaacaagagcaaggagtccttaccaggtattaaaaacttccatagtgcctaaataattaaaatagtgagataccaatagatgaagagacagaccaatggaacagaatagaaagtccaaatgtagatgcaagtacctgtggaaatttagttattcgataaaggtagcttcacaaatcattgggactaagataaactcttgatttactggattggggcatgtaaattatggcccaatcatgccatgtttcttttctctggaaaagaaagtaaattaggttcatacattataccatgtaccaggctagactccaagtgaatccaaggtaaaagtgtaaacaaaactatgaaagtcctggaagaacacatagcgagttcctttttataaccttggagcagagaaagcctttctagtttcaactcaaaatccagaagccagaaaagaaaacattcataaaaattgaatttaaattacaaaaaaactttctgcatggccaaaaaccataagcaaagacagatgccaaactgagaaaaatatctgaaacttctatcacaaagagctaatctcccttgtttaaaaaaacaaagtaaaacagagctcctagaaattgttaaggaagaggctaacagttcaataggatttgggatgaagtattgaacagatagctcacagaagaagaaacacaaatagctaagcatagaaaaaaagtttgatttcactcatacgagaaatgcaaattaaaactacaccaagataccattttttcacttctcatattggaaaaaatccaaaatatttgataacacactctttggaaaacaaccccacatggctgggaggacggcagaatagcacatctatagaggagaatttggcaatatctctcaggttataaacacgtattctttgacccaccaatcttagagggggcatttaccccatagacttgcacacatgtgaaatgacagttgtgcagttgttcattgtagtgtttcaaatggcaaaagatgaaaatgtcccccaaattccatcactgagggaataagtaagttagggtgatagctcccaagcttattttctcttcagaatcacctcatgaagaaaatgaaggtctgtgkgatagtagctggcaggtgggcatggtggtgagggtggtgtttgagcggagacctgaatgaaggttgagaaggagccagccactcacagacacagaggaggccttcaggctgagagagcagagaaggaccctgtggcagagacaagctggaaacagcactgcttccatggtctggagactggaatatgtgggttctgcagacacctggggggggcaccacctggtaaatctgcctttcagctcttggttcttccagcaaaccatgccagctgtggctctgtagccatgtcctcggaagatggcagaggttgcaacgaggcctctctgaggtgctctgggagcacagaggagtcaggtggaacttgtggcatgttgccaagggaagaagtgatttttagacagaataggaatttgccaagaagagaagtcagaaaagcataactggcagaggaagcagcatacgttacaagtaactgcatgtgtacagggaatcactgagtgatggacaagggcttggcacttggtgggggggggtaccatgttaacatgttagcaagaaactaggtaggggtacttgacttgggggcagcagaagcaggtgtgagtgttggacaagacgagaactgagtgctgcaaatgtttggcaagacttgattgagtgcatattgtggacctgtgtctccactggagacacaaattagaatataacaccttgccctggtatgctcagggtctactgaggtggagaaacctgcaagtagagtcggagtacagtgttgaaaacaccatctgcaaccttaacacagtgctaccaaaaccgatttcggagcactcctgcaggaagtgggctggccagggcaagggaagccgtggagaacagtggcctctcccgggcaggcagggtaaggcctagaaagaataagctgagtgaaggtttgtgtgtggcccatccagggacctgcgacaggaacacagcggctgaggaacggatgcttggagaggagggggtgctttacatgccaggcgggcagggccggggtggggccagatgctggaggagagggytggccaaggggtggcagagaggccccccaggtggcaagtttgcaccctgttgcttcctgcaaggagcttttgtttacgttttcagcttggacagtctggctgtctggccaagagtgacaacgtgacttaccatcagagcgaagcaccaaagagcacataaatgaagtggagatccctcctgtgtccagcctccccctccccgtggccttctcctaccttcccagtcctccatcagtaccccggggccttgccagaatctcagaaagaatctctggactctggctcaggacctctgaggtgattatgcatctagaggcatccccaggtgctgcccaatttggggaagcrgcacttcccgctggaagctgggaagtttcccctggctgggggtcctgtgaggatggagaggccagaatgaggaatgggttgtgagtcaagaccaaccagaaggggacttagcaatgtcagatgatagcctgggtgaactacatcctgtgtggaaaaggcaaggtgtaactgcttatttcttgtcaagtgagcctaatatcatcatgtttctttttatgcctgctcccaaactcagcccctcccagtgagatcacagctccaggaacttgcaaggaaagggactaacggggcatctgattcacccgtgtgcccttaatggcgtattgtgtgaataaagcaacaatttttagyacagggatttaaaacaacttctgcaaagacagaactaaaaattaatcttaaaaggtggagggttggggtggagggcaggaaagaggaggaactaaattgccattctctttggagactttctaaaacctaagacgaagaagaggagccgaattatggaaacaaaacctttgcggttttccacagaacaaaaatgatgtgaagctgcaagtcagcagttctggcgcaggggctccgggggacgcccgctccgccggctgtggtgtgcgcccttcctgctctcccctccgaggggctgaggctccttttgtctggcgcgcgcgccccaccccgccccgggygagggaagagggagcgggcaccccgcgcccgcgccgccgccgtggaccaaggttgtttactactttccactccgaataacacgccaatcaccagggcccaccctccccgccggccaatcgctgcgttgggaaattccacctttccgcggggcccgggcagcgactggctggagtgtctgtcagtcaagtgggcatcccgcaaggatgcagcaggagtattagggaggcgatcaccagagcagaggaggagtaaccttccccataaacaagatgtgttcccccsactaagaaagcgggtggagggtggaggagccaaaacacatcccagccccggggccccaccggagcgaagcgggccgagcgcagagtgcagagtcggggaatccctccctccgcctcccgccgtcgctgcagttgtaaacacgtttccctccatgtctgttttcccttctctctcaccgtggccattacgggctgctgtttacaaaaatcctgcaggcctttgacaccccgtcctcccttcccccggcatccctgcccttattctggctttyttctcttccatctcctggtgagcacagcatactgttctcaggcttgttttccttttattgctctccatgtgggacaggtcatgctttatcaacatgtaccattttctacaaatgccgcccttcctctttaaattgcttggatgggcagatcgattttgattagcaacactgcagcagaaacaagktgcatctctggaaggactgggtggttttctcgttattgttgctggtttgggtcacatcggatgctattttaaattctgtgttttattccacgatgggtcttgaatcctttccctattcctaggtttgaaatatgtttcctccctttaaaaaaaagaaggggggcagtattgtgttgaaccaaatgtttttctaccttctcctgtgatctgaatcaggtttcccatttccagcagtacaatgtggttgtattcagtgtgataggggcgtagtggacatgaattatttgcgacagggctgcctggaagatgcggagcggagtttgcgtggcccggagcagctccagtgtctgaggcttctctgtgtcacaggctccaagcaggaagcgcaggcaaaatrgcaaaayacagcatgtggcattcagttcaaaaatgcccttttttagaagtcggtattctaaatgacatccagtcttgcttagttttttaagagaaaggaaaaataatctatgaagatggtttggaatattttgtgaaaagccttttcagcataaaaaagatgatcttgagggtctggtttgcggagtggaggataagcctccctcctgcgattctgaattgctttttggtttgtaggaatttcaggaacatgttgcaaagccgtggccgcttgaaagggtcggtgccctgcgccccgtctcagcccctgcggcccctgaactttttcagtgatggggcacttggggagaagtgcggggagtggaggaggaggggaaggtgcattgcaaatagaaatgtaaggcgtggcctgggtggccaggatgtgccagagcagcctccagacctacttaaatcccaggaaaagtcctgcctcaagttaggcacaacatctgacttggatttctctctgtttttttctcttccagttgtctgtctgtgcgccctctcccacaaggaatagttttccacactgatggaattaatgcatatcgtggtattattggtggaatatgtttaacctttgtttcgtgatttgagaggaatggttcttgtgtatcgtgtggtgacagcaggttaaggagagtgtcagagctggtgcagagttttgccccggggccatgaggttctgggcatcatgactctcttatgaagttacaaaackgggcaagtgattgaaggcagaaagacactgtaataaagtgtgctccagtgatgtgtgctccggcttctctcccttactcatctgggccaggtgctttcgccacagtgagcctgggtgtcccctgcctgagatgagcacagtgatgtctatgcgaggttgtaggactcagtgaagtgccttagggattttgcctggcactctcctgggctcmtgaggtgcctagggctgagacttccccttctctgtctggtaaatcatctctcccattctttcttctgcggcccttcatatgagctttgtaatttactcagggtggcagggtgaattcatcttttgctgggtttctgcatcacctgctcctttctggccaggtcagcctgttcattttttccatgccaacagcctctaagtgccagtaagtcacgtctgaacaaccaaagcatgtttccctgcgggagaatgccagggcaggcgggtctgggagccaagaggatttctcctgttcagataagtcgggggaatagaagagccctgtgacttgagacaagctttgagtgacacccagtgaatctcccatcactactttaatccctgccccagtgttctggttccccctttcctgcatgaggcagtacgagtaccctggcctggctttgggttctacacggtctgactttagcctgccttggtctttgttcccctctcactccctccacccctgccccccccaacacatgtggagtaccttaccctgccttcctagttctggaatggctgcccctgtgccaggccaccccattttctagaaccaccttcatacagcccctgcgcatcccactgtactatttccttgtttgtttttcctgtcaatcttgccttccgcgctaatgggacactgatgctgtatggtgatgtgttctcccacagtcatcttytcctcctgtggttggggtggggagctttctctgtgtccccccatgagagtgaggacagtctcatttaatggcaccatggtctgtggagccaggcaggcctgtgtgtctgactccacttcagcgctctcagccagcgtgggcacctcggacccagacagacgccccgagcctgtctttctggagaaggaagtagtaataccttttccttgagggagttatgaggattaactgtgcctggccctgaattcgtgccttgcaggtacttaggaagtgagttattacaagcagtgctttttatcatccatagatggagatgttatctaygctataggactgcagaaagaattacagagaattatgtagaatcactagggacttgattaatatttgtttacctttcccccacatggattgatgtcctttattatacttttgtacccccgcttggcaagcccttgacaaatattgatccaacaaaaaattagctctttaatgtatacgtttagaacctgttgctttgtcagtagtggtttttatgaaaatgaatgcttataggtcagacttctggaaaccctaatctgagggaattgggccaaataggaaagtgagccccttaaaggcagttgtctgaccagtacttggagcacaacaggttcttgctaaagcactgtgtttttaaaacagtggagttattaggttgaaattctgaatagcaagaaaaagaataatggaagtgctgccagccccgtgatgctggtgcagctggtcagtttgcagaaggaggccagttactagagcagagtggccgtagaggctgcaacacggtggccaaagcatgaagctgctgtatagtggcaaggtcacagtgatttccccrcagcctcggtttagagggagacggggtgtgctgagctgtgcctgcttctgtagaaggggccttctccaagtctgagtagccttaagccwttaggactgctgagtctttctccacaaaaatatgtgggaggcctgcagggcaggtgctcaactaagctctggggctgcaaagatccagagccatgcccctccttggaggcaggtccttgyagacgaggacaatcgtagccttcctgattaaagcaggaattgtccaatcaggctatatgacgggcatcgtccatagtcttcaccaggggagcttttctgactatacatctctagccctgtggcttgagccagtcacttaatttcccctgagctttggtttcctcctcctggtagcagagagactatcagagtgaggggcagatgcaatagcatatgtaaaacacttagcgttgggcctggtgtttaactgcaataaatgttagctcatattttactgtgacatagatgctgtatgccttttgctgagtattaaagatactgagctgtagcatgcatacttgcatgaatcagtctgctaagttattttaagtttgcatttgaaaataaagggtggattgctatccaaatataaagaattggaaccaggctctaaaaggatgtttgctgttctttagcaaaataccattcttcttaagtttcattcaatcattccacaaaaatttaagcatctgttttgtcccaggcaggcactgtgcttgtaatggatgtgcaatagcaaacagaacacttgctttcagctcacacagagctgactcctgggcagagaatttcgacagtaaagaaatacaagtgtgatgaaggagaaaccctttggtactacctgctacatgttttaatatttaaatgttgacttagggaggtctttccatctaaaaataatgatttgccctttctcctgtaaatgacccctttctcttaagttttgggtgagagattttttttttttaaggaagaaagatattctacaatcgaatgtacaactgagataatgcttaggagagaatgtatactgggtttgtgccttggaagttgcttaggggaaacagttgtgtgcagttggaaagctgatgctttaaagaagcttctataaagtgaccccacaattaaactgttttgtgtacatctttatttatttatttatttattttttaattgagacagagtctcaccctttcgcccaagctggagtgcagtggtgcgatctcggctcattgcaacctccacctcccaggttcgagcaattcttctgcctcagcttcctgagtatctgagattacaggcatgtgccaccacacccggctaatttttgtattttcagtagagacggggttttgccatgttggccgggctggtcttgaactcctgacctcaagtgatccacccacctcggctttccaaagtgctgggattacaggcgtgagccaccacgcccagcctacgtctttaaaaataaatgtaaatacccaaggctcacagttccgttcttccatctagtctagcaccgtccagtggaagtttccaccatgatggactgttctgtggatgccctgtccagtacaggagccgctagccacatgtggctatggagcacttgaaatgtggctagtgctacggaggaactggattttggatttttttaaagttttaatttaaatttgaatagctacatgtggctaatggctactggacatcacagatctaacacaggattaactgacaaaattctttcctcttaaaaatatgtgtttattttgataaggataactgagacctgtacattccatttttcctgtcatatttagggctcataaagggggtggtatgcacgttttaaaaaatgcaacacaaccagttaaaccagctgtctaattgtacacatttcctggagctgttggtgttgattattagcaaatactaagtacttgtaatgacctaagaactataagacaagcaagtcgtcttctgtaactgagtatcagcggattcaagcgttaaggaaaatgattaagagaaaacaaccaaaaaagtcttaatggttctgtcaatcaagtggctatcaattcatggctattcaaaagcttttgtggctatgaaaataaactagattgaaaaaattctaaaacaaaattgaaacactcatttgagtttaaaattttagttgagttgatttttatttcttgttttggttcatttgtagtttccccccgcttcgttgtttcctcagatatggagaataaagcctggctggtcagtttcagtttttatttaaattcattttrtcttcattccttttaatctagcacagtcctgtgatgtattgggatcacagtgctctggggaaacattgaaatataaaaacattttcctgaaaacatttccagttatatttaattttcctccttgaatagaaaaatatttccaacttaatcctccctctcccctcttgaaatgaattgcatgctttggaaataacatcaatccacccaagtacacaaggacaatctcagccatttaatcgagatataaaggcttagagaactctgggcttcggaggcacagactccacctttcaggatgctaataaacgtggacgaggtctcgcctgggcttcctcctccattgttcagcgcagcaaaccagcacagcactccgtggccagggtttgcggggagaaatctctcactctgttttagtagcatcatcatccttatcagcaccctgcttttatttttgaacagccaaacttcctctttccaaacttcgtgtgacatctgggaccagctatgtttgaaggagtctgaacatgccacatagtggctcacgcttttaagggaggaaggccagtaagcctcctcaatggcagaattctactttcagtctaccctttggttctgttgtggttgttccttagaactttattctgctcattaggaagcccagcctccggggagggtttagcttctcatctaagcaagaagtaaaatgtcataatggaggaaaaaaaaaaaaaagtccaaactttttttggacttttagaaacacatccagtttgagctccactgagctatcattgcagttacaaagcccatgtatattgagatcggtgtaaaaattcagcatgtccacctgcataattatgaccagtgtattgaaagcacatttcatttagttttgcaacagccgatgaggtagattctaccaacattgttttacggaagaacaaatggaagcctggaaaaataaattgtctacctcacacacttcgcaggtggtaaacacaggatttgaactaagacatacttgattttaaagtgtttgcttttcctttgcactactgcatctgcgatgtttgcactcagacactctagaatatttggtgttgcatgtttttgccccaagaaagaacccattaaaatgaaactttccagttcgtaagctttgccctcaagaagggaaagaacttcttgcaaggtttctgaaacaaaaagaaaatgaaaagtaactttactgtatctgggttttctgattaaattacggtttttgcaagcttgtgcatttctcagtgtccagatagccaggatttttccttttaataaatatcactttaaaaaacaaacacacacattcttaaatgcatgattaactgtatagattgatttagttataagatgtcctagcctaaatataagaaggtgtatgtgttagaattaatttcttcaataaagagaaagaaattcaggaattgtggttctgttggtcttctgtactgtatatttttgtgcagccaaagcagcatgccttgcttcttggtttcatgaccacatgggtagtttcttgaagttttttcttttgagatggagtcttgctctgtcacccaggctggagtgcagtgacgcgatctcggctcactgcaaccttcacctcccgggttcaagcaattctcctgcctcagcctcccgagtagctggaattacaggcatgtgccaccatacctggctaatttttgtatttttagtagagacggggtttcgccatgttggccaggctggagtttcttgaagtattgactgatccttgactctgaactgtatgatcaaagacttttgaaatggcacaccgtttcttaacatttaggccaatttcagttgctcatatccaaaaataagtcatgattttcggagtcagtgcgcagcacttagtacaacaatccaaacccttgtacagaccatcctagtagaaatgtggatcttgagtatctcagcttcttagtagattttgaactccgtgaaagcaggagccaggcctctcamagcaagtctctccaatatgctcagtaaatatttgtcagatcgagcaatgaccagatgatgaaatacattaaagccttagggagaactgagactactgcaccagtttttgtgcactatcatgctggaaatctttccaacatgtattctgtacttctttgcttcttactccagtgaatataatttagtcatttctggccaacttgaggacatcagcgagcataaattgttgtattatgcataatacagtgataccctcaaggctgagtgggaggcagtttgccctctgctgaaggtttcttgtgcttattgtgttcttatggtttggttttaycatttttatgtctccatttctgtttaatagacttatttcagtaagaagagaaagccgtctccatcagcmcctctgtaggtgattatttgccacttcctttttgctgtgagtgctttgaaaacagatttctaagcttgttagagttatgtgttaagagtaaataggcagtaagtgaaaccaagcttcttcctggtgcttgactaccccagaaatgtttatttgctgaatagttgagttctggaaaggtgaggtataaatgtgtgataaatttattcctttgcatgatttttttttctttttcttccctccctccctccctccatctatgtctctgtctttctctgaacatctctccgtctcagtctgtctctctcatgatagttgctggaataatttaaatgaatgtaactcatttacccacatcgaagcccaactcagtagtgaaaaaacaaatcttccaaatgaatgcactttccccttgatgtgctatatacaagaccttggcacacctagttcaatgacatagtattttagaagggcctccttacaccttcctctcagataaatatacatgcagggacattctgaagaagtttgttatcggtcttctcccctcctactattagctccgccctcctagtccttctctttcaccatgctgacccgcgtagggaggacccttacaccctctgcatgcagcgctggtgctccttagtgttcataaccccaacctccatggcctctctcgcagttctcaggttaggccctgcttctaggggacattagctttccaccctctactacatacttcctagttgttgcagcctttgcaagcaaaacttgttttcatttgggagacagcatggtctgacagagcctagatcctggggtgaagacattctgggtttgtatcccgtctttaccacctctgagcctctgatgctggacaagtcagcaagtctttgcaccttagtctcctttctgtaaaaaggagcttatggggatgtaatcagagaagccttagcatggctcttggtacaaggcacggaccaaatccatggtacgctcactcctttcctttcagtaatactgcctaaatagggcacatgtacctaaaaggattttgtacattccttgacagcagaattctcatcttctgttgcatatcccataatgctgggaacacaaaataaaaatggtagcttttcacattcacttttggcctcaattttttgttattccccaatgaggatcatttcatttggggctggtctccggaaaaaagtagatcaagcttttcagatgagatttgggtgaaaccctgacaaactcttttttattgccttccctaccacatagtggtggatcaggaaactgtagggcttatgatgctgggaaatttctgctaatgcaataaagatttttgctgttgaaagaatttgatctgttttatgtataacatgcagagagcagaagcatatattatctgtarcagatgatagagcagggtatatgggcaagttagaaaaacacagttctcactacatttgaagaaaaaggacaaggagttgtcacaaggatccaggagagtcgcacataattttctgtcgtgcattttgttgactgttcctctttgcatccttcaaccatcttaacttcccacttgcacctcgctggaagacaaatctaagctaaattaaatgctaggcaatatgtcagaatggaaagggccctcaacttgggatgcccggttctctaccagcctgaataaactccagcaacagtatttctctaggaatcatctgtaaaaagtagaggtttgtcatatctctaaactagggattcaccttatttattaagctatcagtgactttatcttgaggtgcayggcttttagtaactctggttcaagtgcaaggaatgcaaagttaagtgtatcattggaggtgggatttttgagtttgtcagtcatttattgatttgcatgtatccttatagttcaaaggtctttttctcaacttagttgatgatcatgctgtaagttgttttcttttgctttatcaacttttaaaaacgtttattaacttttwaatttgaaataatttcagacttgcataaaggttacaaagagtaccaggagttctggaacaccctccacccagcttccacagatgttaacatcttacataaccgtaatacggttatcaaaacagtgttcactccatactccagtgctgttaatctccagactgaattcggatttcactattttcccactgatgtccctttttttkgttccagatccaagagacgatcctacctggcatttattgtgttcagtttttctaattctgggacgttttcckgggttttctttagtcattcacgaagttcgcacttttggagaacatggggccagttattttgtagaatatctttctgttagagtttgtggatgtttcctcctkattaaatttggggggtacatttttaacttggagatcacagaggtgctgctgtttgtgtctttgcgcatcctgtcaggagatgcgtgatgtttcctttcctggtgctgttagctttgatcccttagttaaggtggtctctgtggcttcctccattatcattactatttttctctttgtaattaggaagaatcttttggaggtagatacttgagactatctaaacaagcattctgttcctcattattctttcacccactaattttaacatccattactgtgatgtttgccaaatggtgattttctatttctgttttctacacttagtaattggattctactctcaggattttatgtattttttaacagtgagggacataaactttttaactagcagtggcaagtccacttttatttgggaggacaattactagtcacatgaagaagaaaaaatatgcagaascttaagaaatcccacatatgaatgttatttgaaatgttcttgccctttctccctacaaaggaggtgaagaagatgacaggagatgttaattgccaaaatagtctcatagttttggtcctggctgcaaatctctcgtttttgatactcaagagaatgctattggggaactgactctgaagcacagcccagatgcttgagatgggttgggaaggtttacatcaacaccatgaatttaatttatcatgtgacattttatttctgagtttttaaagctgtaattaaaagaagtgttcaaagtgttgctttcctcttttagaataaacgtggctgggtgtggtgcctcatgcctgttatcccagcactttgggaggccataggcaagaggattgcttgagccaggagtttgggaccagcttgggcaacatagggaaaccacatcactacaaaaaaaaaaattagcctgtcatggtagcatgcacctgtggtcccacttacttgggaggctgaggtgggaggatcacctgagttcaggaggtcaaagctgcagtgaggtgtgatcatgcccctgctctccagcctggacaacagagcaagacactgtctcaaataaataggcaaacattaccaacatggcaaacaagttggaggaggccccctatttaattaaatttcagcagtcccaaatctaattggtatgaagaaatcattattcagaattttccatcactgaaatactaaaatcacttgttgtttgagacatcttggcctgtcacccaggctggagtgcagtgttgctctcatagctcactggagcaggagcctcaacctcccaggtttaagttaatgctcccacctcagcctcctgagtaactgccactacaggcgtgtgccaccatgcccagctaattttttaatttttcgtagagatggggtctgtgttgcccaggtccctcttgaactcctggcctcaagctatcttctccagtcggcctcccaaagggctgtgattacaggcgggagccacagcgctcagcctaaaaataactctttagccaaaagaaagttttaaaaaattgtctgttgtattctttgattttactctatgtggtcttttctattatttttaaaataaaaaagatttatactcctcaagtgtaacattttatcaaatctcatgcttctgtttgatgaaaccgaatggctaaattttttaaatatcatgcaatccatcccagtttgtaattttattatggccctcacacaagagcgtgcaagctatactaagcttcctgtggccctcgtttttcctcactgatatttgtaactcattccaaattaaattttaggagtctgaaatgtagctgttatatttgggagatgtgaagaaaagaatcgtaggcatctcagtaggctaggtatcagatcacacatgcttgctggaccaaagaggactccttacagtaggatacatgattctgagttagtttgtgtactaagtatatactatatagcttttgaaggggagacgggcacagaattcacaatatcatgcactaagggttattttgtgtttgcagtttccagatgaatgttttaaagttggctgcagaatacagcgagataggtaaaatctatttgagtattacttacagaccccaaaggatatcccaaaggatatgttggactaattcctaaaatatcctgtaagtcattgcaggtacaggcgtggatctgggtttggaaacgccgcctggatcgctggctgggctcctgcagccgccaaggaggggctggctggaggtggggctcggcgtgcatagcggccacgtgactgcgccccggccacgcccaccgtccctcacgtggtcccaggccacgctgggcttcggcatgtgctaaagtggatagaaaagggagtggggcccgggcgtggctttgtggtttgggaagatatgaactccttggggtttttttctcttttaattctttaattttgatatttggaaatgcgtaaaaggtttttcatttgtccttgaccacgtggtccaaacctcaatttccctagcagaacgcggtttcgatcactggtggatccgtctcacagcaccrgtcatgctgcctcgctgggaagtggagggctcaggattcccgtggttcacgatccattttatgttggaaggaaatcattttgaactatctcagtacacaccctagtgtatctttaaacctaattgagtgttgatggaaaatctgcggtccgagaaccgtaagaaaagggggctcccacctcccgctctggggtcgccacttgcctcgcaggcaggaggaggctcccagagtagatacaacttgcccgtcaccyggatgggttggtagtgcacatatgcacggggcgcagtttaaaatgaaagtaaaagatgcaaatgtgtttgcaaaagaaaaattaacataggatacgtgcgggcgttctcagttgaactcggtcttactgttccacgcgagcaccccatgactcagagcccaaatctcagcggaacagcccaggacgctcctgccgtccacaggaagacgcctctgtctctgtcccccgccgccaccacacagatgcacgtactctcttcacttccgtgtacccagtaaatgcagatcctgatttaaatctgcagcaygctgctttcttcccattgcatgtgggaagcttcaggttctcttcggtttattttctcatcacctttattaaaatgcagtaaagcaaggagtatattaatgcgggcctctgcaaatagagggaatttattgaaaagcagaatggcttgaaagattgaacttcatcttaaaaatcagaaacagactcttgttattaatagctttagaaacgaaaatctaacttctgataaattatttcagaggagtggttcaaacgtgtagtagatagctctgcctggtcatcaattatagtgacgtccttgcatcagctccagaaactcagaatattcatgagctttccagtctgactcagaccttcaggagccatgaaattttcctgttgggatgagaggaagcgctggcggtcgtttcggcagcttaatgaaaccagaaatagataagcacgagtgaggggtgatgtccgcttgtttgctcccatcatgttgtttttaatgtgtgaaagtgaaagttttaaaagtcatactaaatgtgtgatcctttttagaattcactgggtacgggtacgtggaggaagtgtttttgtttttgtgaatttgtttaaacaaatgactgaggctttgttttccactctgtctggccaagcaccattgctacacttttttaaattcatgacatcctgagcagtgaagctgttcttcagcccgcctctccatttgtgactggaagacaaggaggcagacaccaatggcgcctctcacaatggaggtttatttttttttaatctaacggagggattgtagatggtgtaaaacttccttgtgccaggagagaaagggggagagagagagagagagagagagagagagaaataacccattctaaacaactttaggaatagatgatccgtaggcatcaactttgcgcagcaacaaaagccactttctgaacctcgttctgtgaagttttaaaacaaattgggtttgtttaattaaaatatttcttaaaggcaaaaagcactgagctaatttttaagaattttaagttatatattaatatgagtagtgatttataattttctgttgaaatacataaattcgagaagccccacccctaccacttgccagtcttgagtccccacggctcctttgcctaggtctaaagtcactgcttgcacactcctgccttgcatatgccttgccatcgtgtgggcctcttggctggaagtgttcttgtcctcccgttaggtatcttttatgacgtgaatccttacctctaattattatctgtgtgtacatctcatcacctgcatctgactgtgtgccttgtgtatgtctcttagccctcacaattgcctgacatgccttacaaacgggtagaccaagtgttaaatgaacaaatatttaataagaacttaaaagctttttgactttatatatttttaaagccattgtgattaaacactatgtttgatgtggtgctaattctgtgctttatcaactgtgtgaattgtagtatttttaaagtaggaataattgagaaatattttgaagttaggttaagcatagcagtaaagtttccactttttaaaatagccaaatccaggccaggcgcagtggctcgtgtctccaatgtcagcactttgggaggccagggcgggcagatcgcttgaggtcgggagttcgagactagcctggccaacgtgrcgaaaccccgtctctgctaaaaatacaaaaattagatggttgtggtggtgcatgcctgtaatcccagctactcagagaagtgtttgaacccgggagttgggggttgcagtgagttgagatttcaccactgcactccagctggggcaaaagaatgagtgaaactctgtctccaaaaaaaaatcagagcgtggtggtgcacacctgtagtcccagatacttgggaggctgagatggaggtcaaggcttcagtgagccatgatggcaccactgcactccagcctggacaacagagtaagmccttgtctccaaaaaaaaaaaaaaaaaaaaaaaagccaaatctgttgggtttttttttttgggggggggggtcctttagaatggccctgacagatctttaaggcatggaaatgagccttatgcaagctcctggcaatcagtatgtgagttctgtctccttggcaagatacagcctcttagaccctcagtctggggaaataatgctgatttctcctacgagttacgagaattacgctagaaaactctgtggcgcatacaggtgccctgtagcctgttggttagaagcactgaccctgaagtcaggtcgcccaggttggaattccagctctgccttcttcaagctgtgtgactctgggaagtcacacacactctctctttgtgcctcaggctctggttctgaagatgggaacggcaggccctccctctttggcttgttgcacagatgaaatctgacagcgtatgccaagcgcttagcacgggtagcagtgagtgccccgtaaatgttaggtaccttcctactactactaaacattcattcttcccttccctgctagtacctgcagctctgactcatctcacacccttgagagaggattatcttcattaaaaagtttttggtctgcccagaagcaagtgttacctgtgagagagctgggcttgtgcataggttagattatttctttgggttattcctggggaaacctgcaaagaaatgcagccagaggcctctggttcattttactgctcatctcctaaaagtggtttctcagatttttatcctttttttctctttttcgaggaaggggcaaggaaatattttttcatattattcttgtcatcgtctatttatttaataacagttgactgttgaaacataggaaagtacttatccgccaggaaactcccttctattattggacttacttgctttccatttatatgttgtctaattccaaagagatttcgagacagctttcaattaaaaaaaacaaacaacaacaacaacaaaaaaaamcaccacatrccgcatgggtattacacaggacctgtatggtcaaattggcaacgaccacaccacatgagaaggaagattattcttcctggaacctggctcccttgagattcttttttttttttttttttagacggmgtttcgcccttgttgcccaggctggagtgcaatggcacgatctccggctcaccgcaacctccacctctcgggttcaagcgattctcctgcctcagcctcccgagtagctgggattacaggcatgtgccaccacactcggctaattttgtgtttttagtagagatggggtttctccatgttggtcagggtggtctcgaactcccatcctcaggtgatccacgcgcctcaccctcccaaagtgctgggattacaggcatgaaccaccgcactcccttgagrttcttgtaagccaaggcagaagaagagacatcttaaagtctgtatgtgcacacctgcctccccccattttatatacaattcaagggctttgcttttggaaagtttgcctatgtagtcgtccagggctaaattaacacctgtctctatctgtgtgtaaggctctctgggaggagctgtgaggcaaataaaaataaggaatggtgtcccgcaaggagcttacaatgtgtgyattacaagtatatactgagcatggccctgggaacacagtgaaaaaacaggattcctgccctagtacagtgtacactagtggaagagagagaggcagtaaacctaaaagtaagtcttttaaaaactgtggtaaaatgcacataacataaaatttaccatccaaccgtttttatgtgtacagttcagtgacagtaagaacattcacattgttttgcagccgtgaccatcatttatattcagaactcttttcatctcgcacaactgaagttgtacctattaaacagtaactcctcattctctcttccacctaggccctggccaaaaacaaaaataagtctttgattgtaaacacgatcagtgctttgaaggagatgggaaggatgttatcataaaatgatggggctgcaggaatggcacctactcagagagggcggtcaggagagacctcttgggaatgatgacatccagcaggcaggtcattaaggcatctctaggcaggtccagagtgcaaggaggcataagccaggcaggtggaacagcgtgtgtgaaggcccagagtcaggaaatggtctgcttccttccaaggaaaagaaaacagccagtgtggttggagcaggggctaggagagaaaagatgtgcatgtgtgtgtgtgtttgtgtatccccatcatgatttagtactgtcagcgcttctgtgttctgaacctggagtacaggcagacacagccgcatcccagaagctcaagagtgcccataccaggaaattacagaaatctttgccaaatggatgartgaatgcaacttccttgatacagggtcagagaggggaaatctgagaaaagcaggtgggcaatgtactcctgacatactcccttccgttgcaatggccttgagtgatggagcaagagtgaaggaatgttcccatggcactggyaccaggatgactttttgtgaagcagagcagttggtcttagatagtggaggtgcgggaggcatgagaactgggcagtctgacggctgcaccagccagttggctgtcctttccacctccatgcccaggagctggcccagggcgcgcatgcacaaagccagtgctcttttcaatcagaaaacagcctgcgtatgttcttgcttgcaactcagatatccagcccactgatccaggaagagattcctttgacctgggaagtcataatggcagatatttaracccagctctcaagcaagcmtccaagttgttccggtgaaccygtaactttgagtaacctctgattgaaccagagagtaggaactaggtgcagaaccttgttgaatagaattgtttagcatcgtccatttgttagagcatttcaggatgcctgtcctaaaatttggtatcataatggtatttacctctcactcacctccatctcagcccagtaattaataacaagggacttgcttcttcacctgtttctttattggttgtaggaagtcttttccttaccacagaggaaggagcttctggatccctttgctacgtccagagagttttcatctaatctgggtgtattagtccattttcacactgctgataaagacatactcaagactgggcaatttacaaaagaaagaagtttattggactcacagtttcatgtgactggagaggcctcaaaatcatggcggaaagtgaaaggtacatctcacatggcagcagccaagagaagaagagcttgtgcagggaaacttccattttaaaaaccatcagatcttgtgagacatattaactaataacagcaagggaaaaacccaccccatgattcagttagctcccggcgggtccctcccacaacatgtgggaattataggagctacaagatgagatttgggtggggacacagagccaaaccatatcactgtgtaaaagttgaataaagttatttaggagcacattgtattgggagtttgtttgtttgttgaagagccaagtaaagtcattggaagcatgggaaacttttttccctgtctaaaaggaactccttcctagtggaagttgaaagctttcttggcagcctcagcccccaccctacctccaccaccccagtgggtacctgcatcctgaagacccttcacaatagcatctgaactatactgggccttcaaatgatgtcttgggtaaacccatgtccaacctgcactaaatgaagattattttcgagcgaatggattgaagaacagtgctgaaaaactagaatttgtaatattttcatttgagcagaggtgaaatttgaaatattttagaatcttgtcttatgattttttttctttctttgccacatagccctcccctggaaattaaatctgtggattactagtatatgaactgatcagagacatggcttggggtctccccatttacccacttcccagcacgttataatccactggacacctccaaggatgagagaccagcgggtcataatgcgagactggacatctctcctaccccatgtacacttcagctgagcaggcagaattagcagagtcaggactagaagttcagtctagggatcaaataataatagtagctaatgtttaaagagtacctaagatccgccaggagacatactcagtatagttccgtggtttgccacatttcatcttataccagtagcacaggtgaaatttgtcttatgtgtatactgaggaaaacaagtccctctgatacacagcagccaataaatgacaaagctgggatagaaacttacttcattctaacccgagagtccctgttcttgcatgggcacagcctgccatccccatgctctgcctcctaagcagaggatgaacttaagcatcttaaaattttaaacattgactttccctaaaaccaattaaaaaaaaaaacaaracagacagacagacatgacttgtgcccttaaaaatgcagccaggctggcatataaatgggcgtaggctgtttctaaattttttgctttaaattttgccagcatagcttctggactggtagttttgtttgctttttaatatatttttgacactgtgtacagaggaatgctacctcgcgtcatcatgtcctcctccctgaaggcaagccaaggatgtcaaggggccacttcaggggatgtgcaccctgaaggtaaagctgctccagtgggaggggttggggtaaatgacaatgttagcagctggtaaatttttttacatgggatatctcacaagacttattgatgcatgttatacgtaataacctgaggcacatcaacattttccactttttcctattctttctgtattttcactgatactttttttcaaaaaaatctccaataagtttaggatcagcttcaagatttctctttaggtaaatagatttgtatttttgatggccatcctagtccagtgtaaagatatggacaagaaaccccacataaaggaagcaagatygctggctgctttctctaggtagcttgagttgtatactaatttgtagattatttctcttcatcgaaaaaacaaaacattctgcagagggcagtcatgtgtccgctgtgcctctgctcctgtgtgcaccataaaacttgaaagtgagccagaatttgaaartatcggattgggatgtgatttctttaagcctctggctaatttaatataaagtgtttacacttcatttttctggcagtggattttctatgtaggtggtggaagatttcctgtaagttttgcaagttccagggcaaagagagttgcaatatgcaatatctttctgtggtcacaccaacagaaagggcgatttcttaacctgctgcagttaccatgtgtgtaggtggatgctggctattacagatggtatcctttcaaccctcaaaattgttgcaagttcacaggtatgttaatgaaaatgaataagtggcatttttaggaattccaaatactgagtcttggaagtagataatcttttccctaaatgtatgctccggtcagaactgctgcctaccacacctcgtgggtgaaacagatatttcgagcatgactgagcttattaagagccctgcggcgcttcctctgccgggggtttagaaatttcaaaggatgggggttgagggagggaggagttatgggcatgtgatgtggacagggcgggcaggaggatggaagtaacaggtccaaaatrtatctttggtggcccggcagagctcttgcatggggtgagaatggtaatttaggaagagcaagtcttcccatctgtgaagcagaagaaaaaagtggacttaaggagaagttcgggtgctgtttatttagataggagtaaggagagtgcagttggggaaaagcacttcagaggctttacttagactagcagaagtctgtttggcagggtgggaagcaagtgcagttgggagaaaaacgttttcaataggcagtttcagaattggaaattggaggagggcagtccatttcaacatttccaacagtattaaagaaaatttgcgggttgtttgtcaaaaggggtcatatgctttaaagattgagagatcttttcggtgaagtaggggagctggggacatcgtgatgtgacaagagccgtgggctcagaggctggggacctgggtgtttaacccaactcttgtgagtggtgtggctttcatagctttggttctctggtcttcactttatctgccaagtgaagacatttgactggatgtcgtgatcttgagttgctttcagctccagawttcgaagaccccttccattgggcattcatctaatttcaaagatgctccctggctccagctctgcagtgaagcagaacaaactgatacagcctagcttgggggtggggagtcggccctccttttcccctcccttcccaggtcctctgggtgattgggggaaactgagaagccgttctcttctccagagcactccatttaacaagcattgcagagcctggctcgtgctgcagtgaacaaatgctgacttcagcctttaccctgggtttcaggtcacactgattgtttgcaaaacatgttctttttttgtcacttgccagtacttgttctctgtgagtaaaacacaaacacatcctcagggatgttgcacaccagtttgcagcctgcagcttctgccctctggcctgcccaggtcctcggctccgggacgaggatgctccgggatttcgggagacagcagttgttttgacatgaatctcaaagttcctacaaagcttatttctttgaagaaggccaaaaaaaaaatgaaacattttcagatctttgttttcagattattcaagtccagaatgttggataagatttttgaagaagagatttatgcttgagattccttttagtttctttctttcttttcttttcttttcttttttttttttttttaggtgacttggccagtttgggtttttacggtgttcagggaaagggttaagaagttaatttgggaagtacagtcatgtgttgtacaagttgctgtctactgatcccttcattgagcaagtaaacttcacacattctcgtgtctgcaaagcatgtggatgcatgggcagttatgtgtatgaactttttttttttttgagaatggctttagtgttcagaccaaggatggaatgaaagatcacgtgtgctttccactgtagagctgccctgcttgttttgattttatagttattctaagtgttaagttccttcatctttcaaagcaaattcctttgatccctgaaaatcagctaatgtttgggaggcaattaaaagatgaggctgtggggttggggtgaaggcttccccagcaggaagagaggagaagcccactggatctgggagcacggtgctaggactctctaagcgtgacctccttcagtttggcccagagtggtcagatagtttgccggggcataggatggatgacaggcytcatacgcatcacgtctgaagggaaagcccttgaattttccacgctactttttagtaacagtaggctttgtcataattggcttcatgttccagctttcctaaaactgtaagtgatgttgggtgggccagcagcaaaataattcacttwacaatttgcatgatagtctggaatgaaccgaatacctaaaaccaggaaataatagtagatatttaatggtttggggatcaaataagaatttactcccagatgtttcctaattaattggaaaaagcagaaggttgctggaaggccatctccattgggcatttacaggtgaaattcactcttcaactaggattttactcatgggatgcctgtgttcttcatttgaacccaattttacctatcatctacaaaaaaagaaaactattaagagttaaaaaaaaaaaaagagagagagagtcttgaactttgaaatccttcatccacgttttataaagtgtggggtcagattttttccctagttgaaattgaggaaatgagagttgccaatatgattggatttgtactgccaagatggggttttagcacttctaatgcattctggcaaggctggtatacttgtatcaagtgcacagccccactaccaccacctctaccacccacaaaaataaaaactagcaaaataaaatatgagccaacagaattctgtgggaatggcaagtgttttgtttttgtttttagtagtaatctttgcgagaacattccaaagatgatagttttacatttgtatgtttttttccgaggcacttttgaatcatcagatagattaaatataagttccrtgtatttttgaaggtgggagtgttctttggtacagttcccccaaaaaactggttctcatgaggcttatgtggtaattctgttaacgagaatgtatgattatctgggatactctgttctgctctccatcctggataagagtttactttgaaagtctagttgatcttttgtgatttctgcacaatgtaaaaggtactttaacttcaggagatagggccagcaatcagatttgatgatggaaaagagtagtgtagcatttaagcataatgtatactctataataaatgtttacaagtccaaaagtgtgccatcagaaagtaaccagatcaaaggagaggtgaccagagaagctggaaagataagaaataaacaagtttcaaggttactgatctgtagctgttgctgtccatgcttcttggcagctttaattatgacagggagagggacccagagggagagagagagactgacttacacataaaggcattttatcacaaagccatctaaaacaaaagtgttaaaggcacaatgctgtgtttaaaaagcatgtacttctttaagagctcaaatttaaatatataatacaaacttaagatccaaggaagaaaatggacccaggacacgaagagaagttaacgccacaggtaatgcagatggccaagagatgtgtgaaaaagataatccagcctcaccaacagccacagaattgaaatgagatacctgtttctgcttctggcattgggaaagaaagaaaaatggcactagcagccttttttttttttttttttttttttycccaaaaaatttgctactcttgaggttctgtcaaaraatgtgctgtggcctctagaagcatttttaaaaagagactttcacaagtgattgtgcaaaattgtgaggtcactgaataggtgtgtatcctcctaaggaggtagcgttggaggagctgttcttgttcaatttactcagcacctgtgaagaggcttcactgtgatttgcctgtacaggtgtgcaggtaaaaatctaagttccacaggtagtgcaaaaaaatctacctccctaggtacctcgtacatttatcacagtttcctggtaaacagttctgctgttgttgacaaaattttatcagaaacattgcatactcttctctaaatagtagtttccctacaagtggctgtcttcagtttagtcgtttaagttatgttgacataaatgattatgtgtgtggcaggggcttttgcgtaggttgttgaaacattgcaccttttggactaacagtttttaccaaaataggcagaagtgacatttgcagccacagctgtgtggcattgagcgtctaaggtatgtgtaataggcagtgtatcggtagcattgataccttggtcaacaccagtaagccatgtaattgcccagaagtgggctctaacactagttttaggagatgcagccaaaacgacaaagctggaggcctctccctctgagcttggcctccacttggtcaaaacagtccccagtttgtccctacgggacacaggcctgccttgttaggaaatcagcaacatttaggagcccacaatacctcacataactctgtgtacagtaacagagaatggaaatagggctgtaagcatgaacaaccagtcaagttacaaatatagaatactctctcaattccactttagttagtcatggagggacagtgtgagttttataaacttataaggaatatacaaacagttccaaatttaaaataacttgaagtaacttttaagtgtgtgaaaagaatatttttttccaccctgtccatttaagcatctgtgacaggcagtattaagtgatgggtgtctttacgtacacatgcctgttgctcacagtactggggaagagttgcaaaatagtcacccattctgcagtgatttctctcttcttatttgtgaaagactcaaaaaaaaaaaaaaaaaaaaaaaaaaaaccaacaacaaaaaaaaggccaggcacggtggctcagacctataatcccagcaccttgggaggccaagtcaggtggatcacaaggtcaggagagcgagaccatcctggctaacacggtgaaaccaaccccgtctctactaaaaatacaaaaaattagctgggcgtggtggtgggcgcctataatcccagctactcgggaagctgaggcaggagaattgcttgaacccgggaggtggaggttgcagtgagccgaaattgtgccattgcactctagcctgggcgccagagcaagactctgactcaaagaaaaaaaaaataggggggatgtgggttgtgagagcgacactgtgtgtccatgcgtgaagaaacccggctcatgatgacctcgccccagaacgccgaagcagggccggtccagcctggatttcacagtgttcttcattgcctttgtccttgattttttgtcgttaccattataacttatctctctttcccaaatgtataagtaggctttgaatatgagtttaaaagaaagaattcggggatgatttcagagtacactagaatattttttaaaagaatattttataaaaatacagtgatagtaaaagaagtagaaggccaaattcygcccccagccccttcttaatattggactttattcctttgcttttttcccttgctgccatctaaggaggctttctgtgctatagcatccagttcctctgccaggcatttctgtaaagatgaggcaccttccactgttttattctccatcattagagcacgtgtcctgctgactcggagcagaggggaggcacacgggggtgaacattccctgacagattggatgtctcttaactcttttttcctggtatcaaagaatggcacaatttagttgatttgatagcgttaccaaatcgtttttcctttagaatgaatctagaatgcagatagattctgaggtccagatgggcctctctccaccaacctgtgaccagtgtacctgtgattttatcactgcacattcatagaaaggttacagggctaatcttcccgtgatatgaatcatgaaagtcaaaatttatgaatgaaaataaraaggaatgaagtactgatatatgccacaccagagataaatattgaaaacattacctatgctaagtaaaagaagccagtcacaaaagacactacctattgtctgattccattcatgtaaaatatccagaataggcaaatctatagcgacgaaaagtgtaatagtgattgcctgggaaaggggcgtgggaagcatggctaacgggtattgggtttttctttggggtgatgaaaatattgttaagattaattgtggtggtgtttgtacaactctctaaatatactaaaagctaccaaattgtacactctaaatgggtgagttatagggtatgtgaattagatctcaataaagctattgtaaaaaatgtgtgaaggaaggggaagcatcctataacctataccatcccaacagcccagctagaggacgattcctgagcctccttctcagcctttgtgttaattctttgcattgatgacttctctctctttacccttactaattagctctcaaaacctctatttaataatgatgctatttataactttcctccttctggtttcttgcttgccctttttgtggtgtttgcttgtttttcttttttctcaatactctgcccagcgttgcgtgttggttccggagacttaagtgatccagtgggcactgtcaggcaattatttcttttgctcattaattaagtgttcacagatacattcagcagccaaaccttgtggcatgccttctgtcccagacagtgagaatctacttggaacttggatatttctgtgagccttgattatatacaccaccaaggggatggcatagaactaagttttttcttcttctccacaacagactttgttctttaatttcacaagcttgacatagcctataagacatcatagtggtaccatagacagttttcccttgatgcccatgggggatttgttctgggacctcccacagataccaaaatccacaggtttatcagcaagggtcactgctcaattgcaacaactgaagcagaagctcctctcatcagaggcagttactgcagcatgttctgtagggcaaatataaccatatgtaagtgactgtgctatcaggagacagaacaacaagacccagaaagactcagtgacccacagagccagttccacccaaacaagtcttastaatgagattagataatgagagtgtattttcttcatcaattcatgtagctcagcaaggctggaaactgcttgcacacttctgcagagaaaaaaaaaagttccatttgctggaactcaataaataaagaaggccttagtgggtacgtgttatctccttagcatcacctggatgcctgacccttttccagagtgtcatgttgcctgggttttgtccttcagtctaagtgatacacctcttagtgtggcggagaaaagggtgctgtatttcttcctgatggatacatgcttaaatggaaaagtagcatgagatgaactcccatagccccttccttttattatttttaaaatattcattcatttatttatttatttttgagatggagtctcactctgtcacccaggctggagcgcagtggcgcgatctcagctcactgcaacctccgcctcccgggttcaagcaattctcctgcctcggcctcccgagtagctaggactacaggtgtgcccaccaccacacctagctaatttttgtatttttagtagagatcggctttcaccatgttgaccaggctggtcttgaactcttgacctcaggtgatccacccgtctcggccttccaaagtgctgggattacaggcgtgagccactgtgcctggccggcccttccttttagacaatagaaacatgctgcaaccacataccaccataaacacggtgggggaagaggctgcaatcaacagtcaggaggatctgggttccaagcccaggtttgcagtgtaacagctgtgtgctcttggtgygaacatttggtcatgtacaaatgaggataatgatactgcccccttgtgatcattagggggattaaattaaatgcagaaatatatgtgagatgcttaatgtgttgtaaggcgcatggaatatatttagtgaatattaactgtatattaatacaaagtcctgtattcagaatctccagtataaattacatttatatagtagagatatgaatagtttttgtgaacaagaagacctggaacttcaggtgactagaagctcagagtgagccagctatgtttgatgatagttattcttaagatcacacagagaaacggcaagcaagctgctttgggcaaaaaagagcatttctacactgttcagactgcctctgtactgttagaataggtctagggcgtgttgcgtgagtggtgactgagtaagatgttcagagggaagccgtgaccgtcatcttggaatattgtttgaaagtctgacctgtacaaagcagcactcacttcccctgcgtgtcagacacctgcatgagggctggggagggtccagtacaggaaagcgcatttttaatatgtgtatggaggaagttcgtcaagatgggtgccatctggcagtggagtagcacttcctggaaagtaatgagctcccttggactttgtttgaagagtcacccaggtttttgtaaagaagtgtttcagatcagtatgcaatggatgactgtaaatttctcttcagatctaagaatctgtgaytggatgaaagggagaaaggactgcataagtgcttgttgcttgtaaactgggccaggtggatgtcatggccctaggagcttcttgcctgcctttgcatgccataaagcagtcctgcaacccagtgtcacctcagagggatgggaatgtagaagaagagagtgaatagggacagtgatgaggggtgaaaatatgtaactccttgccccttctgtataccctagtacattaggaagttcacccttgtctaggcttcctgttaggaagacagcagactcaaaatggagtctcaacccctttcaaagactgcaagatctccttgtacacactggacttgggagaaaatgagagctttcaggcctgctatcttaacaggttcagaaaggtgtggtccagccccctgactaaccagccctgctgtgcacactgagaattctgctcaggtgtacctttctgtgtgctcctgggtgcacccccaaagtgctggttctcttgaaaacctttttatttaggttcagacagacaaactgtggtatcttccattctgaccataaagtgtttcttctgggtctaactactatagtgggatattttctctagaacaagaggttgtttctttttggcattgagaaatgttgccgatgtgattttcttttgtgaacgtttaagacacagcgcttgccacttgaactttcttttgccgtgcgtagctgattccacataatggctgcagctccaggcagaaacctgtttggaagttgttttaaactcttcctggaatctctaggcagtggctcagtggggtttttttccaaccattccttaggatgaccagaagcttgacagaatcctcttgtcttcattttgagaaaatatgtctttactgtgtgtatgtgcagcatttggttttacctcgtgggtctaagcattttcaactaagcttccttttccaacctagcagacttgtttaaagaacttcaaactaatagccaagctgtaatacggtggctctctcagcctgagaagcctgtgctcaccgtcactctcttcttccctggggtgatagggatggggagtagtgtgtgtgagaggacagaagcgaggattgattgaagattattttacgaggcgagagcatggtggcacacctgtcagctgagtggactcagcgcctgccccggctaggctgtcctcctcctgtgccagccgtgggttccctgagtccctctgcagtcattcatgggtgctgaaaataaagataccctttctgtcgaaagtgttcgccgggctgcctctgcctccctggaaaagcagcagggcacacaggcttcctaggcagcccctgagggaggggctctttttattgtcactctggttagtttgaagaccagacagaaggcagcaaaaaccaaccctttgttgaaaactctttgcctttaggcccttggtaccatgttcatgaggctccagataattccacaaatacattattattgttacctagacttggggacagagaagggtgaaacatgggtctgggaattcacagatgaatatactgtaatcccctcgagcacatttcttttaaaggaatgggggtattctaaaggagtgaacactccactggggggctgctaggcccctgtgaacggtggcagccttggccacggtgtgtgctgtgatctctcctgggtcccccgggcatcctcagacctcccccacacccaacccacagtcccttctccatccatctgctgaccacaccccaggatgtttccagctcagatcacgcctgattgcatccacacaaactgcacgccaggcatttccgtttggatgtgtacacaaaaacaacacgtcccagactgagctgatctttctgtacccctcaaaagaaaagttctgtacccggccaggcctggtggctcacacctgtaatcccagcactttgggaggccaaggcaggaggatcacgaggtcaggagattgagaccatcctgggtaacacggtgaaaccctgtctctgctaaaaatacaaaaaattagctgggcatggtggcgggcgcctgtagtcccagctacaggagaatggcaagaatccggaaggcaaagctggagcttgcagtgagctgagattgagccactgcactccagcctggtgacagagtgacactccgtctcaaaaaaaaaaaaaaaaaaaaagaaattctgtacccttccagatggtcctggacatatcttgaatctaccctgcttttcctcatctgcactgctgtcctcttgatctgggctactgaggctagaatgcacatctgatcatgtgcctcctgcttaaaatagtatttttcctcttaagagtagtccaaactcctattgctggattaaaaggctgttccaggctctccctacctcagggcacaccatctttcctcccagtctcccctcccctctgtctccagtgcttccatccttcagtcatgctgaggttgtctttgttacctttgcttctcttggcccgcactctctgttggctctgccagcatccctatgcacctgctagctcctactcacttgtccagctttggcctggaagtcccttcccctggcaggcagccctaagctaccctttgcttgctactggctcatattctcactgcttgtcctcaggctgtgagccctgggagggctgggctgagtccccgaacctgccacgtctatagggtgtaacctacctgaggcctgactgctaaaatcaaaagaagcctttctcatttgcttagctgagctaagtcctttctggagaagaatgcccacgtcctgggtggacttctgttcggcctggggcaggacgctgcatgtcagttcacctagagcccctcgcttgccctcacccctctccctttccttctcctccccgtgttgtctcatggtcagttcctctcctggcaaggcaagagaatcataaaatctctttggaccatgtgtctctctgatgcactttggaggttgaagctcactttcgtgaagttaggagcggttaatcctcctgcacgaggatgcatgcctgctagggaaagcctccctgcgtttatatggaacagtggtgtgtaccttagggcaacccagaaacagctgagatggccctaaactcttccgtattttgattcagaagctttaccttatttgaacatctgcagaataagttctttcctttagaaatgattggggataaaattgtttgcattatgaaatattgtatggccaggtggcccctctttcatgttttgttccttgtgaagaggttgagtctcctattttttttttttttttggagatagagttttgttcttgtccctcaggctggagtaaaatggtgcaatcttggctcactgcaacctccgcctcctgggttcaaacgattctcctgcctcagcctcccaagtagctgggatcacaggcacgtgccaccacacctggctaatttttgtatttttagtaagagatggggtttcgccatgttgggcaggctggtcttgaactcctgacctcagttgatctgcccgcctcggcctcccaaagtgctgggatcacaggcgtgagccaccacgcccagcctatggtatgcttttaaaaatggtttctctgcactaatgattatttaaaaaaaaaactctggcaagaacaaaaacaaatggttttttaaaaactctagaaataatttgatacattcgaggactctggagagggagagagttaaaggctgatgtgtgtgactctttttcctctccccccaaggaaaaaaaatgaagagaaggagcttttaagtgcagtgcctcgtttttatgtgattgcaaacctgaaccaatccttttagtggtggatgtgggacatgttagcttttccaacagtttagatgggcctttgtttttattgttggtcactgtaagaattccaaggaatagaaggatctcatgggcaaaatcagtttgcttttttctctgtatatttgttagtttayagcagcttctattttcctcctatttttaaaagctgaaatgcctttaatcgcactcagtgtgtttattcatggaagccagagaagagggtcccttcctttcccccatagcgccgtaattggaaatttggtagtactaggtgaaattctcagttttggcgctcgcatggaacagccatccatctgctggcgagacacactgcccggggcttttcaagaaatcccttaatggtcctgaacactaataatatttatatacattgagatgagacaaaatttacagcgggctctggggctggctccaggactctctaatcccacacttgctcrcgttctcttgcttgcctcctagaatcctttcaggttgtgcttcagtgaggggagcatggtgtccgtctctgcagcaatgcttatttatgcagttcgtcctctaacaaacagagcaactttccttttgaccttcccctcttctccccatcacattccattgctgcccccgcatagagcatgtgcttatgcatagtttgcatcatttaacacgaaggaaccccttgatttgtgatccctttaagaagttgctctgtatataaagaaaatgatttttcctggttggttttactgaagttccttcagaaatagctcccaccaccgaaacacacctgacttccccagcctgtgtatcggttgtggcacggactgactgactggatggtataatttcactcactcctttgggaagtttcgggggactactgctcagatgtgtgggaaatgcggaatatatctacaggtactttgtcagtttttttttttcttttctttctcatcctggaaaatcccggcattgatatttaggtataactatttgcaagcaagtgcagagggacatttttctgttcttttcaacgttcttattactactgcattaatagctacttgatcttaatgtctattacacatcattttatataatgttttctttaaattgtcagggaaagggattctgcaagtagatgttggtccccccagttagtgtctgatgatgatggtaagattctcagagtttccttcctctaatgacaaagcatggtgatggtgatgtctgaagagcagcctcggtgctccaagatgggtgtatgcttaatactgctggcacacgcctgacgagcgggaatgtgagcgttgtttctgtaaccagtttyactgaacctcacagatccattatacgacgtgaattttgtgggaataacatagrctgggagtctgctctcttccagcctggtccctctcttctttcagccctaccctctctgatcatcatgtcccttgcactgcggccaggtaacctttctgatacgaaggtctgggcatgttgttcccttgcctaaaactttccatggtttcgtattatccacagttgggctaaaccctctgggacaggccttcagtgcctccccgggcagtggtccctggccttcttcagtaacacccaagcccttgcacccacagtgacctcgttgcttttacaagcatttacatgtgatgttctttattcctcccttgctcatctttccactttcaactccacaaaaccgtcctcggcacccagaagcccaggaaacaccaggcagctccactcactcccgtacttgctgtgtcgtccgttccctggggacaggattgtcgctgatcctgcgtgcatctgtctggcacacaggtgcagcacacattaaatagctgctaaatgaataaatgaagaatagatggaattatattctgttgtgaccagtttaaaaacatgaaattggaatacccaattgcagtgtttctttagatcttggaccttgaggtgacctctgtaatggatatatttgaaattattaactgtcttcaagtgggggtttgatgagagagagagagagagwktgtgtgtgtgtgtgtgtgtgtgtgtgtgtgtgtttacagaaaatatgctaggtttgtacattcaaatttgtgttatcctcttcaagaaagtcaccttggtagacagcatatatatcccaacattttaggaactcataaaatgcatacttttttggtgtgatcagagatgggtaactccttattacttgtgggttagattagtttttggaaatagcctggagtcattgagagccaatccttatcaacaaaatggcataaatggacaggaatgggtttcttcttcactttagagatagctctgaagacatgtctcagttgggattagttcagttgcatatatgaatagcagtcattgaaacaagataaaagtgtatgtctctcacatctaaagaagtctggagtaagcagtccagggttagcctagcggccccactctcataagggactaagttccttttatctcgcttcaccattcttgatgtttcgccttgtggtccaaggttggtacttgagctccaagcattactactgcattccagccagcaaggaggaggatggccatgccctctttgttctcaggagtcttccaggaagttccagtcacaacgtttgtttatatctcactggccagaacttaagtcatatggccacctctagctacaaggaaggctgggagatgtagtctgtaactggatggccatattatcaactaaaaattactgaaaatgacaagaagaataaataatggaaggcaacctgttgtttctgtcaaaggatgacttcaaaagagaaagttgcaaaagtatttcaagcttgacagtatcatgacagttttcttcagaggtgacgctattcatttgcatgtccaagttctgatatctgttttcaagttcacctatttgcagcgaaataggaactcttggaggcaactagtgggtgtgtaaaccggtacaaactttctagaggacagtttaacccaacaagatgaattctggaaattgatcctaatgaaatgttaagggtgctcatgaagattgctttgccgattgcaataataaaaagtaaagaaaatatcttataattggggacaggtgtaacttatgatacattccacaatggagtgtaatactgctgttaaatgtttgtggaattcacaatcttttatgccaaaagaaagctttcagaatggcttgtcttttttgtagatacttgtatttatatgtccatgcacatacataagaaaggaccrgggaaggtctgcttgaagatattaataaaggggtcacttgtgggtaggtggacttacttgttctctatattctctttacttgtttgtgatctctggtttttttaatcatgtatttttattacaagaaaaaacaaattctagaatctccactcaatattgcatgtcagagtcaaaaagatacacatttaaataattttgtattgttttccaatttgaggataaagtaggaaatgtataatgcaaaccagatttcatattttgttgatttagacttaatttacaagtaaggctgacagcccacagagtgtgatcacgacagcattgttatggaaataaatgccagctcatgcatttgggatgtacaccatggatctgtggttattagatactgatttcactttagcacacgaagaggcttagcggaggtggcttctaatatcctatggttctgtgggctcggagatrctactcacccacttgtcagaggcattgaaaccagagcaactgcatcttgaataggagctaggtaaaatgaggccgaattcccagacagttaagacattctgagtcacaggatgaggttaaaggtcagcacaaaatacaggtcataaagaccttgctgatctagcagatgcagttaaagaagccggcgcaaacccaccaaaaccaagatggtaacgagagtgacctgtgatcgtcctcactgctgcactcccaccagcgccatgagtgtttacatgtcatagcaacatcaggaagttaccctatatggtctaaaatggagaggtatgaataatccaccccttgtttagcgtgtcataaaaatgggcaaccagcagccttccaggctgctctgtgtatggagtagccattcttctgttcctttactttyctaatcagcttgctttcagtttacagactcaccctgaattattcttgcgtaagatctaagaaccctctcttggggtctggatcaggactcctttcctgtaacacacctatgttcttggacttaagaatgaccctcagacatggtgacttctttgtcatctaacagctttggcttatttgaggtaaaacctttgatatctaaggcagcagaaatttccctgaagtcattttgaatggtatcatctttactatagtgtagtttaatcattttcaaagtaagcatttctgcacactaaggctttaaaagagttttcagtaaggaacatatttgaaatggaaagtgagcagagcacaatgccttttaaattactgataaaccatagagttcctgtagggcttccactggctgacccacgcctgaggcaaccctcaaatgtgggtattatccccctcattttacagatgggaagagagaggatcaagatcacagaagctaatggtttgtcccagaccaaacaaggagttcctaggagagactgaactttaaagatatcractctctgcaggtctaagtggatgaaaggacagtggtgggggtgaggatttcgtagtgtgtttttgcattgtctcctcaatgagtgatctggtgctggtggtagcagtgaatgacccagaaggatgctggccaggcccagagaaggcggtgcctcccctgcccggtctcatctccgtctctcctctctctccacagtgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgagggrtttgtgatccacgacggcgagtgcatgcaggagtgcccctcgggcttcatccgcaacggcagccagaggtcagtcgcggccacacgtgtggtcactacccgccccacctcacccgccaccctagcacacaaaggtagactctgtcggttgtttcatccgggtgcagccctcaggaagttcactgaggtgggtcattttgagagggctggcttaccttaaatgtttggtgagattctaggaacaattggcatggcttaccgcccccctcaccagtttgttttatattttaagtgcatactgcctggccatttgaaattaagtacttgcttgctggtttcgatacccagagttcatagtctctctgggtacttgccaagctgccatctaagagacagggaactgtagttttggattttcctagtctgggtgctgctagccaggtgaggctttggaagtgcaaaagaaaagacatgctaagcccccaccaccatccttgagaccagcaagcggacctaaacatcttagtgcaagagctagcagcagctcagagtaggcagtagcttaaaataagggacatttttccatcagcacttccttcctctcatccccctctaccttgaccctccctcagtgctcatcatgtccttcattttccttcctgaactttgagacttcacttgggaagcaaagaagttccttatggccaggcatgtggctcacacctgtaatcccaatactttgggaggctgaggtgcttggatcacttgaggtcagagtttgagaccagcctggccaacgtgatgaaaccctgtctctactaaaaatacaaaaattagcacctgtagtcctagctactccgaggcaggagaattgcttgaacctgggaggcagaggttgcagtgagccaagatcacactacttcattccatcctgggagacagagtctcactctgtctccaaaaaaaaaaaaaaaaaagagaagttcgttataacaaatgccatatgcccttttgtacrtgtcaactggacttctataaatttgtcattggtttatgcttttgaaaataagatgttagcattgtttaaaaatgtgataactataactttgaaagcaaaagaagattggagatttggggttgctgttccctttcctggagcagagtaaagaacttttaggggctcacgcctgtaatcccaacactttgggaggccaaggtgggcagatcccttgaggccatgggttcaagaccagcctgggcaacatgcaaaccccatctgtacaaaagattaaaaaaaaattagtttggcktggtggcacacacctgtagtctcagctccttgggagttgcaagtgggaggatcacctgagcccttgaggtcaaggccgaaataagccaaaatcgcctcactgcactccagcacaggcaacagagaccctgtctcaaaaaaaagaacttttaggaaagttctgttttagtggactaaatgcctccttcatgattagcaccagggggcctgtctttctgagtctgtcaaaatctattctacaaatataaaaatatcgttagaaaagtaggtgttaattttaaatataatttttgctgcagcttatgaagtacattgaggaagtgtttataaagrggattctttttctagtgtattatttggagacgcagcttctactgtaggcttaccttcaaatcaaagataatacattcttttatagtattagatgtagagcaactttctccctcttataatctgtataaccattagsatactaacaacaagaagaaaattactctgaatactttaaaatgataaataggccaaggacttcaatgagctgtagaggatacatattacatccaaaatcagtctaccacattgtactcacattttgttggcagccttcgagtgtaaaagggcttttactggtgcacacctcgggcccaggggcagtgcctggaaccaagttgaggctcagacactattcagacgtcaccttcctccttggggtggggttaggggagtggtagcttgtccatgaactcagtgtgctatcgtctttgttttgtgaatacattttcttaatgacatttggaggccttcagtcgttctgcagccaccagagttgtggcaaagtgggaatgctgtccatttgacagtgttgtttcttccgctctagtgcactcttcagagaattgagccattatttcccctattcattcttacagtccgttaaaaactatacatctacctttttgtttaaaaataaaacaccataaagaataataaattcccttctctcagcctttgaggcttatttaacaattactttgaaatatttaattttttcatcttgtttataccttctctataccatagtggatttgaggaagcttaatctataaacatgttatcaaaacacttccttagaaaaacattttttaagtgcttgatgactcctagactttttaccaaagatgattggttccattttttttttcttttcttttctctttgatagactctggctgtgtcacccaggctggagtgcagtggcacaatcatagctcactgcagcctcaaactcctgggctcaagtgatcctcctgcctcagcctcccaaagtgctgggattacagatgtgagccactgtacccagcttcagatttttctatttgagtgaaagatggagagaaactaaacatacacttatggtacaacccagcagttgtaaccctggatatttatcacagagaaatgaaatttatgtcaacacaaaaatatgtacaccatcgtccatagcagctttatttgtaataaccccaaattggaaattactcagatgtcctatgatagatagttagttaaactgtgggacatccacaccatggaatattattactcagcaataaaaaggaacaaaccattgaagtacactacttggatggatctcaaggacattatgctctgtgaaaaagccaacctcaaaagatcacatactgtataattccatttatgcaacatcctcaaaatgacagattatagccaggcacggcggctcacgcctgtgatcccagcaatttgggaggctgaggtgggtggatcacctgaggtcaagagtttgagaccagcctggccaacatggtgaaaccgtgtctctactaaaattacaaagtttggccagtcacagtggctcatacctatctcagcaccttgggaggctgaggcaggcagattgcttgaggtcaggaggccaacatggtgaaaccccatctctactaaaaatacaaaaattagccgggcctggtgatgggtgcctgtatttccagctactcaggaggctgaggcaggagaatcacttgaacccaggaggtggaggttgcagtgagctgagatcatgccgctgcactgtagcctgggcgacagagtgagaccctgtctcaaaaaaaaaaaaaaagacagattgtagacatggaaaacagattagtggttgccaggtgttagggacattggggactaggttgggcagggcagtgagtatgaacaggtggcattagggagagcttggtggtgacggaacagttctgtatcttgattgtagttgtgattacacaaatctacacaagtgatcagtgacacagcaccacacacacacacacacacacacacacacacacacacacacacacagagttaatttccaggtttgatacttatatcatgtaagatgtagtaaacattggaggaagttggatgaaggctatgtgggatctctctgtaactttctcgtaaatctttgcagctttttgtgactctataattattttaaaataaaatttttttttttaaatggaaagtttatagggtatgtagataaattagaaacaacagaaggccaagtaaaaaagtgctgaaggaagcctctacccaggctggaaatgagaatgttgaatgcaatggtagaggaaggactctccccatctgtgggtgggtccagttcctgtaggacccttggggaagccatgacccccattctcccaaacacacaataggaaaataccagagaagttttgtttacctgttagcttttaaacaaaacagaaccctgcatctttgtcttagatacaaaataaccttcatgggtagggggaagggacattaataaaaagagctataatttacattgtttttcttgaatgtttttacttcacgaaatttgagagatgatttaagaacaataatgtacatataatggctccccagcttaccatcctattacacacacatcgcataagttcgtattatttgtcttgtttggaaatcagtccaactttctgacccttgttctatatataactatrgatcccaaaggttcagctgctgggctagcattttgtctgctatttcctaaataatggtaggtaagcaggaaaagtgccagtcttacttgtccctgactcttggtggttcgtggcatgttcaggatagtatttgaaacaagagctcattacaaagtaatggaaaccccttgcttttattgtgtatgcagcaaaagcaacatttggatcaatttacaagtttctgcaaaacaccgtcaagaaataatttcggttgtgctttagcaagaaaataatggatctgtgctataccacatgccttttggtatccctcactgggctttgccaaaacactgactgcaggagctagactactgttaggcagagacactgcactccctttgctgtccctgccttctctcctagcgactcctccaggtacacaggccagggtcacagtatcagaaagcagctctgttttcctccagaaccccccaagcttcctttctgcagcactgtctctcccacatggaaccagctggctcaccagtcaacagcctatgacacacaaatgccttgaggatgcagcatgtattttgtctggaagcaagcaacacgctcttcctttgtaggctgtttctccttttgcttgcaatgtgagtggcttatcttgggtgggcttgggggtgagataccatgtgaccacatgaacacttcaaaacagttgctttttctaatgcatgctgtaataacaatgaaaagcatatccttatggtttttttaatgcaagaagacagactcaattatgtgtgtttttgattttttttttcttcttcaacagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggagtaagtattccatccccctggaaaaacggctagatctcatggttttcttttgttgatgcttttcatgctcccgtccctgagtcaccactaaaatatgggcttagataaacaacatggtgtgtaagcctcacgcatgacgtctcttctttgagtttccctgaaagataaagaacagattgaaaggcaatctgtcttttagccattggcacgtcatttattcctgtaaagagggtcatcgctcatctttttgttagtcacatcttgcataggagaggcaagccctgacacatacaaaccccagaagagaccattggatcagacgtgtgactcagcagactccagctgtagccaaatccacacatctttcaagtctaaagagttttggttacttgaatttactgagaagactgagcaaagggaagtttagtgatatcacgttaaaattttatgaagtccaaaagaatgctagatttccaaatttacttgtgagagacaaaaggatacaagtgtgtgtcattgtgtacataaagtttcggtctcacccctgtacaatgacctttatttgcaatagatggcattcctggtaagttgcttctragttggatttgtgcaaaggatttcccactgacttagcctatgatctcttcacttctttggttttttgtgtgtttgttttttggttttgttttgagacagggtctcactgtatcacccaggctggagtgcaatggcataatcatagctcactgtaacctggaactcctagtctcaaacaatccttctgctcagcctcccacgttgctgggaccacaggcacacactaccatgtctggataattttaaaaatcttttcacttctgatttttcattgccaagggcttctagtaatggtgccttaaattctctgccactgggaccacttggtcaaggtactgatagttttataagctagaataaatatcgtaaaatggctttgaagttgaaaggaattttggggggggaatccttttatgaagaatttttttttttttttacagtttgagaggaaaaataatgtattttgagaatgtgttttccttaatatttgttaaatgagtagactgtattcttaaggtttagaaaggacagaaacaagtttgtgcttagttcttctgaattmgttgatatcccttgttgctgttcacaatacacccactcccagccctccgtgatggagataactctgttccccacaactagggcttgccsactctcatggtacttctgatgtttaattmttttggctgtgtctgcatttcctcrtttacttttaatttgcttatccctagaacataccttttgagtgcctaaacttttttatcttcctgtcctgaagacaaaaatttaatctgtgaattaaacccatggagaagtatcatttatgaagggattggtacatattgatgcatgatgatgaaatgtgtcttctggtttatgtccattgcaggaaatagattggatttaggatgatgggacatctcattagaggggaaatttcctgatcttgactaaggcatgcttcctgccccacgtttaaaattcaggatctcttccttaaaacatcaactgcacgcaacctctcatctttccaacttgaacttccctttaatttttcttggaaagctattaaattaaattagatgtagggctttatcctttagtacccttattattttatttgtatcaactcaaagcaaaatagagcattttattaaatatgtcttcataaattacgcacagtaaaatcccattaattggaccacacccagttcattatagtgtttattataattttagcattagttgaactgaaaattggtttttgtttactatgagaaaaaggtagactaaacaagatgaaacctgttgtttgcatattatgtttgtacatctttattagcaactatttttccaactattttcaactatttttccaactattttctagttataaaagcaatacataaatactatagaaaatttagcaatgcagaaatgaatttttaaaaatccctcatagatagccattgttaacattttggtgtattttcttcaagtcttagtaaaatggaacctttaaatatagatccctgtatcttaggaattagaaaggcagcaaaggcagttcctaatgagatggagaaaatgttgatttagtcatgcccttgtactgtgggggccatactgtctgttgacagagcatattaaaagacgttccctacattcgtcagccttagctaattggcagtctggtatttatgattttatattttgttaatcagcttgggagctgcagtaccccccagcctcctagaaacttggcttcccctgcctgggaggcctcgttccaggagtcgttgttgagagtcaagccagggaagtgtgtttttgtcagggagcagccagtcctgtgctgggagcrtctcagggggcacctgccgttgaattgttctcacttgtgtttgtaagaatccaagtatgtcacccttacaccaagtgagcacacagtgacacartcccctttcaatgtagataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggtaagtgccccaaatttcatgagctgacgttctattacaaaataagcagcgtgcttatgaaactgtgttgctgaggtaagagccctccctgccttgttaaagagaagaaaggaggaagccgcagtattgcctgtgctgctcgagtaggtcttgggtggagtcatggttctccattcttaggaggttgctgtttggaaaacagagatgttatcacccttactggattttgcctcatcagtcaagggttgcgtgtctgactgtgaccagtgagacggcagacgggggtgcrcttagggcttttctgccaagartgacagcagttggtctggagtgctcacctccctgtgaaatcattgttcgcgcgaccctcatctgcctcaggatgctgtactctactacgcacaactgctccatcttttaagatattggaagtgagagcacrggaggagcatgggcggttcgttttgttagaaagaaaccyggattcacgagatggtttttattgattagtttacaggatttgcactattgatagagtttttgccttggcacaggcctgctttgtgataggggttttaaaataaccgtgggcttttcactggaggataaaagccggtgcttattgcatgcacaattgctttccagccgtcagcctgtgtgtacctttgcatatgtacttttctctttaaactctcccttttaaatacgactcttgccaggctttaagtgaatgcttcaaaataaaaggagttatcaattaaagagtgaattccttccaaagagaatttgggaaaataatttaggaaaagaagaggcgagaaggtcatgggaaaggttgtctttgctgatttatctgccccaactggataaagttactgcataagggtttctttacagcctccctgtttttctcagactaactcttggtcagtcttaaattcttaaaattccatcatctgwtagagctaacgagagcgggcagctcttcattccatccttgaaaagcacagtgtcctccccactggggaacaccaatccttaaaaaacttctttctcattgcaaatcgaaggaggctgccgctgcacccagccccagactcctcagtcacttacctggcaagctgaggccctaccagtttaaggtgatgattattgtttcttgtattaaattttaaaatgaatttttctccgctttttttttttctaagtagrtttgtgtttctggaatctcgggtgtctgtgagcatttcttcttcagcagagcagtagctgtcaaattttcttgttgcttaatgatatacttttttgtttctagactaagcaaatgatagacatagaggtgaatgctgagaggagagtttaattaatttccattaggaattattatgtggttaccttttcatggagtsttaactaagtattgtgcacttaaatgtagttagaaattaaagcctgatttttatttgcaagaatatttatgatgtctttctcattatctgaaacttgcataaaacctgaagcatcagcaaaatctttttaaggttgygtgctcaggtgtttgggaggctttccaggtaagcccgggcccctggcctgctcttaccattttagatgcaggggagggcaagtgggccttgggttttccctgctgctgctgctccccagtagtcctgcagctccaaggatgctggctccagcctttcattcctgcgtgcagcttctaagaggctctttcttgagcttgggctcttaagaatcttttacctcccgatgggaagttttctctcaccctgtcttcctggcccatgaccacaaaggtatagcccatcctcacgatgatgagctccccaagagctctgtttgcttcaggtgttgagaccgctagcaacacctcagctgttcatttctccttagactcagggacagagttaggtctggccccttcactagctgccctcacttctgcaagaagggaagagtcagagcgagaaagagaaggacaggatacgatagtcagataaacatcagcagtgcaaagcagaactcgcacagtgatacaagggaaagaaagaaatgtgccctaggcatggagaagagccagatacctgagaagatcagacaggcttctgacaagaggtggcatttgagatgggccttgaaggctttcgggaaaaacttgaggaaagcagaggattgaagtgaagaaaggcaattcaaggtagggtggcaggagcaaaggcaacgagttggggcatcctggggcctgttgggcaactaacactggagaggtgggtggtactagagttatgtaagatgttttgcacgcaggtataaagggttataatttaggaagaccatggaacgtattcaaggcttttgaatagaggagtgttagcagagctgtctgaaatttttatttcggtgtgcttttggtttaagccaagatagctttcatcccagtgtttctcaaactttgctacacattatggaatcattgggggtgggggcaggggtggagttgagaaatcctgatgtccaagttgcacccccaccccaattcaataggagcgtttggggttaggatccaggaatcagtgcttgtctaaagatccctaggcwcttcagcaggcagcaaagattggaaaccactgctttatcccttcatttcttcccatgtgcatatcacaaagcactttgacggttttttttcctaaatattttcccctcacactgctgcctaatgttttagaggttcacccatgttgttaacacgtgtcacactattttcttgaacttttttttttttttttttttgagatggaatcttgctgtgtcgcccaggctggagtgtagtggcgctgtctcggctcactgcaccctctgcctcctgggttcaagcgattctcctgcctcagcctcctgaatagctgggattactggcacgcaccaccacgcccggcttatttttgcttttagtagagacggactttcaccgtgttgttcaggctggtctcaaactcctgaccttgtgatccgcccgcctcagcctcccaatgtgctgggattacaggcttgagccaccacgcccggccttcttgaacttcttttatagccagtgataacataaatgtttccatttggttcaataggatgaaagttctgttctgtagccttttgtttttgatggagaacagaacaattcaaggtacagagatccttcaactctgacaaccttggctttccaaaatgtcactgagatccccctcaaaaagtctcctgagccatccagaacagaaaattcaagcattttacmtagagtagagctcttattcctcactcagagcctgttgacttttatatcgcactcggcgtgagctgattttgtaacccagttacaaaagccatagccatggtttcctcaaggacaccatagggtgtatttctagagtaatgaccttagacattaagaaaatcaagaccgctctgctgtttacaaaggaaacaggttttgtaatccacatgtacacaatttttataaaatagctaatttttaagctcttgagtaagagaatattttcactatctggaaaatccccttgtttggacaaccttgtttcctgatggcatcagataaataaggagttaaagtttcacattatttggtgctaccaaggattgttgccttgaaaagaagaaggaaaaagtagatggagggtggtgagttaaaagaattgaaattcgcggataggcatttctatgcttttgttcctaccactcgactstgcaacacgcagtgctttgtaataccttcttggagctcaaaggtcaggctgaaacatggccgctttttcacatttccctgggacttttggaaaatatacaccaaccctgtgacctagcaattccgggatccacccaagagaaatgaaaacatgcccacacaagacttgtgtatgaatgctggtagcagtattactcataatagcctccygggattcccccgacccccagcccaaaagaaagacccactggaaaccattcagatgttcatcagcagatgagtggatagaaagataaatggataaatgaaatgtggcacaaaggacaactgactactcaacaataaaaagacgtgaagtatgacacgtgttacaacatgggtgaacctctaaaacattaggctaagtgaaaagaaaaaatccagacacaaaagactacatattatatgactcattcgtatgtaatttgcagaaaaggcaaaactatagagacagaaagcagaccagggatggctgcaaggaagaggtggagattgaccaccaatgggaatgagggaactcttggatgatggaartgttctggaactgagtagtggtgatggttggacagttgtgtaaatttacggaagctcatggaatgatgggtgaattttttttttttttttttttgagatggagtctcactctgtcacccaggctgcagtgcagtggcgctgtctcggatcactgcaagctccgcctccgggttcacaccattcccctgcctcagcctcccgagtagccgggactacaggcgctcaccaccacgcccgactaatttttttgtatttttagtagagacggggtttcaccatgttagccagtatggtctcgatcatctgacctcgtgatctgcctgcctcggcctctgaaagtgctgggattacaggtgtgagccaccgtgcctggcctgatgggtgaatatttgataggcaggttatacttcagaagtaaagctatttttaagaaacacctaaacaaagaggaaacattgtctgaatatctgtatggtgcctggttccacctagatagacatatccacccttgctgaacccctaaggttgatgtaaatattggatttgggggagagtggacatgatataaaccagcctgtttgcagatggattggtgggagcatctgcagaaaggcaaaaaaggccaaatactcttatcagttgcagatggctctgttgctgatgacagcctgtgtcctgggttctgatgccccctagagacagccgtgaagaggcaattttctcctcgaaggaaggaactggaatgattggttgtataattgcagaattgttttcagtatgtcagcaagcactgaaaatggggaaactgtcccttcctacctctgtaggctggagacctcgggttcagctccatttatcagggcacaggaccttcctgttctgagactttgttccaggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaatcttttgcccagaggggttcctcagtaaatgctggagatgaggctcagacctgacctttggattcccagatggagtgctctgaaccgtgtacctggggctgtcttcaccactcaaatatcgatagagataacatagagatgtcctcaggaagataaccaactgttcccatcctgtgtggtctacagattgggagatagggcctacccaagtgtagaaataaacattttttacaacatagagaaggctgagaaccaggataccaatatcaataaaatctggatatcatagagcacatggaagctaaagaaaaataagtaactggtcaggtgtggtggctcacacctgtaatcccagcactttggaagaccatggcaaggcattgcttgagcccaggagtttgagaccagccagggcaacatagtgagataccagctgttaaaaaaaaaaaagaaaagaaaaattaaccaagcatggtggggcatacctatggtcccagctacttgggaggctgaggtaggagggtagcttgagcctgggaagttgaggctgcagtgctctgtcattgcaccactgcaccccaacctggattacagagtgagaccctgtctcaaggggaaaaaaaaaaaaaaacctaatttttaaaagcattctttgaatgtaaaggcagtaagctaagaaacaattaggaaatcacatttactgaataatttacttaagtaatctttttcttcaggaaacaatgataactttagcgtatgcatattttaaagatgtgcagacaggtctctgccttttaccttctcttaattctcacctaatcatggaaggaatttagcggggagccttgccccaagctgtggctcgaaaaacaagcatggtattgacaggcagctcatgaatggcttgattattattttgacaagggttttatttttatttttctttagcttccacaggctccataatgcctgggttttattgatattggtatcctggctcccagcctcttcaatgattgtaaaaaatgtttgtgtttactgtaaaaagataatcttgcttttcaaagtgattagtcaaatacacagaatttcagtgtgcctgccattcatttgtcaaattcctggtttataattcatgcttcctcccgtgggggagaagaatgttttgttcagaaggtatttttggtgtggttccgttccctgctagtgaaattagtttatgaaaagaggcctggttctgggtgtagatggaagtttggcctgattaattggtccttaccggcagcccagaggtttcttcatcaacaaggagattttgtcctgtaactaactcaggtacctggaagcagcccgacatttgggggtgcatcgctgcagtctcctttggagctggagaaaccyatgagcaagaatgggctwatgacacatccatttccactccatccctccttccgttgtatgactgcatggagcccctctgacctccagcagtgtcacctgcagcctggtagtgagaaacagcaggtatggatggggtctacccccagcaacagtagcgccagctgggccatatcctggcactgctccccaggaaacacaccttgtgttgcattgaccagatctgggatcatttggacaatgtcttatgctgcttttccaggatagctgtgtgttcaggagggagcccttactgaaaggaaagaactgttgacttacaagtttttgctaccggtttggtggtcactaatgtgtccagaggcctgaagatgggcgtgtgaggagsctgacttagcttcagaggctctgtctttcgactcacttgtgtgctcactgcacccctgtgctggcaggactccaacctccacccccagcacttgtgtggacagagagcccagtgctcaggaaagggttgggcttcaggcttgtgatgcagattccgtggtggctctgtgactccttctggtcgttcttaaagtagacagggagcttagatgtcacctgtgcattccccttgttgtcctacgagtgagtaaacagggctacagatagcactaagggatctgcgcatggctgtgcagctcattcatggcatttctggtcctgggtcccagtctctgaactccttcctggtctgacgtccctttgtgaatgttcaggaaaatgtcacagggctgcttggcagcattgtaaccataatttgtgctttactgtaaatgagaatcaggctgaggattgaccagctggttagaggtcctggtttgggtgtaaatgaagaccctcaccagatgcagagagatccccaatggacatagcctccagggcagacgaagccttaggggttctgttttgtcctggctacgctggctctgcagggagggctggggttctttctcctttgtgtgtttatacattagatctgtgagtggatcttagaagtcactcaaagtactgcactgattcccaaacttagtaagaagcagagcaggaagaggagaagaaggattcacggtccatggggatcaggcccatcagcacagaggactcagaagtcaaccctggcattgtctgctgccttcctggggaagccagagagaaaggcccactgcggggatctttctctagacctaagccgtagctgtctgctttcttgcctctccagggatggacttgtcctgccacctgggtagccagatagaacggcttcctgtgctggttggatctgctactcgtgtgcacaccctctggggcagaagccacgtctggtttggtgggctttggtcctccaccacctcactggaactcagcctctcctagattgctggttctccacgtgtggtccagggaccacagcaggggtcagcaccacctgggatttgtgataaatgcagattctttgcccaccccagctgaatcagaagctctgggggtggggcccagccctttgcaaacaagctttgtgcacactgaacttggagaaccactgtgttggactccgagtcctcttgcctggatgagaggcccaagagcactgcatgttagtggctcttcctyctcccccacacctccagggactggagctggggctgctcagaatgmaagatgaatgggggagggagaaggcccrgggttgaccccccacaagcttgtctccctgtctcatgctgtctcctatcccatcatgctgctgattgggcaggatttacttccatggataatgggagactttagagcaaagtgtacgctgttccgattgggtagcagagcatgtctgttctctcatggactgctttcaagcacgttgtacatacttggctgagaaaaataaccaaaggcatttcttgggaatgattctagtaacatcctctggtacaagaagcattatttgatggtaatagtggtcatagaattaattagcatcttaccgattttgatatgttatccttgaatcatgttgctgccattgttaacagcaactgtctgttctcctatagtgttaataactaaatctcttattggcaaaggaaatgtattgtggagcaggtggcaaagaggacctgtgttacgtgrccagcaggctagaggggactgtggccaagggcaggtgcgctaacatcgatttctgtgcttctaggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgagtgacagcatccaaaacaccrtgggcccaaccatcatgataacagcagaccctcctcccatgtgtgatggcagctttcctctgcggcccctcctggtttcacatgggggaccactagaccatcttaactagcactttgctcctacttatatgtcatcacaatcagtagtgggcagatacgtgatgtattcgtatttataaattctgtacatctctgtgagtgtgtgaaacacttataagtaggttctcaaactttaaagtgctgcttacagaatgcacagttaaatgtccttttatacacaggtgcacagttagatatttctctttcttttttcttttcttttttttctttttttttcttttttcttttttttttttttttttgagatggagtctcactctgtcacccaggctggggtgcagtggcatgatcttggctcactgtaacctccacctcggttcaagcggttctcatgcctcagcctcccgagcagctgagattacagacacctgccaccatgcccagctaatttttggatttttagtagagacgggatttcatcatgttggccaggctggcctcaaactcctgacctcaaatgatccacgtgcctcagcctcccaaagtgctgggattacaggcttgagccaccatgccctgtccgattatttttcagggaagagccagtgtgctycagccctatgagctctacccttctgctcccacagaagggaagcacaggcctgtggggtggagggggctctgccctaagcgcagcccctgtgggccacgggtttcctgtcccttacactcggcygccttgtttctcccaccccaacatgaaaaagatggagtgagcctgcagccctgagttgatattgctttttaaattgagaacaatataattacagccttgtactgkttataaaactttaaggtctcatatcagagatacagcagtgcctttctcatctaaccctgtgtagaatacggctgttgagaatggcgtggctctctggctggatagggttataaaagtaaatcgtcttttcacctttggcttttaataagggaagggtattagaaaaaaagtaatttgtatgatgaagggtgatttgtgcgtgtgtgcagacagacacacatgcrgrgaggcaaatcagaaccgatgcgtgtttggctttggcttgtttcgctggtgtctggatttacctggcgacacttgttgctctgggggatcttagagggaagcacgctgactgacctagggctgaacagcaggctgacgaccagcgccgcctcccgccccctgctcactctatccctgcaaagcccctgccttgctccctgttcagatcatagtaaaatcggatgtatccgagtatttcagagtgcttgtctccttagagtcagccagtctgacctgtcagatcataatacrtagtagccgtttattttcttttgaaagcaaaatcatggtttcctctctaaataacacttcagcaggaactgtgacatttcccaatctcagttgcgcacattttgtcctaaagacttcttagctcttttactgtcttcagtccctctgcttcacctcttgagtgtgtagtgggattcaggcagataagagggcgaaaggacaattcgtcagagagctctgggtctccatgagggtgggcagtcatcagtctttccctggtccttatcgtagtttgaatttggtccaaggaataagagagacacttggcacagcttccctgccatacccgccagccaggctacttcccatagagcacgttaggcttggccaagtgagatcttcttgtcagtgcttaatccagcctcccgttgtttgtcagccctagctggaggcctcacaggagttcctgtgtccttccagtttgatacsaagtttagaccaagaaaagttcctttctgtggcacacctgtagtctcttacctgtctttggtggttgtacacgaacaggcagatatccacaactgcagaacaagtgtcatcgtctctcttaagaagtttcagggcagcctaaaggctcaccttcaccctaccaggccccctttcatagccaggatcttagggatggagaagaaagataagttcrcctcgttcactgaagtcgccccttgttttcaggttaggaaacccaggttcatgtccaagtccctgggcaagtagccagcgtaactgattgacctaaaacaaaggatggagcccttggrgctctgcatagtgaaatgtatgatttcttagtggaaaayragaaagccactgaggaagcccagaagggaacttagcatatacagccagctttggggaagggggaagcagtgccaagcaagacaggtgcttttcagagacacatgaatctctgtcactcacggatgtactctttgcmccaggtgaaagtgacrtcctgcatttcacctccaccaccacgtcgaagaatcgcatcatcataacctggcaccrgtaccggccccctgactacagggatctcatcagcttcaccgtttactacaaggaagcgtgagtttctgctttgggtgatgccattctgttgacagggctacgaatgggagaggccagtctttcgatccttgaatgggctggctgaatacagggggtcagcagagtccccagggagagccacgccaaacatccctacttcatcctcatgcaccctctcgggctgtccctgtgatgtcagtcacagccagtgacagccatgattgggaaagtgttagctcgaggcctgtcattctttagtgagtgattagagrtgtttgaataaaataaacccaaaatggggaaagcttgytttttccagaattaggtcagtccagactcatgaacgatgatgggggacttcactgaaatatcgtttcagcctccttacctactaggcctactccaggaacaccctgcaggcacgtggctcttttgtatcatcttattcctgtctctctctctgtgtgcctctcccaagctgtggccctctgctctaggtcatgagccttccaaacaagcgaagaaaagtggagagagaacaaccttcatgtcttgagccttttgtgacttctcctagactctgttgggagcttttcctgtgtgatcacatgacattcmcccatctaagcagccgaggcttattcctcccgactgcagccctctttgatctccctcttccttcctttgccttctatatccaggtggctaccccggtctacttagccatcccccttacccaggtcccatgttaatcccatagttctctctcccagatgtgtggcttccaaagagcagcaaccagaggcaccttatgacagcatcttgtactctttcctcctgccagagctggggtcctatgaatgagaaattgggtacttaggattactaggctttcagagtttgtacacaggggagcccctcatgatctcccatcccatgacagcagacggtgttttgttcatgtttgtttcagaagccagcggccagcagctgtccagcccttttagctgataaatataaaatacctacccaaccatgcatctgtgcgaagtactatattctctgatagtcacaccagtgctttggcaatgtcagctggtaatttcactgaggacttgatgctggtttctaaggcaatctggaaactaaatatttgaatattataagatgcttaagcatcagaattgtttatgagcaatctgaattttagaagctacttctgtttgtctgtaggaaagtcatttttctccaacagttaccttctttcaatatctgatatttgcattaactgactatgcttgtttttttcttgatgaaaaaatgctgcaatcagaagagagaaaaatagtttttgcatatgttcttaaggaatagtaactattgaatcccagtaactgttgaagtggctcttcctgaggcagaccattcaattctgtaatgcccgactggggaagcccagagtccagtcacttcatttcttcttctataaaagtctaattgattatttgtttatttagacctcccattatagaaagtgtgacatgctgggcctctggggaagatttttgagggttttgatgtcagagccccgaacttyctcygaacttaattgtctttcagaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcaggtatccatgcctagacaagcccccagcatccacacttcttcrcaagctcactggccttgcttgtaccaggtgtcattgtagggttagcagtgagctatgcctgttgtctttcttgtcaataggtaatactgtgtcatattcatttccccactgctaacacattaggctcttctgtgccattttctggcctcggtactatcttccatcatctcctgctttgtgcctgtgagcccaggtcctccagggtgctgggctggtttcattggaaggcccagcctggaaacagccgtcttcagctgcccttgtttcttgtttgttttgatgttcaatcctccaggaactgaaaccatgctgatctgtgttccacttaattcatgtagctcactggttttccatcttcattctggagcttatagagttccaaagaggtcaacaaaagttgaaagcctgcagatgtagtatgttgtggatattcagagtattcactgatgatgaggttcctccttcctttatctttaggttctaaaccatctcatttctcaactccagatctggaaacagtaaaagcaaacgttaatagtttccagtatataaaaactagtttagaagtaggaaaatccacttcagttttaaagacactgattgttttagtgtattggagcttctatcacaaaaaaacagtgtagcctgggtggcttataagcaatagaaatgtatttctcacagttccagaagccacaaagtgcaagatcaaggcgctggcagatttggtgtctggtgagggcccactccctggctcatagatggctgtcttttcattgtgtccttgcatggtggcagggatgcgggagcactctccggggcctctcatagaagggcctggattccattcatgagggcttcactcccatgacccaatcacctcccaaaggccatgcctcctaattccatccccttaggggttaggattttgacatgtgagttttggtaggggacacagrcattcactctatagcactgataaacattctttgataatagccattattttagtgggtaaggtgtttttaaatacccataagcgagcacaaaatcagtttaaatggcagagaggagggtgagaagaaaatgctggtggggaaaaccttttgctgtgcacgcctgctccttcctccactcctaccccatctccatgaccctgtaagtggccacagtcatgtcactgggtaaagtgcttattraaacaaaattggcacaggcttctgatcctgcgtgtgggttggtgtagcagaggttcagtgcarcagaagaagtttttcatcttaaaatttggaagtaacccctggccagcaattcactgtagtgtttgggaaacataggaatatctgcttattgtgacagattctcaagaaacctgtttcctttccrcaaagatggaaaccaggcactgtaccaatgagtcagttcactacgttttgtcctctgtccttacacgcagcggagacagacgagaacttggtcctctgcctctgctgtttggtgacacctatcgtaagaatgtatctaggaatgagctgtttgtttttgaagtacttatttttggaaaccctaaagtggctgagcatcaagtggttgtgttttctctgaaaacgccagtattagtcataacctttttccaaagtatcatcccttaaagatgttcagaaccttgtgtgtatcgtataacctggagcaccctcaagctgtccgcccttttcaagttttaaaaatggcttaggcaaacatattgcttaagygatatccagtgaaggtgtcycctgtgctttgaaaaaccatcaacattgatgcttttttgtgacccaataaggacaagatttcagtggttctgggatgcatttgatctttatgcacacttcagctctgggtttcagttcaggggtcagcataagtaaagcttgatcagataactrtgctttgcctataatcggcattcattctgctggtgacagagtcctttgctcaaaatgaggcttccatgcgtttgcagttctaaactgcttttcagagtcatgcctcagtcattgtactgaaggatgcctgtggaaatggtggacttccgtgttctttgcattgcctctcccccatccctcttacacacagctgtgacatgggcatgcacactccttcacacacacagactctccagscccctttccacttcctctttccatttggcttcatgacatttttatcagagattcaaaatctcagatgaaatccaagtcagcctgttttaccagttgtcgaaattgccggagtgcagcactgtggagaatggcagttgtaataaatgagaaataccaggtgtttgaattagctgtagattttcayattgtctcttctaaccctgcttgtgcccccgcagcctttttccatttacaactcagtaatgtttgttttcacagagattaccggaggaaatagattataaagggaaatgttggcatttatagtagtactatttcaaaataaggttcacttttcactttgtatttcattgttcattgttattttcttatccaggtcaaactggcagtttcctgttggcttgccagagtatctgatagcctgactcttaagttcatttcattttctagaatgttctttgttcccctctccagttccttccattcccttggacgttctttcagcatcgaactcctcttctcagttaatcgtgaagtggaaccctccctctctgcccaayggcaacctgagttactacattgtgcgctggcagcrgcagcctcaggacggctacctttaccggcacaattactgctccaaaggtaagggtgcagcagcggcctggacggagggtgtgaccgttcattcctgtggttgtaatgtgcctgagccctaatattacacgtatcagacaacagtgtagttctccattggaaaccagctatcttctggttttttttttttttttttgagacagagtctcactctgttgcccaggctggagtgcagtggcacgatcatggctcactgcaatttctgcctcccaggttcaagcatttctcattccccagcattccgagtagctgggattacaggcatgcacyaccatgcccagctaatttttgtatttttagtagagacggggtttcaccatgttgcccaggctggtctgaaactcctaacctcaggtgatttgcccgcctcggcctcccaaagtgctgggattatagccttgagccaccacatctggccgagaccagctatcttcttgattaaaggtactgagagctattatttttccttacaagcatgtataacggctttcattcccactcttgttttggcttttcttttccgagaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccaggtacccagctcatgtgaaatttcakttggcaaaacccactgctcaggccggttctgttgcctttctccccaccaggtagtgtgtaagtcagcagctggggggtacaatacagtagccactgagacggagccgaaaaagatgacaggttcggtgaagtgagtccctgcggaagccagtcagccctgaagggaacagggaccagggcttgggttgctggggccaccggtgtgacaggtactgctgtctcagccacaaccccccacagagagcaggtgggcaccctgtggtagaggcagggaggggaaactcaaagagtattgacagctgctgcctggtgagaggaaaggccaggatttgggtccatctctgcccttcctaattatctttactgcctctctcagcctcacagaggaggagtgaagcaagagggaaaaaagtcagagtctgtgctggaaagggcctgacttcaaaacatagccaggtgccacaggcatcctgtacaagtaagtttgggaagcagtgtagggcgacagcctgcattggctgtttattccgtggttactctgtctttcaaagcaacacagcccctgccccagggactctgctcctctgctgtggtcttggtttctggggagtggggacaaaagcagaggaaagtaaacgttcatagcaggactgttcatagtagccaaatctggaaacccagtgtacatcaacaggtgagtggctcaataaaatgggctcgaaccttacagtagaatattattcagccataaaaagggaggaaattttgatccatgtcacaacacagatgaaccttgaagacaccatgccaagtgaaacaaggccagacacaaaaggacagatagtgtatgattttatgttgtgtgaaatatatggaatgggcaaatgtatggtgacagaaagtagatttgaatttaccaggggatggggatagagtgtggaggggaatgggaattattccataatygataggttttctatttggagtgatgaaaatttttggaaatagataatgatgatagctgtaccattctgtgaatgcaattaatgccactgaattgtacccttaaaatgattaaaatggcaactttttatcttacatatattttgttttgttttaaaattttattttaacacaataaaaaatgttaaacaatttttttttcctttcaaaaaaggattagcccagtagtgtgtgggaaaggagatggaagcacagtggtgctccctggccccctcttcctgtaagattatagtgcagattttggaaacgacctcatgcctgaaaactaggccaaggagttggatttaaatcagcatggcacccatgagctgcccatccgcagtccccacagcacccgctgccagcaccccacccagcacgttcccttcccctcactgcccccgaccctgagaggagcctgtagcggctatttattccacagtgactctgctcttacaggctttcttaggctgtaacaacaaatggtttttaaagtgattttttttttctgccaagtgacctttttgatatttgcaaaatggttgaaatagctatctcacttcgagaaatcagtaaagtgggaaataaagactggttagaactggaggcattatttccttttgagagtgcgcctcttcattgcttggtggcttttttctcctcccctcctctctcgaagttcaaaccaccagagcagccaggcgcggtggctcacgcctgtaatcccagcactttgggaggctgaggtgggtggatcacaagatcaggcgttcgagaccagccgggcatcatggtgaaaccctgtctctactaaagatacaaaaaattagccaagcgtggtggtgcacacctgtaatcccagctacttgggaagctgaggcaggataatcgcttgaacccgggaggtggaggttgcagtgagctgagatcgcaccgttgcactccagcctggacaacagaacgagactccatctcaagaaaaaaaaaacaccagagctgtgagaagggcctgcgaggccctcatggcctctcctagcctgccccgctgggggagtcttctgcctgctggtgtgtggcagggctttgaatgtgaaccttgaggttcagtgcccaaggccattttcttatccaggatatctttgtatcactggtggttcctagaaagcagaaagtttgaggactagaaagattgcaaagaggtttggaaactggaactcaatgaggtttggtgacttctctgacatcctaattaattaagaatccgtttgggacctggtcctcattcccacacaccgactcttttccccctcttctcctccattgcgttgcttctcgtggtcctttccacctagaccagcagaggcttagctcgtggcagctcctgctgcccgccacacggaaggatggatttagagtgtcccaaagcaggctgggcgggaagtttgtttttctctatcatgggcccttggttacgttgctgtcttgttccaccaaccagcaggaggttcgggttgtgagtcaaggttttggaaagattttgctgaaaggccccttgctttcagttgtagttacgaggcaagacctgtttttttctcatcagatgtggagcacaaggtgaagtgacgtgaaggcagagctgtgattgacatgttattaatgcacagcattggtggtgttgggttcaaaacaagtttcctgtgttctactggagaagtgtgtttatctgtcccccgagtccttcctttctctctcctaagacaagtccaacttgtgattctctgttttcatggatgtatatgaagacaatattttgtccgtggtgagaggccataatttttaagaagttaatatttgtttttttgcctcctactgagttctggcagagtccaggtgaaggagtgtccagcagagagaatgactgaatcacagaggctggctttctgttttacacgtggattgtccgaaaatggatttgatttctttcagttcattctgagaacaatgtatttgtgggataaaaccagttaagtaagatttagttccttataaattgtccagaatatcctgtatgttttgaagtacagtggaagctagagtttgtaaaacttactagtttctgaagtcaatattcgcagtaaatgcctttctttgactactgtctttattttgtaaatcacatagtttggtttaactagctaaaatgttgacagatgttggaaagtaaaaggttttccaatagggctaggttgtattatgggatggagtggggaaagttggcagtaatgtttgcttttgggcgtacgatttggaaatgtagttgtttaccaaaaaaaatgatgtatgggccattgtgcttcccctgttcctgccttccagataatgttctstgtcacctccstccccttgtcactgccttgatgtcatcagcattgagagctgtgcagtccctaaaagtgtgatgttgataaacaagtaaactactgagtatacttcatgaagtaatcccagttaaatgggggtgggctgagccgggagaggggttttgacagaattattttgcggtacatcaaacctaagcaacttctgacagacacaagtgtatgttgtgttggttttgaaggtaggcaggaaatttgttgatgatgtgttgacaaagatttccctgacagtaaatgtggtttcttgtgtttttcccttccgggaagcttggttagctagttggttggtttgcagagtgtgaggattgtggatgatcagcctcatgtccttacccttcctcccccagtattgtgaaagcaaatgtacacgccctgaccttgtggttttctgcttgttggaacgagcatatctgtgttgggcagttcatgccttcggtaggacccccgtgtgccactacacaaagaaggaccgtgttttcctcaggggaatccatgggctgagaagactggggagcctcagaggccctttcccraagccctctgctctccccttccaggttctgasctaaggaccagccagaagcctgccgagcgtcagccgaacctgcaagtggcttctgggctgttccgttccctgcgtgagctttccctctctgctgctgctgccgcgctctcccctccatggcactgatgagcttcccacattctggactttctcatttccctgggcagatagaattcatcccatttgccccctgccttttgcctattcctaagaccggtgaccccagccgaaggcctcagccctgttttctcaccattcgtccatggctgacctgagggttgccctttctccatctgggtgctcctctcgtattctgttygtttttgttggttcctgtaaacattagaattctgttttaaggtttctagggggagccacaaagcccatttcttcatatttgaccaaagcagcaattagagggtcgcaccctcatgcctcatctgccctttttggtgagaatgtcctttttgtgatgactttatgcactcccttttgcttttcggttgttccaagccccattcaaatccatgacraggactctgctctctgatgggcaggaccttgatgaggccacaggtgctcactgctgagtgggaggaagcctgggtgggctccagggacctgcagagtgtagcaagcacagacgcttggggttgggggtgggctcgcagcaggagcccccaagaagagagagccctggggtccgtggaactgcttgctgctagactccaggcatctttatttccacagtcagagcaaatccaaggagccaccaccacaggctttcatatccctctgccccaggtctctggggcctctgccacacacctcacctctcccctcctgccctaataaatcttaaccacagctgataggtttgccacctttaaggcttaaccataaggtctgtgaccagatggcctgagtgttctgatgacacagccaggactgcctggccaagagtggcagagacactatttgcctctaggtaaaatcgaagaaccactctgagagccggggggtgggggtgagagtttgtgtgcccattctgacacttgcagagtagagaaagcaagataatgaggaaggacatccctgtgttattcatgagttcttacctaagggggctcaatagctccttctattccayggttaagattcttctgttactcttactcaagtcatagaaaagacaaaagaggtaaaagtacttaaaagccacatttctctcctccttgcagacctgaaaggaagcggagagatgtcatgcaagtggccaacaccaccatgtccagccgaagcaggaacaccacggccgcagacacctacaacatcacygacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcaggtatggtatgatccagctggccccattgccaccttcctcacaacctagtggagaagatgtgttttatggacacagggtctgacacccagggccatgacccttagacccaggcctgcctgctaaataacgtgcagtcattggcaggtggcgtgtagaccagctgcccagggaacagagcccacgctctcctagtgacaccactcccagcttggtctctccatagaaygtgctgggagcagggagctgtctgcagggtccaccctccacctgctacttggtgcacatcgtgcattcctgctgtcctttgccccctcttgcgcacaaatcgggttgccccctcctgagctctcacatgtccagagatgtctccagttagttgccttgatccagagtaaacattgcccctcaagatcaactcctggagyagcctctggtcttgcttatttagtctttggctttcccttgttgttagacactgcctgtcacycgggcattcatccatctttgaaggtgggtgccttcaaagacagaacaagarctgccctgtcctttagtaggcctcaggtggtagaaagagcacggaggtgaccagagtctggggtgtggggtcctcctgggtgcagttctggcactgaagtccattgtagcgtgccttgaggcagtcgtcaggctccctgcctcagtttccttagccctcctgggagagacatagccagctaacccctcaagtgccttttccggctgtaactttccatgacctttgcttatcacaactttgtttactgcttcaagaagcaaaagcaagaaaggaaccactgcaaggtcagccagccgctggaggagttggtgccggcagggagggcttgccctgctcttagcaccagcctcctagcagcttcctcacaggccgggctcggggccatccttcgtgcctgcataaaaattgcagttgccgcgtgtagacgcgggccacggagggtccctgtcacagccggcaggccccgtgtcctgcttctgcttactcagcatctttccagggctgcttgtgtttgatggcttcacaaagctttcttttttcaagtggtaggcacagggtagaagaaagttacttaggttgccaagattttcctgctgtgcttggcagcaggctttttttgttgagggactggggagaaaggaggatcttgtggcatcttgagacgtgcaagttttgtggttggtgtattctgaaccctcygctgtgtgagcagcccgctcaggggcagtgtacgtggctgatctccactgtcctgcccgcgtggatgggggsgttattctcagtgtacgtggctgatctccactgtcctgcccgtgtggatgggggggttattctcaggtcagcccagtgttggcctccctccctgggaacccaaatccaactttgtcacctgtttaaattgtacagaaggagcagatgacattcctgggccagtgacctgggagccaaggcctgaaaactccatctttttaaagtggccggaacctgagaatcccaatggattgattctaatgtatgaaataaaatacggatcacaagttgaggtaggactggggcagtggcccgtgcctgcatgtacttccatccattgacagcatatgctacctgactgcacaggttacctcctggttagcataggacttaaaacaataaaatccatgccaagttggtgaggatttgggtctttctacccactctgtactctccaaggagtactgcatagtgtgcaaagagctaggctgctttttgccctcaagaaacgatttcattgtgtaagataaccttgtggcataggccaggtcagttctaataacttttaatccttctggagttcttggttacaaaaatgtttggttaaagcttttgggtgtgcttaaagctacttgaagacgaccttttaagatttgatttctttgtctttactgacactcaggatcattgttaggtgggaggtcagatcaggcagctggagtccccagtgtggtgagtttagttggcaggccccagattyctcctgcattcatgggaaattgacatgtatgttttatttccccaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaagtaaggcttgtggagggagamgaaacgtggtaaaactgaaagcagggtggtccaggatcaggacagcccgagtgttcatggctgtcttattttctgttaaaatggagttggccagcttccagaagggtcatgctaaggtgccggcacataccggcactgtgtgtgaaaggttgggcagggcagatgccgagctttgggctcctacctcatgtggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacctcctacttggtcagtaaagctagatagggctcggattcagggcttgaaatcctaaggggtgtaaggaactccagaggtcatctggttcagcctgctacagggcaggaatctccacggtagcatcgcagaccctccactgtccttttaaagyccccacatgcattggaaatgtacggtgctcaccctttggtacagagactgaggaatgtgagtttatgctcaagtcattaacaagacagaattcttaggctgttctgtgtgatgacttcagattttaaaacaaattataagatgtataagcgcaacaagggccacatacttgttgtttgaccaacaaaacttagtattttggtgaaattagttctgtgttgagtttctgttatttcttatttcaaacccagtttttaagattatttcatgttcatggaatgggatcaaatttggcataacacataaaatagcaatgcagcctcacttagtggtaacacttttgggtctagtgggctgatctttcctggtgtccacatttctgctactcacatctggagttacgttaaaacatgcactccgccgggtgcagtggctcacgcctgtgatcccaacactttgggaggccaaggtgggtggatctcttgaggtcaggagtttgagactagcctggccaacatgggtgaaaccccgtctctactaaaaatamaaaaattagttgggggtggtggtacacgcctgtaatcccagctacttgggaggttgaggcaagagaatctcttgaacctgggaggcagaggttgcagtgagccaagatatgtcactgcactccagcctgggtgacagagcagaactccatctcaagaaaaaaggaaaaaaaacaaaaaacagcgcactcaataggtccagcaatctcacttctagtatatttccaaaggcaatgaaataggtatgtcaaacagctctctgcactcccatgttcactgcagcactattcacagtggccaagacatggaatccacctgatgtccatcactatgtatatgaatggataaagaaaacctggtacatatacattatagaatactattctaccataaattagaaaagaaaaatgtcgtttgtggcaacctggatgaacctggaggacatgatgttaagttaaataagccagacacagaaagagaaataccacatgatctttctgataatgcggaatctaagaagttaagctcatggagagtagaatggaggttaccaggggctgagggtgagggagcagatttggggagatgttagtcaaaggatacaaaatttcagttagataggaggaataagttcaatagatayattgtacatgatgacagtaataatgakgtattcttaaaaattgctgagacaatagattttaagtgttctcaccacacacaaaaaaatgtgatgtaatacatatgttaattaggctcattcagctgttctacaatgtatgcatatttcaaaacaataygytgtacatgataaatatacaatttttatttgtatattaaaattaattaattttaaaaaagatctccagtagtcacctggtcagcaccagatattctaatctgtttgtgatatctgaaaatcctaatacagacagcaaaagcaggatggggtgaatagaactgcaaatcttgagccaacattttatgtgcctggcactgttcctgggttcaggtttttaggggtaaatggatgtttaggcagataattttgtcaattaaaatagtctgaattgttccatctagtccagttaacctagtctcaccagttagtctatgccacctttgcagcacccagaagcttcataatattcctgcagccttgtccagggtagtggcttgcttgctttctrtctttccccagcctccttccctcctctttttcctcccctccatctcctagaaacagatcctagtttgggggtctgtgatctgtgaaacagcaaccttggcttctggggttgagtgaactcagcttgttttggtgacatgacatgttcctgtctgsctttgctgctccatttttaaccttgtaagtgccaggatgccagtgggaaatcgggagtccttctgatagaatttttccagcagatgttatcacgtactgcagggaaattggatctgcgtgctggccttactgttgagaaatttttccttatgtcagacaagactctgtcctgctacagtttagtctcatttcctcttatttaatcctcagaggagatggaaggtttggaagctttcaggcaactgccttccttttaggaactccttgtgtgcctgaatactattaaattactcctcagacttctcttttccagatgaaataatctcaggtcttttggccttttcttgtagcccaatatcatacaccagtttcctagccatttaatcatttttgttattctctggatgtgttccattttctccatgtccctgttgaaatgtgaaactcaaaaagaacacagtacagcctgaccagtagtataagtgatataaacagtgatataagggccttgggggaagaaagaaaaatctgccagctttccgttggtaatgatcacctctgagtgtttttaggaattgcaaaatgctggagcctgcatccattttgagagctacaatatcaataaaaatayttctttcttcgattaaaatacttctmattttaaaaattaaaatagctgtagtagtctttaaagagtaaccatgatcacagttttccatggcaaaataatcattgataggggacttacgattaatgtttacttgatccccagtgattccaggcccatttccacatagacatctgtatttggacgtcccagagaggtctcagattccttgtgccaaaaccaaaatcacagttgttgccctcgaaaggcctcttctctcctttgctccttagctcagtcagtggtcttgtaatccatttgttacccaagccaggaacctcacagcatccttcactcttctttctgttcagccacccctttttcattccaacccaagcctcatggattctgcctcttaaatgtctctggaatccagccctctgtcaccaccagcaccgccacagctcagactccaggtcactcgccttggggggatggtakgagctgtcatactgtatgagcctcatcctggggccatgacttaccaagccagatcatctctgtgagtctgcctggtgkaaagacaaggatcagtgacttctttgtaggtctgaactgggtaatgcagagcatgccctggagacatggcatgtccccccaattctccaagacatgacagtgccttctcttactgccaggtccctccgtctgtcctcagcacagccatttccctggaacgcgaatctgatcagttcactgctgggcctgaaagctttcgctgactccttttaatctgcagaatgagggtgaaactgcttagcttgggctgggtcccttgtgagctggccctgacttctctccagtatcatcattttctaggaaagccatttccccacaacccccaaggaaagcatatcataaacaagttttcccttggrgaggttccctcgactcccttctctcctctcccttcctctctgaattgttgccatatgtgaagtccacttttctagttgtcatgctacctgttgacactaatttcccatgtcccacagaatgttccagggtatgggtccatgtgcctggtgcccagcctagcatctgccatacaagtgctggttctgatgatcagtggcttctgtggtcttagacttgtagcaggactcaaatgtctgcagcggcattggaaaggggtgccgtccagtgtgtgcatgtgtgtgtgtgtttattttaaattgtctrtggaactatctcaaagattgaggccagcaggacttgacctatacatagatgtagactgtacatagatgtaagaatttctattcattttatgaaaatgaatagaaattttcattctatttattagaaatagaatgcttgctgctgcaagcatttgagtccttttacaggtgtgagatcacaaagaccgcttaccaacagaaccaacacttgtatggcagatgctaggctgggtaccggggacatggaccaaaccctggaacattctgtggaatgtgggaaattagtgtcaaatgtatgcattttcactaacagtcattaaactgcgtacaaagattatttttcttcagtctatcattgaaactattgcaccagaatatactgtactttaaaaaatgagtatatgcctcagtctgcacatatttactcttttttcaaataattgtttgtttgccgtgttctatttctgacaccatttaccttcaggaattcttactgtatgatggggagtaaacgaatatacaggtatttttttcatacttccaactgaatgtgaagaaatgaaaygagcaaattgttcacctggtgatattttatcatttcctcctctttgctgcagcaggatatgaaaacttcatccatctgatcatcgctctgcccgtcgctgtcctgttgatcgtgggagggttggtgattatgctgtacgtcttccatagaaagaggtcagtgatgtgcaragttatgacactttctgtggctgagtggtttgatgatttgaatgtgagtgaaggtgatatttttgaagatttcaaggaaatattttatggactggaaaacctgattttcccatcaaatgttcttccaggaaaagagaaccttttctaatgattttaacaacagccaaaataatttttcgatggtacagaccttcccctggctgkcttttctggtatacagatactgctgctggtgcatacttttccaaacgcgatgcgctagccttcccaatcaaataagcctttttatttccaatgaagtaaagaaacagatgtttcttaaaaagcgctaatctcaggctactgaggaagccagaagatgtgttagcaaatgtctgctggctcacccaggcctgaattgggagtgtagacaagagctgctgtagacagtaagctctccccattctgttctgataccgtgtgagagaggataaatgaaactgttgtagcgaagatgaaagtatwtacaggaatgtatggaggtggggttttgttaacgtgaatttaatctttttgacagaaataacagcaggctggggaatggagtgctgtatgcctctgtgaacccggagtacttcagcgctgctgatggtaagagtccgggccaccagcactgccagcgtgcagggcaggtagatcgggagctttcaggagggttgctartttgggaaaggaaggaggtttgcattattttgagctacctttggccttggatctgtcttcattaatatttctttctttctttttttttttaatcaaagtttttagcagttcagtgaatatgtcaaaacttgtgggactgtrtggggtgccccaaggaaacacaggctttagagatgaatgtggccagcgcagtaatcaatttatttaattgcttgagatgttatgctagaatgaaaacagctttttaattgttaacatctagtcagaggatatgctgcagctgacaaaacagtccttttaaactagtttcagcttgagtatcatctcattataattgtctttgatgaattacagctctgcttttttttttatcatggaatttttctgtcattcccttccgactagggtcatacgctcgtggctcattcacattccccttggtaataactaatgagggccattcagttaagtggctgggaaggtctgacrtggaagttgggtgatcctcaatggttatttccttttttgctctttctagcatttttatatccagaccttttgagtgagtcggattagggtgaggggttggtcactgagtccagtgatactaggacccttaactggcactttgctaggggcttttacaaacaccatcccatttgtttcttaaacccctgcaatgtgcgttttcttaatgcccatctgcaggtgaggaaatgaactctgggaaaaaacttgtgcaggctcacatggttagacagttgagaagtcaggaggagaatggaatcactgtggaaagggctgtgaggtcccccgggcaggcaaggaaacagccctcaggaggggctggaccggattcatcaaatgaataataaataagtgcatgatgttgagtgagtacatttagaaaaagtgtttgctgtcttcttgcctcgggagaagtgaaagtagatgcaggagatgtgaaataaagagacatgattattctaattattgtgatcaaataagaaaacataagaaaatactttaataatgtgaaaacaccgttatactatgtagggttttactatggtttctttaataatttctaattcagtttatagtaaagtcaatcaaaagcagcctcctctgaatgggaatcaggtgcagaataatgactttatttctatctacataaaggtctcacaaagttggttttttaatagtaatatatatatacatacttctgtagtgtgtgtatataaggcagagagaacattctggacggatgcacaccacacttacaagagttgttacttgtggagaggatctttccctttaaaaaaaaaaaaagccagatgtggtcgaaggcacctgtagtcccagctactcgggagactgaggtgaaaggattacctgagcccaagagctgcagtgagctagaatcccaccactgcactacagcctatagagcgagactggctcttaaaatccagcaagaagatagatatgcattgtttgtatgaataatagcttctaaaaagaaaatcagtaaggaagggagtcatcccagatgatggaattgatagaacaaggcaagaccactttcyccctctgtgagggtggactgtgactctacgagagaagctattctgctttgaaatgcggcactagaggttggygtgtgtagcttttgactgtgaagtgtccaggaagagaaagcatcaatacaacaaattcagattctcagggctctcatggtgacttgaattcacattttgtgtccttctagaatgctttcatgatacgtcttggtacttcattacaacaaaaacaaacttattgccacccaggtcgacaggtgggaacagtgtcaccttatttgaacttratttattcggcctttgagaagcacttatagccagtttcctcraggggcaacaaaatgacattgcagttcaaaagtgctttaaaaacttctttttcccaaagctataatctgcatgtcaccattctccagagtacattgaaaatcccctacaggaaagtgctgataacattgtgcacagaaaccgctcctggctggtggcactggggacgcctgcttaaagtcggagccgttgggttgaatcgagagaaaaggattgagcgtattgacttcagggacctcccagggaatgaatgtgattggtttcaactccatgttttatggcaggctaaacagttaattctgattaaaagcaagcctggattctcagagataaatggctggagacagtgaactctttacactttctgaggcgcattgtgaagagccttatctcctgggttgtcttgcatacttactctcctctgacaagcacccgcctcttcttcaggggtgcaagccacctatgccagctggagggcagagttccattcgtgaaacccttgaaacataygtactatgaaatacaaaaatgtgtaggaaagaaaacaagattattaatgaagttcatattggacacccctcagaggtctaaaatgatggtgcccctcctgggcctaatttataataaacatctctcctttgagacatcacttaaaggttgatagttgggatatggagatgttaggatacagttgtcagcctctcacatccagccacaggcccagggtcagcatctgaaagcatgaaagcaaaaacaggcaccttctccacctcctttctgagccaggaccacctccttcccacagtcagtgtgtggtagagcctggtggcaggtcccgtcaggcaaggacattagcacacagcgtcagaggaattactgacatttcatatggatcttatggaacaggttgattttattttcgtttttaccctacccatttggaggtgtagaattgagcctgtgtttggttttgttttctttctttccaacctttttcctttctttctctttgttttgccttccttcctgcatagaaatatttatttattcattcattcatttttttgagacaggttctcactctgttgcccaggctggagtgcagtggtgcagtctcagctcccwgtagcctcaacctcctgggctcaggcgattctcctgcctcagccccctgagtagctgggattccaggtgtgtgccatcacacctggctaattttttaatagagacagtgttttgccatgttgcccaggctggtctcaaattcctgggctcaagcgatcctcccaacttggcctacgattacaggcatgagccaccgcacacggcccatttattttcttaaaccagatcgaatctaaacagaaacagaaactggagaagaaatcctattcaggcttggtatctactgtgcattcctcccaaatctctacccattggtcaaggtccctgagttcacagagcccaggccagagccctggaaacgcctctgcccgtccgctgcctaattgcctgtccacrctgggcaccaccrggtctctccctcagtctcagagctcagttgcttctgcacctcatcagggatccagccatcaaagccaaggctgggggacacttggrctagagtaatcctaccaataatgcagttcagctttgtaaccgcaaattttctagtagccgtattttttaaaagtaaaaagaaacagatcaaatgcattttaatagttttttagttccaataatacgtttcgtgtaacccagtatatccaaaatatccattttaacatggagtcagtattaaagttacctaaatatttcactttttttttttttttgtctaatctttgaaatcccatgtgcatgtctcaaattggactggccacatggaatgctcaggagtcccatgtagggaccagctgccatgttagatagcccaggcatagcatctgtgttgagggccctgacacctcttttggattcatccaagaagtaggaccttacgtgcaccatcatcacctctcatatgtgactctggcctttttcccgacccagcataagaactcttccctctccctactactctcctcctttttacatttgcgttttaatctgttggtgaagatgggtaaaatcctgcttgaccatttcattcagtttctcaatcccctgtggttaatttgtttttttcaaaaatgtrtttttatgtgatgaaaagaaatttttaaaaaccaactgctttctttcctatactagacttccttgctttgttctggtccttctatctgttagtatcctcaaattatcttgaaatcctcagagatctgaaatactagtactgactgtacagttttcttactcaaatctatagcatgtggaaagttgacakcaagccatgccatcgcctcctggtattctctgtgggtttaaggaagcagcatcttatattctttggcttagagttcccccaaagcacgttctgtctaagggcttgtttctgtacctgctttaattacggtttcttctccagtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgaraggattgagtttctcaacgaagcttctgtgatgaaggagttcaattgtcaccatgtggtaagagaaagttcctgaaaagycaaaatgcagcacagggagagggtatcacacaagcctcccagtatgttcttggctgcatgtacccgtgggtttggtgtcttgcctttgccttctggatagttaccccattacctcactgctaccttcagacccctgtgctcagaccaggccgcagcaccacagagacagttccagacaacacaggcaccagcaagggccaccctgaccctctgagtctttctctttttgattcctcccaggtgcgattgctgggtgtggtgtcccaaggccagccaacactggtcatcatggaactgatgacacggggcgatctcaaaagttatctccggtctctgaggccagaaatggaggtcagttttcatttccaccggtattgcatgttgcctggcctgctctcttttcctttayaatctccctgcaaggaaatgctgtgtctttaaatcagtttactttccagcatccagtgtttcttactgcatgctcagttgtaggtcatttatgcaaaggatttccccaactagagtcagactctgatcttcgtgaggggaacttcctgttccttggatcccctctgctaagcccctctgtgcctttgttcctgcattccctccacccccagtcccctccccacatcagtgtccacctgccaagccaggccagygccactccctccccgaagctttcctgccccactccagtagctatctcctctgctaacttctcgatgcgcttgactcacatcctcgtatgtgttctctctcgttatgttgtgttgtgctgttgttggagtgtgtcccccctccaccccgttgtgtttagcttttcatctcagtccaagtgtgtggctcagggccgcatttgtggcaggcactctgtcaataaatgtatgttacagttcaaggttaagctgcctggattcttgcccttgcatctgggaagttgctgggtgatttcccacccagctcygtgcgcaagatgtgcactcattcataaaccccctccccacacacagtccccttccccggcattgttggcggtccttgtctttgccactgggaatctggtttcctcagactctacgtccacgtttcaggattgatccagagtcagtgtcctgcttaygcttttgaatgaatgatcccacctcagctgcaggatttctgcttagtttcctaaaaatttcactttgggttatgagcttccaattctaaacctgctaaagtcctatgcaatttttcattaaaagtcaccgtggtgtctcccccctctgtagtattaacccacaggccagctttttaacatatgcgggcatgacttttgagtaattaattctacaaataaactgggagataaatgctgagacataaagccagcaagaactgagttttcatttggttgcctccgtgggtctgaagtctttgacccttactttgctgcttactgrgtaagcagtgtgtctgcttttattccttagaagcagtgacttccccttctcggcccctttggaaattcttttgctgttcttcatttgggcttaatttttttttttttttaatgttctttgaatcggcaacttaatcatctcccaagtgacagtttcttaattttagttccaaacacctgttcacatatgacttcatktatttgcagcacatggtgtttggggccaagtgtggactggggcttcaagcaggatggtttacaaaactcccaccctctgttctgccaagcattggtccccagcacccctgggtgttagtgcctcttcctggttcactcactcactttctctggccctctctgtgtctctstcactctctttctttcgagatggagttttgctctgttgcccaggctggggtgcagtggcatgatctcagctcactgcaacctccaccacctgggttcaagcgattctcctgcctcagtctcccaagtagctgggattacaggtgtgyaccaccaygcccacctaatttttgtatttttagtagagacggggtttcaccatgttggccaggctggtcttgaactcctgacctcaggtgatccacccacctcagcctcccaaagtgctgggattacaggtgtgagccgctgcrcctggcccttggttcactttaatacacaaaacagcatgaaggagaaaagcttgatgaaataggtgactggagatctggcagagtatttcttgccagcatcgattgaggcacctctgaaaagtccaaaactcactcccttcctcyccagtttcaggcacagaataaaaattcagaacacatggccttggtcctggctctgyggctggctgcctgtggtcctcagacagcygctgcaggttcctgggcctcagtgtcctcaatataaaataagagggtgggacaagattactgaagtccctttcagaactaaaattcacctttagattggtcagatttaaactttttctttctagctcatgtcargtattaaaatgtgtgcacttaccctgcagtttcattatattcaacctgctcccccgaccaagtttcacttacgtatctcactacgagtaggtgtatatgtatacttgtcttaaatagctctaaccaaattaaaggaaagaatggcagtgtaacaccatgaactgacaaaatttcagccctctgtctttctccatgcttaaagttgagtgcttttgttgattctgttgctcacggcaattataaatgaccacttcataacacatataggtcatactgtaatatttaagaattgtgagcataaactttacatttcatgtgcatatttcctcatgcatcacacgtatctaaagccctgaaaagtagtgatttggacttacccccagtgacttaatgttgcttccccagataaccacgtgataagtgttttaagtcaccaagagacagctttgacagcctgttcagaattcaaaggtttgtgtcaccaagtgtagagaaccaacccagaagtaccgaggagttgttataatgattccaaatactagctttcagtagaaactagcacctcacagggcagcagccagcatccactgggcattgactatgtgccacgcaccactgggcactttctgtgcgtggccccaggtcatcttctcgtcagtgaaaccactgtgataccccatgtggaaaagcctgggcatgctcagctggtggccggcctgcaagtgtgggacctgtcagagccctatggctttgcagtgctgtgtgagatgctttgtggtcaagaaaaccaaggtgtagagtctgttgcacttgtatatgcaaaagtaaaaggtaacattaaaattagggactagtgattgttttaggatggagagacttgggcatgtgttttatataaaacttttttctaaatggatgtattatttaagggtaattctttttaattccaaagccagcacgttgctgtcctctgcaaagaggaatgcttatccctgttacttattcctggtttcctccaagactagtttcagctggacttcagttgccaaggacttgtcttcygtaatgccsacagaaaataataatgccacattgtaaggtgaaaacagtaatcctggtatttttgtattttagaagaaggttgaagggaaagaaaaggattaaataatttataacgatgctyttatgggaaataaaatataccatgtccatttggaaacacatttgcttacttccacacagcctttgtaacgtgctctccttcctcttacctgtacttcggtgatggaaataaaaggaacatataaacaaataggaatttgagtaactgagaatccttactaccaaaaatggcttgtttcactttaaaaaaatgttgccctacccaaaatagaaaatgttggtcctaaagagtgcaaattggtgtttccctcaccagctctgatgtggtcagggagcaagtgcaaataagcttgcggggagcaagcaggtgccatgctctccatgatggtttgttccttccgagcaagtcctggtttcttagcataaacaacccacggtgcccagattgaacaaagatgatatgcaaacctcgaaagaaattggcatggaaaaaaaaaatccaaaattctcatgtgaatttttttaaatstccaacagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggaggtgtgtccttagctttccaggtctgggcaagaactaaactcaggtgttttgaggactttgttggcattagtctgcccctggagaggttttctagtgtgtcccttgagtgcacggactccttcttgggaatgatgtgattgtctccagttgatggtcacaaacctggcacggtcggtcccaatgctgatagctcatggacatggtggttcagatactgggcacggtccctgaggctggctctccagacgtttgaggcatttcttggtagaacacctcttagcattggttacagaaataattaagacaatgtcttyaggagattttgacttgggaataaarctcactgtccaaccttgcattcatccctccaattttyctagcttttaaggagcattgctccccttccagggacccacattggtttmtaagaggcaagctgccctaatgacgaagcctctgcacggagcaggagcagtggcaggagctggcatggcagtcccttaggtgagggacgatcactgctcactgggtttcacggctggggctggccagcctccaagctctcgaccactctctcacaacacttactgtcctgctcttagctcaccagcctactggttagactcccttgttgccaccacccactgtcacaccagaaaaaagggttggattgaatttctgagcaatggttaaaacccacttcagcctttaggtttgtgtttttacttcggtcttttaatctgcctaataaaaacacacataacatcagggctgctcaggaaaccacctgcttttaccaggaytctcatcttcccactatgatacaatgatagtttagaaaaataccaaatatttatcctgagaaactgcaggggagatttaacacccaaaagaagctatttcaaatggacctctgtgtctagttcttgaactgccttttctggaagtgttcaccttcctttagtaacatatttttttcctttagtagtgatgttttaatgaaatgttttagcccctttggtgaacaatgagaatcttttagagaacggtttctttttttgagacagagttttgctcttgttttccaagctggagtgcagtggcacaatcttggctcaccacaacctccacctcccaggttcaagtgattctcctgcctcagcctcctgactagttgggattacaggcgcgtgccaccacacccagctgattttttatatttttagtagaaacaggttttcatcatgttagccaggatggtcttgaactcctgacctcaggtgatccacgcacctcggcctcccaaagtgctgagattacaggcgtgagccaccacacccagctgagaatggtttctaaagtaggggtgagtgtctttctttttactctgtaggagctagaggtattgaaatggaaccatatcccagagcccacatccctccgtcatcagagttcctcattcaggatccaccagtgtgtccctaggtttggcacgttgagacgtcctcacgtttggtgctctgtgaagctgggcagccctcagagaggcaaagaagtcccaagaggccgtcctgcctcagggctctcaggaaagagccgcccgcgtccctggctgggcttccttggtgcacccagctcatttctccttccctctctgtagaactcacattgtccccrtggaaatgccagccagctcccctttcccagtgcaggggggagccaggtgggcctgaggtgggccagttctgccgctaatgggtgagagacttgggccaggtgccttacatccgggagcctcagtttcctcacctcggaaatagggtgataatgtaacagaccccatggggttatgagaaggacttggtgcaggaaagcagcagcacgtgcctggcacagggcagggcctctccagatggcagttcctgtctgtgtcttattcccaccctccgrgcacatggggggaactcagtttctccccactgcgcrtcaccctgggagaggtgttttttgtgccaattgccattttaaatccaaatcagcagggatcatgtttgctgttcaaccatgtggcatatttatagtgattttttttgtaatcatggtttttctttctggaatttcaagtttttcrtttgtgctgaggaaggtcgtttgtgttttttaataggattccttcttttccaccttgtgcaagtaaaggcaaatcccctatttgcatgtcactgtattaattcacagataacactttcacacttcatttttattcttctcaagggctcaagatgttttcccaatgcccagcgtctcatggatgacaaatatgacaagtaattttaccagaggcagtttgagggctcttagcayagcacaagtaaattatgttggttcaagtccaaggaactttgttctctttgtgtttgcttttgtagccttacctctttggggcatgagttagagacatacatgagcattttaaagtggagcagccctttctcctgggaaggagaacggaagagtccacttaagaaaaggttgtatgattgagtgcaaaatcaaaatctgacaaagcagcaataatttaggattataaagcgagcctgccatcaaacataattatgtggcatcttctggagacatggaaaatggaagaaattttcaaaaatgagtgggaggattatgttgaaaaacagtattgagtaatagcttcaggggcctcgtaaatagcatcttttcggcatcttactgggtacttttgtcatcatgaattgttaccctgaatattttcccccttattaagcagtgaaattatttacttttctccagtggtggggcagtgctaccaagttaagtaagcatctgtactctcctgtttatttggtcaggttttaaaaccatgtgtaaatgaccagtggtctctgcagtactatatattttcttaaattgtgggactctaatttttacaccgcttccttttttcttatttttattttcaagacaggttctcactctgtcacccaagctggagtgcagtgttgtgatcatggctcactgcagcctcaacctccagggctcaagtgattcytccaccttagcctcccaagtacctaggaacrcaggcgcacaccaccactcacaactgactaatttttaaaattttttatacagacagggtcttgctgtgttgcccaggctgatcttgaattcctgggcacaggcgatcttcctgtcgtggcctcccaaagtgctgggattacaggcgttgagtcactgcgctcagcctgcctctcatttaaatgcaataagggcattaacttcctaagggaatcaaattgtaaatatattaaaagtggagattgcttggtatttgctcatcatgtgattaatcatcccttactgtctccaccttataaaattgcaaaccctaatatttggccaccttaaagtgggacgtgtctgtgtcttgccttgcgtctctccacacataatgagtgtagggtcctctgctgtgacagcagtggtgcctgctccagcgtgtgactctgcgccctctcttcccttacagattttggtatgacgcgagatatctatgagacagactattaccggaaaggagggaaagggctgctgcccgtgcgctggatgtctcctgagtccctcaaggatggagtcttcaccacttactcggacgtctggtatgagaacctttactgcattgccagcctggagcccccagyctctgcactttccaccagctcagtctctagggctttatctttctctgttcattgttacccgttgccagctttagctcagtgttgtgtgagccacacttcttcatcrttgaggtgttcctgttgtcagtgggctagctaagggcagaagggcattcgtgggattttaaagaatttatgggaccaacattctttccgccttcagcagataccgattatgtttccaggaggtgggatgtgccagaagccgtcacctctttttgtttctcccctgcctgccttctttctcttttcctctttctcaataaacagatactgtctgtgtgtctgcctcacctaatctaaccctcagattgcagacagtgctttatttagacccaaagcttatgagtcctgattgtgttttcctgctggtcccatctgctgtctgtctttcagtgggcatccaccgttgtggacccagggatggttatgggaagcaaaacgtctcccttaatcataaacagtgtctaccagtggaagcccatcgaccgagggatcagaggcctctcagtagtattgtttattgcagttccttggcaacattgcagagaggcagtcaggttctgaaatacaactgaggttattggcaggctgaggccctggcacaggcaccttctagaatatcagctagtgtcttggctttcctctggggggatcccgttgctgttgtgttacagaaatggtagttgtttactccaacagtctggatgaccgcatagaggaactatttcartagtgactgacatcattttttttttaacctcgtaaacctttcacagttcaggggccttggatcttattttgaagacaggtgcaaattggaaatagcatttgaatatgacccggcaaagcatgattgcttcttaagctcaagtatgagatctgttttgcaatcagcttgtccaagatggttatctcttcactgtcaaatcaaagtgctctgcatggtgtttagagattgggatggtgaggagagagcaagcctgggtatgtgcatgcatctgtttattctaggcttcgtgcctccaggagcttggaggtcagcttgtagtataataaaatagaaaactatacagccggggagaacagaagcagaatagaaggataaagtgttgttcatatctctcrggcaaattttacccaaattctgacgagcagttactgcacaagcaacaacaaagggacctagagtgtgttcattgccaattctgtccatttggctacataactactgtgaaccaatacaaaaagatatgtataaacatgaataggcgtttggtattcattccatgaaatgctcaggcattgacagcgcttcaggttttgtttgctttttaacacaggctttgaggatagcacaggtcaggaaggctagggcgttggagcaggtttctcagcggtccaggctctaaactaaagctgtccctctcaaaagaatggaaatgatttcagattgtattcagcagcacgaagcaatgattcctaaatagttaaaaatctagaaagaaacactaagaattgtattkggctttgtagaagagaccccagaattttaggatttgggatgtatccctgcagtcaggcccagtccccagtgcacctgcagatctttgacagctgctggttgagcttctgctaagaggtttccttccagggactccatgttcactgcctcacaaaggcaggccagcctcatgctttagacatccttgctcttarcaaatctttygtgttctgctacgtcagcctctgtgtgacacccattggaccttctctctgtagcacaattgcataccttgctctgttcttgataagataggtctaggagtcatcgaagaggtgtgtctgttctagccagaacacctccaagtttcctgctgtcttccaggacttcattcccaggcccttgggcactgtggctgctctccctgcagctccctgtagcaccatgtccctctgaaatgacaagggtgccctctaggcatggaggaaaccagacgaaggactggggagctgcaccccacagcctagagctgtgcttcttcccgagcatctggatcacccaacacataatctttattttttattaagaagctttccaaatagtcacaaatagccaaggttatttgcttctttcatgactaattaccatctgtggggaatgtggatttctctgtaggttttaatttgctggtgagtgggccattgctaccatcccctcctggtgtggggaagtatagttactgaatgctgcctccagccagcacgggcattgcagggggactcacagccgccggtcttccccctggggaaacaacgtcaaggttcctaattagaaagggctttacacagagacatgtatctamtgtttgaagattaaatctgtccatgaaatggaagacttgattttatatgaagtcatgaagagccaacaccacatagtaaaataccggctttgaaaaacacagaggtgttgcatatttctcggtgcttctgactggctgtgtggccttggttaaacctcagagcttctctggccttcggttgctccatctgtaaggcaaggtctgtctcgagaagtctgcggtacctgaatagatgttgaaatggctcctgtggcaactggtattgtgtagagatggttcagtgtccacaccttgcagttgtcacattaagctgtgaaggacgactgactctagcactcagtggtcctcagtggcaggtgatgttgacctcagacaagagttgctcaggagataggctttgcagttcacctcgacaagcgtttgtggagagctaggtctgctacctcctgtatcgttgcctgtgggtgatggtaaggctcttgggggtgtggaagatgcggggatgatgatgatgacgatgatgacgatgacgacgaygacagcgtcgtcgtcgtcctggtcctggaaggataaagtcttgtggagaagaggaggcaattctgacagtttggggttgcatcatcttcttcacagaagagatgaagttgtgtaggcaccctaagtatggattgtcacaaaaagagcactaggaagcggggcggggcggggcaggggtggggggttcctggcagtgggaatgctgggcaggcatggcagtagggagcacctgctgcaggtggggttggtgaggtttcctcgtgggacttaggctgcagagagatcaagacaggcctcagctgttgtattaggcatcctggactaattctttaagccctgttaaggtttctgaaccagagggtgattagagctgtgcttgaagttcttgttagccggagtatacagctgcattgagcaagatgttgtaaccaaaggagaggtggtggtgggccaggcaagcaggatcctgcacactcagggagctctgagggacggaaggagggtgccagaccttggacagatgtgagcctgggtggacagttcgcagtgggactccgaggaggccaagggcatgggtgacagcaggcagactgctcgggtggaatgggcatcagctgcagggaagccgggggaagaacagggcacaaatcrgagttcagtgtgagacgcrgtgagtttgtgggtagcccagtaactgggaacttggaatggagcagttgggccgggagggccagggtgggagccgtgccgtgagaactggctgcctgcaagccrctgacacagccaggaagggcacgtggggcaagaggagaagtgggtctgggagggagccacatcctcaggccatttcccagaccagcctgcagtcagcaaaagcagagagctagtcatttcttcttattttatttttaattttttgttgttggagagctagtcatttcttgtaccaagctgcatttcagatgtgtgggtactactgccactggcatctgaggcatgctgcctgtatggctgggctggttgtggaaggcagagcttcccgcacaaagctgatggagagccccttctcccctgggcccaggcctctctaaactgcacttttggcctctgggtgtcttgtacaacatgaagacgacagcatttcttggtcacttgtaattaaaaaggaccttgggttggtctgtcctctgattgctaagattctatttctgtctaacatctacttttagtatcaatttgtacaaaaatctttgattcaccgaaagtagctgaagcagygaataaaacgttctcatacagtcaggagcactgtgggcttgggcacaaggtcwaggtcccaagagctcttggttggaaatctcctgccccaggtttttccatgtggcttgaccagcacctgcagcccaggacaggtccagctagaatccctgctccccaccctgctcccgcccctacttggtgatgagtagcctattttactccaccaaagtgaaccacatggaaaggcacacaggtcagggagaatttgtgaattacggaatttgccctgggagggcacatttgttttgcagattccagcattgtcttttttaacattctgtctgaaagttgtgtgtgtactctctgttttgttttccagtggtttgatcttctaaactggcaaagctgcatgcatatggcagaattgctcactacaaagttattcctcagccaacttctctgcttaaggattctttgtccatgataccccctcccagccagtgcagcccaccctggtccccccacctgtgacacagaggccctgcaggccagcagctccccagctctgttgtgggtgggggagcagcaggagttctcttctcccttggcccaactggacctcaagatccctatagatcttctaaacattccaggtcccaggccctcaccccagaccaatcaaatcagagtttctattgggtgcccagccctctgtttaaaaacctccccaggagattctcctgtgcagccggcagtgagaaccacctgggtagaggtttccaaaattgtctgattgtaaaaatcacctgaggagcttggtaaagcttgactgtcccaggcctcatttgaggctactragtcaatgtccaggctggggcttggacaagaatgtcattctttttgggtcaaagccaggttaggtgataccgccttgccagataaatggccgggactaggtagatgctgaacccagtatgctctgcgttcaaagcacagatcaggggcttcctgaccrtgcaagggatgccggaagcgccctcaccaccttccttagctccaccaccggggctgaatttagtttacggggaacattagcagcaacagagggaggatgatatcccgcacttagcccagggcctggctcgctgtctgacaagyactgtcaccatagtaaggacagtttatctgctcgggatgtaagaagtgctggaaaggagggggcagcattgttcagtccatccctttccaagctcctcacagtttttttctccctgtaggtccttcggggtcgtcctctgggagatcgccacactggccgagcagccctaccagggcttgtccaacgagcaagtccttcgcttcgtcatggagggcggccttctggacaagccagacaactgtcctgacatgctgtacgtacttcctgggccctccgtgctcttctgagttctcttctcaaatacctgttttcttgggtcacaggagattaggagattaaagccattctctctggtcctgcrcctcccttgccaggcrtggctaagaggtttgtccttgtggaaggagctgagtgggttggtcgacctgtgcttttccgtgggtaccttaattctaccccatattccgtaatgctttcgttccgatttgcagttcacactgtagtttctcaggccaaatgtctctgtgaaatgtttggccagagtaatccatccttactcatcctctccatgtgaggtttttgtttctttttaaagaaggctacaacacaacacatactactctgaagtygaattcaagagccccgcgccccacctgtggcaggcctgagggagccgccgcagtgagtgtgcacacagctgcatggccaggactccggcatgcaccacgtagggtcagcttggtgtcttctgaaccctgccccacatgtcttctctgttaagtgtttacaaaagtcataaaccatctaagtaacatgctctccggagcttcatccgctgaccaatgtggacctggagcgtgtgtgagctgacatccctgcggacagaaggatgccagtgctggtgaatttgtcttctcactgcacttttttttttttttttttgagatggagtctcgctctgtcgcccaggctggagtgcattggcgtgatcttggctcactgcaacctctgcctcccgggttcaagcaattctcctgcctcaccctccaaaatagctaggattacaggcacccaccaccactcccagctaatttttagtagagatggggttttaccatattggccaggctggtcttgaactcctgacctcagatgatctccccgcctcagcctcccaaagtgctgggattacaggcatgagccatcgcacctggcaaccccacttattttgaaaaaacactttgcagcttttagtcctaagttttgtcagatgacgagagagagtttgtgatgcctcacagtgttggtgaggcctctctgctcagcgccccctggagaagccccccttttggtggaggacttgctctgtgtccgtggacggtgctgttttgtggctcagtggaggtcagagctgctggagcagggaggccttgttgtccttcctggaatgagtttgaggagggggtgaaggtgttccagttcagtcatcaggygcacaacaggtacaggttgggagcagtggccttgcttttgacatgcactttaaggcaggcttcagagattgatctggatctccatagctgaacaggaaggtgggctcccactagtatctcaagaccaattcaggagatttccagaaatgcttttcaggacaggtttggcttcattttggaaaggatcctgaggaattgctgggctgttatgtctgcatgaaggcacccagctcctatctctcacccatccacccccctggagccagcacagactcaggctgggcccacagtggcgggataatagatagatatgaaccagacatgtgtcaggtggacaggagggaatgagggctccagcagccacaaaagttttgctcatttggtctcctacagtgtctgtgggccaggaatccagatgcaggtgttcttgctctcagctcagagtcacaggaggcagaaatcaagatgtcagtggggctgcagtctcacctgaggctcagggacatcttcaggctccttcagggttctgcacttgcaggactgaggtccccatattcttggcacctgtcagctggggactgctttcaactcttggaggccaaggccactcacagtccttgccatatacagcctccataggccctctcataacagcagcctatttcttcaagactgataagaggacagctctctactgcttctactggttttttacctgataaagtcagatctacccaggatactctctcccttttaagtgattcacagtcaattgatgagaagcctgattagaggagtgaagtatcctctcatgttcacaagtcccacccgtactcaagtgaggggattatatgggatatttacaccaggggcaacgatcttggggggcatcttagaattccatagtctcagaaatcattgtccctaatcaaacaatcaaggtgctatttttgtttcaaagcactttgagtgttgctacaaatactgaatccctaagctccttgtaaatggccggccagcggagggcatggggtggggaagactggatacacacccctgtgctctgggagtacgttggctgggcggcatgctcattarctgctgcttccgaacataggttcagctgaagtgtatcccaggcagtggacacttcgtgtggaattcagaaaggtggcgcaggaaggataccagggaaagccagagtgaaggcatcacccttgcacagctagcacatgtgggggctcccattgtcccatcaaggcagggccagaaccagaaagtcggctggtgccctgggcctgggccagtgatgggaggctcctcttctctgagggtggcacctacagatgcagtggcactgggtttcctggagccctcatcaaggaaacttcccagcatggcctcttcagaactccacaatccaaacttggaagagactcgaaagaccacttagtaccttttcttgcccagtatagaaattcttcttctccccttctgtgttagttttttatcgcagtataacaaactacccaaaacctactagttaagagcaacagtaaacatgtattatctctcagaggtttctgaaggcgaggaacgcaggagcggcatagctggctggctctggcttggagcccttctcgcggttgcagcccagctgtccgccggggctgcagtcatctgaaggcttgcctgggggaggcagacccacttccaaggtgttgctgcataggtagtatgccctgcatgaatcgccctgttctacgtgggcctctccgtagcactgcccaagtgtctcaggatgtgtagctggcttctctgagtgcagagttcggcacactctttctctaaaaggccggctaaaaaaatgtttttggctctgtgggcccatacgaccttgactgtgactactggactctgccactgtggagcaaacacagctgtgggcgtcacataagctagcgtggctgtgttccaatacagctttatttttaatactggaatttgaattccacatcatccctgtgttgtcacaaaatattcttattttgaatttcttttagccatttacatgaaaaccattcttagctcatagaccttggaaaactaggcagcaggccagattttacccacaggtacatagtttgcctgctgtgccctagagtaaaagatccaggacctgagcagaaggcacgacgtcctttctgaccaaacctcagaagtcacactgaggctctcaccttctccttcaggttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccagccattatgagaaaaatcatgctttcaagtctgaatataagccatggagtaagaggtctgatgaccactgaatctgcataaaggtacagtgctagaatctaggctaatactagaactggtggtattttagcaagcttagaaacagcccatgaaagcaggtgtgagttctgcttctgtggtttagggtgggtgagggagagcggtattgttctgtgctttctctttgactcgggtaaacgtttatctacaagagacttgtgggattcttacttggtccacctccaggtgactgggcttttactattaatgtaaactgcctgggacgcagcccctgccatgggaaacgcagggcacttcctgttctcagcatagagtgacaaggaaatttactcagagcggttactctgacattcaatgtttagttcaggaggcatttctgctttgccatcgagaatttttctcccttctaagaaaatgttttctcctgagaaaatttttctcccttccaagaaaagagtagaatgaaaggaggcaacttggtttcatagggagtgtcatgttgtccttctgagtttactgatgagcttacctgagaaaggagggtyctagcatgggagttctgttgytacaagacatgaaagaatggcctccgtttatcccggagaggagagtccctgagcccttgggagttgccttgaaacctctgccgggtcccaggtgagaaagtgtgtgagttgtgtggttctgagatctgaacaggcaccrtctggtgacactaggggctgaaggagctcggtggctgcaggtggactggagctcaccatcaggaagtagccagattctcacccctcagtgtcaccgagtgttctggctttagaggaaggactccgtggtccccaagccacaaggtgtcgaggtctgagtctcaacgccatgactcagtgtgaattaacttagcaggtatcacaacatcagatttgggttgtggttccctgctgggtctgtactttagattgatgacaaagcccgtcctcagccttatttcagcccagatctcggtatttatgccacagatactgttgagctcctctgggtgcgtgctgaccctgaggtcacacagatgagccaggagtggccctggctttcaggaaacgtagtgacgtaaaaggtcccggctgctgcgggataagggccagggcagaggtgtgaacgcagccgtggaagacttgggccaggragccatttgttctgctgctaacacttccacagctccacrtgtccagactgttgccagagacgtctttggtctacaggattcaggagggaatctgaactttagcctggagcattatcaactcatagatgagtctgaaacaaacttagtgaaatctgatgttttttgtagttttccagtacagtttttcccatcgctggaatcctggtttggttctgcgggaatcgagtgcttgagtgggacccagacagacaggaagggcgctcctgctcagttagccccagtaagctcactgaggcacacaggccccatgtccacagccgctcctggctgaggcgtggttcctaagacgacccttactgttgagggctgccaggagggagagacacattcagccccgcaggtcctctgggaatccggtgagcgtcggcaccgggctggggccgtgctgattcccggcagcgtgtgggaatgtgcgggtgcctcgtggcctgctgacatcgcacacaggtcacagcctgtccagttcaggacatcagggccaagagtgaagtgagaatacggaggcacctctgtgtgctcaccctgctgaccgtcacccagcctccggggggggtcacagctggcccccaggaagctgcttcccagcagggcaggaattccatttgagtcttgtccctgttccaggagaagggctgggtatgtgtcccccaaaggggagagcattcgagaaggatggcgccagcctccccagaactgacctgtggttaaaaaaaaaaaaaaaaattgtgctttttaaaagatgagttttatcagctcacacatccttctagagtctaatggagattttttgtgtgtgtggaaatagtaaacaaggtcttgaatcccacagagcaaaaaagacttcctttcatgggcagcactggaagggttgttactctggaatggtttaaaagaggcgtcacatggcttgtttgtgctgatgtcactgcctcgctgctctcctgtggcacctcctcggtccctggccacagggcacagagccaagcacatctcrtgctcttggcccagttacgcttctgcccaggggtaagtcagctggagaggaattcacagcccaggcatttcatgtcgttatggcctattttaatttttttaaccccaatcatttttcttaggaagtgatggggagtttggaaaggcaggcttatttgtcatcaagctgccagcttttatcaatgcaaaccacatccctgtgacatctgtgactgttccttggacagttaggtgagggagggtctcctggtggccccagggttactcttatttaggttgagaaaaattcctttttccaggatcgttggtgatcaaagtgtagtcattctgttgcgcagagaactccatcccagctccaccctcatgaattttgtaatcttggacaaattatttagtatcttagtgcttctgttccctcatctgtaacatgggggtatattatagtcagtagcacctgcttcacaaactcgtgaggacttcagcagttcacacacataactgcctcgctgcctggcacctagygtgcacatggcattctaccgtggggtagacttttaaaattctggctacagagatacttttccataaaagtggccacatggaactctccaaatctaagaagcatactgtgggggccttcatattttgtctaattcttttctccccagaacaggaacctgcacccttccttcttttaaagggcgacgtggtaaataaacatttttagacttgcaggccacagtctctgtcctaatgtcctcagctggtagttgtagctggaaagcagctgcagcccacatggaaatgagggagcgtggccccatgccagtgcagctgatgtagaggcgggcagccccgggttaggccctgtggagacgcaggcccccgggctctagaacgctgaattctagtgaattctggatggctctccctcacacccaggcccaccctccctcaaggttgcaccwtctccacctgaaggaagctgccaggtggccataggagcccttctcttggcaggccagcttccaggcccagtggcttctcttacatcaggggcctccccttggaatgttccctgaaggccagacacgggcaggtagtctgtggtcaagcagccaccctgacaggaggctagatgccactgggtgtgctttgagtttcctagatgtggagagttctgtgtggccacttttatggaaaagcatctctttagccagaattttaaaataaagaggataacttcctggtgagaacagacgtggaaaggaaggcactttggtttcacgctcatgtaagagagggctgttggcggtcactcctcagaactatggccagccctggatggtagccagctgctttttgccccaaaagtctgtttagctgggtctctgcattctggaagcttgtcaaagcccgggcctttcctgggtcagggcagccggctttccttgtccacgtgtggccggctgttttcttggggagccccggccacagccggcaggactccctttgctccatgygactctgagggcctcacaggtatttgcagcccaggtgctgtcggagcccagccgatgckaccgacacacagcacaagcgtcatcctgttctgcctgtcccttgcgtgtggaggggactcgtgcccagggctctccttgctggcttgttggaatctggcttcaggtctacacggggcctctcgtttggtccagaacagcctggctcatcggctggggcttgcttgtgcagggctggagcgagcacgtgctagatggagacagcagactyggagtgtgcatttcttcgtgttgcaagcctggcctcacagtgccttcttcctttggttgtctgccaggggtagccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagaygcctcagatagaaaactggttatttttgtttcttagcactgccaccatagataacagctgtcacgatggacagtgtggacctggattagtccttcttgggaaaggagagtttgggttttgtaccrtggtggttytgggttctgrgggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccrgtttggaccccctcccgtgtgtcttggctgcaggtttgaactgatgygcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttaygcccacatgaacgggggccgcaagaacgagcgggccttgccgctgccccagtcttcgacctgctgatccttggatcctgaatctgtgcaaacagtaacgtgtgcgcacrcgcagcggggtsgggkgggagagagagttttaacaatccattcacaagcctcctgtacctcagtggatcttcagwwctgcccttgctgccygcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagyctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaggtattatatgtaggagttttcttttaatttattttgtgataaattaccagtttcaatcactgtagaaaagccccattatgaatttaaatttcaaggaaagggtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttytcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtgggtcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcrtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataayggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcaytttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacaytgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgaccygccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatyagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccckcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgattgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattct

SEQ ID NO: 1665 - DNA, 27852 bp, Homo sapiens
  misc_feature (1)...(27852): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctcaccctgcaggcttttctcacctttcttgctcctcctgtgcatgaagatgcccactccacagatgatgagccccagcacgaagcccccagctcccgtcaatgtcttactccgggcagaatcagactgtgcctctgggaaggacagacccaggtttagtgtcacctccaccagctgcatccctactcatgtcctgtctgagattctggagcctgatgcagmatatcgggatgaggacagtgcagcggaaaaagcttgctaagaggaaattcagaaagagccaccctcatatctggaacaggggtgtgacctcaacaaggtggcaaatgctgattctggaagttgcctctcaaaatgcctgagaagaggctaaaatgctgaaggaagagaactgttcctatgtgtgaggtcagttcctaagtgtgagggtttcgagaccagtcagtgtccctagattctctgacaagggggagaactatgaatcttcaggaaccccyaagccaaggtcaggaagtctccattkccctggcttcaaactatgctcaggagctggtatagaagaaagatggggtttggacatggccccagggtatagatgcagaagataagatgagtggaccccagagccagagagtcccctgctcttcagaggtggggtctagabggtcatcagagactcactccactccacggtgacaggactytccamgctggtgtgctccacttggcagytgtagacytctccctgctggggggtcatttccagcatcwccaggatctggaaggtccagtctccattacggatcaggttggtggacacgaccccagctgtttcctcctgtccattcaggaascatcggacttgaatgctgyctgggtagaaatcngtcacgtggyagacaagcaggttgtggtgctgcaygggcyccttcttggagggggaaacrttcaccytaggctggactaggagcgtggaagaaaaataatgaaatagaatttgagattgtccttctttccttccttccttccttccttccttccttccttccttccttccttccttttttttgagacataatctcgctctttctttctttcattctttctttttgttgagatggagtgtcactctgttgccaagtctggaatgcagtggcgcaatattggctcactgcaacctccacctccgggcttcaaccaattctccttcctcagcctcccgaatagctgggattataggtgcctgccacttcacctggctaatttttgtattattagtagagacaaggtttctccatgttggtcagsctggttctctaggagcacttgaccaacgcctgacctcaagtgatccacccgctcggcctctcaaagggctgggattacgggcctgagccactgcatctgcccagattattatttcttaggcatgttcactatgtaattgattcctagatgttgaaaataggaataatgtgattaggctagtgggtaagggtagcattgaaaagatagaaatagaccttcaagtagagcatgcatgatcttgaataaaataatagttagtaagtatatagcggaatggcagggagacagagtttgcactctgtagcacatttaggagaaattttaaccaaaagtaatttgggcaaagaatatttgatcaactgtgaaattacctaccttttcaaagttctatcttgatacaaaggaagcaaaatttactcaaataatatcttgaaattaagatatacagacaatggcattatggtggcctgtgaatctaataacttcatgaaaatacaaagaaaatgaagagagctttacatgtcttattctgtaaaaaacctatgtatttttttacctcacctacaaaaactcaaaatcttcatatttacagaatatcctgagctcctacatgcttgagtagtagaaatcccgtcctttttcaagttcctcctctgtgctgcgtcttcaggtcccatgaaggtctcacagatgaccaggtgttgcctccctctgcatctttgcatttgtgccccagcttgtcctgttgttctcaggtgaatttccacactgccactggcaacttttcttttggatctctgccaccagtacctttttcctcctcagaaagcagaaaaggccaggcatggtggtcatgcctataatcttagcactttgggaggttgaggcatgaggatcacttgagcccagggttttgagaccggcctgggcaacatagtgagaacccatctctaaaaagaaaaataaattagccagacatggtggtacgtgtatctgtagttctagctacatgggaggctgaggcaggaggatcacttgagcccaggaggttgaggctgcagtgagccatgatggtgccacagcactccagcctgggagacaaagtgagaacctgtctcaaaaacaaacacaaacacaaaacaaaaaacaaacacagaaaagggtcaagtgctcctagagaacagttcattcagggagatccactagagaacagctctttcagaggactaccctagagaacagctcatcaagaggaatgtctcaaattagtcttctaggtccctaatcactcagttctttcctttctacttcctggagaacacaaataccctaacatggcgctgggccaggtaaaagtacagtcttgaactgacacacaacccttactccctattgtatttttgccttgttttcagactgatccacattgtcagcctcttccctcaatgtgagtttatttcaggggcacctgtgtctcactacttcattacctcggttaactcaatgtccattacactattcaacttatgtctaaatctcagttgtgaattacctacaatttcttccccatagagcttctgggaaccatgaaatcagggggaatacttgggtatctgttttaaggtcccagaacattccaygagaggcatcttgctcaatattctttgacaggagcaggtcagcctggagccacatcagygacctccagggkgcgctggagttaaggcytgatacccaatggcctcatttctgacccagttcaaatacatttcaccaaggcaaggattcctgtttgttctagttgccttctctaatgcccagaaaacatttgctcaattacttctagatttgggtggacatccaccctggaattgtcactacttctttcctcccccttccacctctcccttgcctctgtgttttccctgttctaactcatgccttgattgcaatttccctgacaaataatagcagtttcctacctcatctccctgcctctggtccctcctctagccagcacccttagtagtcttctgaagacacatctccaaccttctctttttcatttttcaaaaatcttcagtgttctgacaatacttatctggctacatgggaacctctagggagctgattacaagcagagatccccmgacctcccyacccagggaatctgagtctgggggcactgagtctggagatctgtgcatcacagaggatctccagaagagtcttcagaggagtgaggttggggacctgcgggcctggaggagaaacccacactccttaggctggcatcagggctgtctgcaatctggcagttgattactgtgaaagaaaatgctgccatgtcactgattggtgcctctacaaagtcttagtaacagtttttgccaattgcgttatttttatttgaacacctctctcaaccaattacctcagcaactttcctaagctcatgtcactcacctcatccccacccagtgtgtccaccttctcactcatagcaggtgaacttcctttcactttccaggaacaagaaaatcaaaggtgtgatctccccagcttcctcctcctcctcccttcatttttttcctctttctagaaaaaaggtccagggctcaatcccacatcctgatactactccctcargtcccwmaggttggtgcaccaggctccccaccccacaagttcacaggaggaagccaaagctccaaggccttcctgtcccatccttgagaaatcctcttactgcacacacctcacctctctccatccctttacacccagacttcctgaaggaaaaagaygaatgaactsagacactgccctgtgmcagccgtggggaacccaagacaagtaaaatccatctcagccccgaggaggatgcgccacactcagcctcatgcaccccctcccattccagctcctgccgctgcggccaacctgctctccccaggtctccctggtttccaaacccactttccatcttctgttttctgaccttcccaagtcactggcaccgctgtccactgtgctgctgaggtcacctcccctcagcttccaagactcttctctgcgggcctctcctcacactgcacttgggttttwttggtctctttcacaggcttttctgtcttggccaaatcacaactgtccagttcccaggatccrgtcctttgctcttccccctgggtccyctctccctggatggtctcatgtatcycagtctcctccccggctgcagacccttctgtctacctgcccatcagaccacccatctgcccctcaagcacctcaaacccagctacctccctgtaggtttcttctctgtgtggcctgctgtgccatctccacctccatctccacaccatacccttgtgcgctgtcctgtggcttccttttttcaccccacatgcagtcagctgccaggcctgatgaagtcccsggggtctctctgctcycgtcctcctcactccatgctcagcccagtccaggtccccgcgctcgctcccctgacaagctccagatgggctccccccatgaatccccaacccaaagtcccctttccgcccggcactaaggtcccttaggccaacccggctgctcctgcgccctgggcacgggcccrcggggctgccctgggaccsccggcccaaagccctcactcacctcggcgctgcagggtcaysgscycghccagctcgtagttgtgtctgcayaycctgtccggcactgcccgcyyctcctccaggakgtccttctggctgttccagtastcckcakcaggccgccccagctccgtcaccgcccggaactcycccacgtcgctgtcgaagcgcrcgwrctcctsccggttgtagatgtatctctccaggaagcgctgtgtcccattaaacgcgtagcattcctgccgtnnctggwamasgtaattctctgcggggagggggcggacatgagcggaggcgccactctcatctaatcctctttctccctctctctctyaatattaasgattcttcccaaatctwcccacycagggctrgattttaaaataggagttttcctagtaycgagttctgtggtcctaagcgggtcgcagagcctctccaggcctgttttctcaccaygcagagagagaatttactgaaaagaatgagctcaggggcactgagtgatcactagggaggggcgagcactgaggggaaggcagtcccttctgctggtggctggaggaggcggagacgtttcacktggggtcactgggagaaaaaacaggggcgggaggagctggggacgtggagggcggagctgctccccctacttaactccctgactgacatttccatcctgatgtcagtcctggttcaaatgccacctcctccaggaagccctcccttccttctytctcttttccatagctaagcgctctctcttctcgaccagtttcttgagaattcctcaacttgctcctgttgttttgcatktaggaratgtagaaatatatttcttaaaactttcttcaactttggtataagaaagactctgtagcctgaaagttaattttcaaacatggctgcagaaagacttggtgtcaaaagatgtggraagtattttacacaatgaaaatcaccacaacaaccagggacctgtgggggtagagtcctttgggtttagaggcattsatgtaattttttttggcagtttttatggttttatttacacacaaaacgtggacatgaactttctactcattttcttagctgtgcaccstggtactggggttggtgactctgatggccggctgggtgactctttccatgatgactttgcagttctggaggaaattttgtgagcgatctcagcacagtaagatttgttgcacatcagcagcactttcagctccttgaggctgtggrccagaaacttctggaagccactgggcagcatgtkttttttgttgttgttgttgctcccataagcaatgttgggcatcaagatctggcccttggaccttctacgaaccctactgttaagacctctgggtttccgccagttatgcttaattttgacatttcagtctgattggtgcctcatgaacttgttggtcctctttttgaggatcttatccttcatgaggagtctgagggaggccatgatgtggaggaagagatggctgccagctgcatagrcagcaccgaggaagacagcattgatgtaatttttacatgaacaattttggcagcctttcccacatgctgttcttcctagggagtgccatgagcagtgtctggcaggtgtgtgtctacacagaattatcagtgacacggcacatgtttgtttctgtttgagtrtcttcaggcctgctctgttcttgggcacactggggaaattaaggtgctgtgattgttctgctcatctgtttcatgctccacaaattaacttctccagtttattaacctcacccctwgcagaagttgcacagctggtggcagaggatagtggagatggggtagggctgggctcaagggcaccatggagtccacctttagtctccagtgtcattgctaaggcaagatcccaggtcttgactcagatatcctgacctgcctcttctcctggtgcsttgggcsccagaccctraaattccaggcccagrgccccccagctccttgagtccagattcctcctcctctgccatccatccgcccctgcctgttcarttgccccactctgagtgtggattctcccattttcatttgttagtctttgtttctcctcctcaatcaccagtaagagaacgtttttcattcaagaataagaattttgaattttttctttgcaacatttaatttttttaatttacccagtcttaggtaattttttaagtacatttaacttttgaaatggaattttacctgccaagtagacataagcaatgaggggttttatggtgtaatttgaaaccttcatttttttttgtatataagaaactttatcctgtttgtggaacccttagcaattgagttgcccagagcacggtttgaaaccactgatctgaatgaattcgtctcttattcagaataggatatattaaaaacctctagctccctatgggttgtctcagccaagcttttctcccccagcctctttaagctatagcctggctcctcagccctttggtcttgtgccctgtttgaggttggggatgtgtgtggagttgggggagcatgcagggaattgtggaatcagccctgcccactttacccactcccctatggctccagctctccctccagcarrttttgattgaacattcattctacgcagggagctccagtaatctaccctcagtccctgtcacatggctccactgcctcatctcattccccctacaaacctcaacccagcctttgccygtcctccctttcactgyccagcatcacatgcycccttctgctctctgctcccccacctctgggtttccttggtgrctcccaacactgtccctcatcccacatgacagctctgcctatgggatggggrygcygcatccgtcacytcctcctgacactgttcagtgtcaccagtgctgctccagcctcctctctccccagcctcacccctctgcagttcccagggctgagccgtcctgctggttagttctcagcacccttctgtgactayaagttcaagttctcctccccttcctggacaatgaacccraggtaatagataagaggttttagggcttgaggggctgtattcaggagattccaaccttgctaccctgaaagatgaggaggtgacatgatgtcagtaccttytaggtgtgtcctaggaggggtgtggagaggtctaggaggaagggtgtaagcaggaaargtggaagtcagtggaaaactaaggtacctactttgcagtccttcctctcagagtgttggtgtaaatttggactagaaatgtcctgagagtacaatggttgaactagtttacagtcccaccaacagagtaaaagtgttcctatttctccacatcctctccagcacctgttgtttcctgactttttaatgatcgccattttaactggtgtgagatggtatctcaagacagtgtggcaattcctcaargatctagaactagaaataccatttgacccagccatcccattactggrtatatacccaaaggattataaatcatgctgctataaagacacatgcacacatatgtttatwgcggcactattcacaatagcaaagacttggaaccaacccaactgtccatcagtgatagactggattaagaaaatgcacacatatacaccatggaatactgtgcagycataaaaaaggatgagttcatgtcctttgtagggacatggaggaagctggaaaycatcattcacagcaaactattgcaaggacaaaaaaccaaagaccacatgttctcactcataggtgggaactgaacaatgagaacacatggacacaggaaggggaacatcatacaccggggcctgttgtggggtggggggaggggggagggatagcattaggaaatatacctaatgtaaatgacgagttaatgggtgcagcacaccaacatggcacatgtatacatatgtaacaaacctgcacgttgtgcacatgtaccctagaacttaaagtatatatatatataaaaagaaatatcctgagagtatcctgagagaaaaacaatggatcatagatgccataatattacaccagccacagggaggcagcaggaagaagagatttttcacttggttactgcttccttggctgtctgataacctacactcaatccctgtcatgcacccacacaacctcatctcattcttcctacaagtcgcaacccactctagtaccctaaccaagttctggggaggctgggagaagtacctttaatgagaatgccttcaggggctaaaacctatccccctccctcccttctctccttaattgtccaagggrtgtgggctcctgctccaccctggggaataagaggcattcttcgtgagcactgaatcctcagtgatcctcagagcctggacactccagcttagggctctctgcctgagtcccctccaggctggatgcagayrtgaacacgcccaggagcctgcacttgccaacttctctctstgcaaaccttgtctgtccaaggttatccwggacctcttggtcccattttccccaaagacaagcactgaccactgggcacctctctctgtttactgtacccatgtccttggagagagaataggccagtagggtagcaagctatcctataggggatgaacctctttctctagctgggaagagaggacactgccttagggcaggagcccccgcagcctgtctcagaatttgatcccttaaagataacgtcccctaggaattgttccctgagcyagaccctccaagaatggcagytcggctcttacctggagtggccctgccctggaccacagatgtgagcagcaccatcagtaacgccgtcagagccactgtccggggggccgcagaaacctgcagaaccatcatggagctggaaaaggatggcaaaatgraaagagctgcagtcaggaaaagaaggactcgctaaagggagctcctgtttgaaatattagagaccatgaacccaagtagtcttctgtgaccctgggattggacagagtctgagaaaagaaccaatggacactgagctttgtatgagtcattgctcactaggcagaaagttagtatgaaaggtctgaaaatataaagcctgtgatgcacttaagatgacggaggaaagacagtgatactcattttaaccagtcagataagtcatgatrtttggsgagattatgcgttttctttgctctgaaggtgatctcaaatattctgctggcccatctacagggattatcatttccccaattctgccacacctcacacacccacaggacatggtctgttgtggaaaaagtgctatcttagtgtgtaaaaggtcattcagtggcatgacttagagggattagagtacccatctcagaactcaaatgaggtctgagtctgtctgtcttgcctttgtccaagggtgtgtttaagattagcacccattcatatttactttctcccagaggtctgtgagtcctgcgatgtgcaggagttaccaggttcttccacaggactgtcatcagggtcaggagggctcagtctagggaccttacactgggagcgtggacacaccacctaccctaccatgtaaatatgcagctttaacgacactgcctctcttggacttcgattccttgtcttcaatatggggatgatataacctgccttatagcaaagctcttaagatcaaatgagatcaataggtctgaaattgctttggaaaaataaagtccatagagaatataaattgactggtaaataaggaagaaagtgaaaaaaaatcatcaaagaccccacctccttcaaagcatctgattctaytttgtttagagtgaatatttttacaaactttcaaagaacattacttcttactttagacacttataaatgtgatcctgttggaccaccaattctaatttcaaaaaaaatcaaattggcatcatttctttaaatcaatattaaaatgtaaatagaaggctagcatgtaaaatgcaagagaagaaaataattatgtagtagaaggtgtctagtaggattaaggggccaggagaggattgtggagaaaaactcagtttttttagtaactgcctgggtgggacttttctccttgtcatttacctgccatagataattagacaaatacttcctcgatgtctcaggtaatttatttttacagtagacattaataatacctccctcaggtttaatatgaggtttaaatgaggtaatgcatgcaaagcactaataacagaatctctcatgtcctaatctgttagtaattattatttatgcaaggtaaggctaccacaaataagataaaatattaacgtaatatatgtacttcatcattacattaaatagtaaatgttttgtgaccttctctatgagtatcaaataaatagctcaaaaytgaaatatttaaaatgagactagaaaagtatttcttaaatatggtaaagagaatataaaataaaaaattaacattacctgtaacagaaaaacattagagaaacccttcttaaaaacaagatcaaaatatgggcgcacattgttaccacaggtaatgctgtcctgggtattcttatatgaaaatgaaataacaagactagtaatttaaagataaaaatgttattacactgtttaaataccaggaaaaatcaaatactaagaaatctgaaaaataaaaattatctagaaatttcactaacaaaggtaaccaggaatagataaacaattaaagatcaacttcattcaagttaattaaaacctctaaatagaaattataacacttctgcagaaatgattaaataaaaaggaggtatctcagggaggtggacctgaaagaaagattaattatatattttattagatagcacattcattcttaattatcagcagaatatttttgtaaaatattgacaacataacataaaacatgatttaaaatatagtgaccaaaaaacatcraagatcatctgactgtctgggatgggggtggggctcgggagaaggaacataatggaaaacatttgccgtcagaagaaggtgtracttatctttttacatctctttctctaactctgaaaatgaactgtgaactggagctctcttraccacgctggtacctaaaattctcccatctcttccccagcaccttccagcgtcctctttacccagcaacagagaatgtcagctctatgatttctctgataggtgaatcccagccatgctgattcctctccacccatttscagtgctagaggcccacagtttcagtctcatctgcctccactcggcctcagttcctyatcrctgytcctgtgctcacagtcatcaattatagacccyacarcatgcgcccwgaagacagaatgttccatatcagagctgtgatcttgagagccctctccttggctttcctgctgagtctccgaggagctggggccatcaagggtgagtgstcaggaggacgcargagcgtyggggtgagtgatggggtggttcacatcaattgytgcttcaggratcasagattttaggggctcattgatctatctggtcctcatagtctatgttccctctggccctcataataataacagcaataayagccagaatttatgagackcctgcataktttctttccccatttacatctcacaggaaycttcaatgaagataatattccattcatttagaaattattccttttatttagaaattattttgaaaaaactgaagctcaaaaagatgaataagttttccaaggttacacagcagatcaacgagccaagtttgaagtccagacccagctctgagggtcrtacactgccttccccagattcctgcacacagtgacctactaycagggccctcctatctctctgggatccccagcctctatcttttgtggctgctttacaggaactccgagctatggactctgcattaggagasgaagtgcaaagagtgtttctgtatcctcyctctcttctaggaccctagggctcttcctgggtctttgtgggtggtcacaagctttcctcyctcaagacagcagggttgcatggtcttgatagccttgtgattcgggttctgagagatycaggactgcaagggaggcctagacttttgatagctgcaaggactcagccagagatggaccgtagtgaatgctcctttttcctgtagctgaaatcagggagaatgacatcaagcctgtgcatgatgctgtcattccaaaatctagtgatggggaaggttagaatccataacgtacaagatgcacactggcttcagacagttttatttaagatgtgtagaataaagaggaggtcaggctgggtagaaccagaagtatctattgccctgttcgcggtcacctgagttatttytaatgttatgttataataaacaccacaataggcttctcttcatagatgcaaatactttttagtattcttggtagaaattcctaatgagctcagctgtctcttcagggcttccctgcccagtctcttaacatttaaacatgtmatttaccttaaaaacataagtgcaaaycaactgataaaaaacaaccttgccttcagtctgcatcctrtcccagagacactttctttgtgtcctcacacgtggagctaagcttctgacttgtctctggtacatccctgaggatcctctcatcttggccatcaggaacctctacagaaggtcaaattcagtgggttcttctcagtgcctctgacttgagttactaataacatttgcactataatccacttctttctgatgaactaccctgtccttatttttctcctgtttacctggatcctccttatcatcttttaaaccacctcttaactatcatgttctctcattataccctgagatctcggcaattctgatttttggcactcttcctggaaaatcttatttaacctgcacctgccactaatgactctcagttctatggcctaaattcctctcctgagaccacccataatccacaaatatctatgtattatttctccttagatgactttcaggtcttctaagtgcaatagccccacagtaaactcagtatcttctcccggtcaggctgtcttccctgagagaagtggcttttgccctgttttctgaatgcctacattgaagccatctgttccccaggaagccttccctgatgtgctgtttggtcgcatcttgtgtatacctacgtatctgcacttatccttctgaacctgctgttgtcctgtcacttgtgtttccttctgtgacttatacgygtctgcagaacaggacgtatgtattatttttatttgggtatttagcatctaacagtgtttgacatatagtagtcttttaatacatatttttgtctgaatggaaatgatattttgaagaaaaataatctgttccatagctggctgatctttggactgcagaacttgtgaaagtgttttttaaaaagcattttaaaaagtacaagggacattcatgtattaagaagatgagtttccaataactgctagaggactttgtgtctttttattttaccctctttttcctgatgagtcctttgagtcctttaaactgaggagcaagctaagtttcctagtgaaatacctataggatttgttttgtttagtttcaaataccactctttgcttggccacttactgtgtcagggagtcattctcagtgaaaaataagacacaggtcataccctctagacacttacaattacagtggcaaggagtcattctcctgtcactgtaagtggccaagcacagactgggtccccacatgtcagggctgaaaactcacagggaaatctgtgagttgggaggtgagagcagaagagtcccgtagttccttctcactctgatgcatttatcattctaaacccagactttcacatacacattcatcrttttctttcatgataatagttgcttttatcctcttatctttgctaattcttacaaactaataaagactaagaaacaaaataaattaaatcctacaggtgttccaaactcagcaataatttctagttggcctctaaaacaaaaatcaaaatataaatgtaagaaaagttyagaatgcttagtacctgtgtgatgaaataatctgtacactaaacccccaagtcatgagtttacctatacaacaaacctgcacatgtactcctgaacataaaataaatgttgaaatatttttaaaaaggaaacaaaagtttggaacaaatgccaaaataactgtactgtacttttgaatttatatgccccaaatgaaaaatattatcaacaaagctatacattctacaktttcatgttcataaactaagacagaaactttaaaactgtcaagagccctaaaatttgaaggatattttcttcttcctctcaattttgtatttttttctaccttttctataataagaaaaagaaaatgtccattcccccacccccatgactctaaaaacaattttacatctgtgtcatagaaaaattaagatcttaatgggagagaaaacctctctactagttccgccagtagccgtatgaccttagcaagttattaatatgtaacttccctgcatttccttacctgtaaaatgtatgatatgtatttgcttcatagggttattgtgacaattcagcgagtgaaatatgtaaagtatttagaaggatgcctggcacaagtaagtgctcaacaaatgttagctgtcattgttactattactattgtgtagggtcaggatgcccagactttcaaagaccaggaagcagcttgacttatcagtgataaacttttcattttgttctttgctcctttctttttataactgctcatctgctctgtattatttcctttatggtgttgctccttcttcttccccatatgtccttcctttgaccycttacyttcttcctttttatattcataagtctttattcattctctagctttsaccacttgcatattcraaytgacattttgtcrtgtttttctctactktctttatgcagcggaccatgtgtcaacttatgccrygtttgtacagacscatagamcaacaggrgagtttakgtttgartttgatgahgatgagmwgttctatgtggatctggayaaraaggagaccgtctggcatctggaggagtttggccrarccttttcctttgaggctcagggcgggctggctaacattgctatatygaacaacaacttgaataccttgatccagcgttccaaccacactcaggccrccaayggtackscctatctttgcctcttcctctgtagcccaactggaagggatgagagggcctctctgccaccctcagactaggaagcctaagtgccccctgctgtgtgatcctcttccmctagtggccatgggctgatcccactacagcaagggcttgcatcctctcttctcaggagagagaaaggtgagcagagtgaggctggtcagtggtgtgatacccctstctgtgattcasagctgccataaaatctaaggctgaggtagaggaccaccctcccctaagaggtggagcctttgtgattcatcccagaagaggggcctaacctggtgctgtctccttccagatccccctgaggtgaccgtgtttcccaaggagcctgtggagctgggccagcccaacaccctcatctgccacattgacargttcttcccaccagtgctcaaygtcacrtggctgtgcaaygggragcyrgtcactgagggtgtcgctgagagcytcttcctgcccagaacagattacagcttccacaagttccattacctgacctttgtrccctcagcagaggacktctatgactgcagggtggagcactggggcttggaccagccgctcctcaagcactggggtatgcaactgcttttctctccataatctcctggcatcctctattccaaagacctggtgtcctctgcaccagctttccgcactggctgggtctcagtcctctcctcrtcctaacatccaattaactggtccataaccttcaattcccacaaccatcccaggccatcaccaccctcactgcacctcctgaccctatctcttcattcttcccccagaggcccaagagccaatccagatgcctgagacaacggagactgtgctctgtgccctgggcctggtgctgggcctagtsggcatcatcgtgggcaccgtcctcatcataaagtctctgcgttctggccatgacccccgggcccaggggaccctgtgaaatactgtaaaggtgggaatgtaaagaggaggccctaggatttgtagaatgtaaggaagggaggaaaaattcaatctgataagtgttcattgatcttctaatgggttaaaagcattcagccrcataacaacaacaayaccgataactaactgagtagttaatatggtcaggcrctattctgaggatttacatttattaactcactttattctcacamatagtctttgaggtaggtactattattttcacyatttcacatgagagatacttacatctttttacatacacagagactttaagcactttgatcmagttcccacagctatgaagtagtagggctagcttccaatccagaaagtctggatccaagactgtttatccactgtcctattcaccctattttgtgaaggaaaagaccaagttsaaattctccagagtccrttgycwaataayggagycagatctatatttctatacataattacaacacagtgtggtgggwgcctgtaactacttactgtctctacttggactcattccatggcaatgytcacacaaaaaatgccyctccagagatcttacaggtttctatytatcataacactcaccatgctttatatttttatatgttttgggaattctcttagcattagacrgtgaacttccatgcagatgaccacatctaattcattattattattgttattcatgctggacctcaggtacaaaaggttaagaacttctcagttcattatatgatcatcattggtgcctccgagctctctctctctcccttgatttatttggtcccttttatctccagtccttactcccatatctaacctcttacccctacctcataggtaaacattttaatgaatttgatgtttccttttatttgcatagatsctcystaatatgtagtagtgtccagtgtacatgtatttttaattaaccaaaatggcattaaattatagatctaattttgtacatccagtttgtttcttccaaatcttccatagtattttactttatatgtccatgcattagtccattttgcattgctataaaggaatatctgaagttacctaatttacgaagaaaagagctttaaatggctcacagatctgcaggctgtacgcgaaacatggcactagcatctgcttctgttgggggattctggaagcttttactcatggtggaaggcaagtggagccagtgcatcacatggtcatagagggagaaagagacatagaaagaggtgccagcctctttttaacaaccaggtttcatgtgcactaatagagtgagaactcactcattacccggagaggggacaaagccattcatgagggtctcctccatgattcaaatacctcccaccaggccccacctgcaacactggggatcaattttcaacatgagacttggaagtgacaaatatccaaatcatattaatccacatatctacattgctcctgggatacctggatcattcctggttctctactattgcaagcaatgcttgtatctcacatggaactgcatatacatgtgggcctgacctgcatccctggaatgtatgtatcctagaaaggggttgcagggttgytggagatgcagctccttaatttgactaaacactgctcatcttctcatcagaatggctgtactcatctgaacttcctttgtcagtactctaattgtcctgcaactcctaaatggacttcaacactggacattatccagttttctaacttttgccaatttcatgtgcataaagaaatatgctgttttattttgcatttctttaattactaataattggggytataattaggactgattagccacttgggggttccttttctataaattgcctgttcacattcattgtccatttttgtactatgtgcttccatcattttcttattgatttgcaggtgatccttatatagtcctgctagtagtcccttgtcagttttaggcattgcaaatgttttcctctaatctgacttctggcaactktctccttggtttcctttattgaagagaaatccttaatattttgtaatgaagtccatcaactgtatttttgtttgtgtgtcttttttaaaagaagtcttccctatactgagatatcaaagatactcttaaaacatctcctacagttttaaatttcacayttactactttaattcatctgggattcatctttgtgtttgatggggatcatgttttatttttctytatataatgggccagtgtgttcccacaactactaaatagttcaccttttccccataggttagtrgtgtctcctttgctatactgaaagctcccattataggtgggcctgtgtctgagttccatcttgttccactgttctgtttgtctcttcttgtgccagtgtcctagtattttgattactatgacattgtagtgtgtgttagtatccagtaggacaaattcttgtttatttttcttagttcacacacatttataattatatctataatgatttgtaacagagtgaagtgaatgtagaatgtcagatgttaagaggaagaatggaaaagagggctgggactagggtgatgtaggggatgcacytggcttaggtgcaaaatttgggggataccaaaagaactcagtaataaatcatattttaatgaaatatcttgaaaaggcaaaattaatgcaaagatacatgattaacaaaacatccaaagaggagtatttaacaaaaatggagaagcagagaagcagaagaattaggagaatatgctgtcacatgagccaaggaattaaagaattcaggaaggaggaagtactgctgtcagatgttcaacagaggtcattttagaaaatttaccttggtttttgaaatcctttcaaagagcagtatacacaatgtgagcaagtatccttcgttcattgccgtcattgatatggtttggatatttgtcccttccaattctcattccagsgtyaagcttcttctctgccctcagtaatgtggcccttccccttgtctgtatattttggagacatgaagcatgtgggatggcctcamagtcagctggggtttgagggtgaaattcaatgactttcgtgaactccttggctcctatgtgctcttcacctggaggrccagggcatgtgcagggatgaccaccttctccctgggacctgaacagggcagagaaatgggaagctcgggtgcaaagggagtggggaagatgggtccgggcttacagtactgaacccaggaatgacaataactgtgtgygttgctgcaggtgacaaaatatctgaacagaagaggacttaggagagatytgaactccagctgccctacaaactccrtcwcagcttttcttctcacttcatgtgaaaactacyccagtggctgactgaattgctgacccttcaagctctgtccttatccrttaccthaaagcagtcattccttagtaaagtttccaacaaatagaaattaatgacactttgrtagcactratayggagattatcctttcattgagccttttatcctctgktytyctttgaararcccctcactgtcaccttccygagaatacyctaagaccaataaatacttcagtatttcagagcrgggagactctgagtcattcttactggaagtctaggaccaggtcacatgtgaatactatttcttgaaggtgtggtttcaacctctgttgccgatgtggttactaaaggttctgatcccacttgaacggaaaggtctgaggatattgattcagtcctgggtttttccctaactacaggatagggtggggtagagaaaggatatttgggggaaattttacttggatgaagattttcttggatgtagtttgaagactgcagtgtttgaagtctctgagggaagagatttggtctgtctggatcaagatttcaggcagattaggattccattcacagcccctgagcttccttcccaaggctgtattgtaattatagcaatatttcatggaggatttttctacatgataaactaagagccaagaaataaaatttttaaaatgccctaattcattgcaatttttaccagccatagtcactccatgtgggagaacttaaatcatgattaccagagctttcaaaggtttgagaatagtgatgattatgaagaaaaatatcttatttgagcaaggattttgtttctttatgagtgttcattagatattacgatgaaaaaagcatgaaatggtaaaaattcagataaatataaaaacatgttctctagttttttttaagttaaaaaaggaattgtttaaagtaaaaattatttgggggtttataacatacccagaagtaaaatatgatgacaatggcacaaagaatagaagggagaaatggaagtataatgttgtaagtttcttatacatgttaagtggtgtgttattatttgaaggtagaatgtattaagatgaatattttaagctcctgataactattgaaaaaaaaagaggtatagccaagaggccaatggagaagataaaatagaacactaagcataattaattcaaaataaagaaataaaaaagggaaagtctggtaagacaaaaagaaaacaaactgtaagatggtagagtttaaaacaaccatactaataattgaattaaatgcacatggcctaaatattctaatgaaaagggaaagattgtcagaatgcacaaaaaaatctacaggccaacttcatgctctctacataatgccctctttaaatatgaaggcaaagacaggtaaaaagtaaaagaatgggaaaatacatgtataccgtggaatgctatgcagccataaaaaaatgagttcatgttgtttgtggggacatggatgaagctggaagccatccttcacagcaaactaacacaggaacagaaaaccaaacaccacacgttctcactcgtaagtgggagttcaacaattagaacacatggacacagggaggggaacacctcacaccagggtctgtcagggcatggggagcaaggggagggagagcattaggacacataccgaatgtatgcatggcttaaaacctagatgatgggttgatagatgcagcaaaccacatggcacatgtataactatgtaacaaacctgcacattctgcacatgtatcccagaacttaaagtaaaaaaaaaaaaaacgaaaataatgccaaccatggaagtattggtggctgtgttaatatcagaaatataagactcagaaatattaccaaggagaaagaaggatagttcataatgataaaaggatcattttattatcaacatataacaatcctaaatgtgtttgttcttagaaaatatgtcttaaatcacattataccaaaaatgataaaaataaatcagaaatagacaaattcacaattatattttagtattctagcactcagtaaacaataaaatatttaggaaaaaacttcatgaggacatgatagatttaaataacattatcaatgaaccaacgtgatctaatcaagatctgtagaatattccacccaatagtggcagaatacacattattttcaaatgctcaagaatattccacaggacagactatacactgggtcataaacacatataaataaatgtctaaataaataaatgtctctattgaaatcatacagaatacattctcggaccacaatagcattaaattagaaaccaataacagaaaaataccttgaaagtcccaaatacctagaaattaaaaagtatactgctaaacagcacctggatttaaaaagagtcagaaggaaaattagaaaatattttgaactgagtgaatatgaaagcacactatcaaaattagtatgatacactaattagagaataatttataactttacataattggaaaggagggaaactctaaaatcaaccatctatgttcccatcttaagaagctagaaaaaaaaagtcaaatgaatcccaagattaataagatcagaaataaatgcaataaaatggacaaacaataaagaaaataaacaaagtcaattgctggttttcaataaggctcaatacattcatgaatctctaggtagatggatcaagaaaaagagataagactcaaatccccaatatcagaaatggaagtgggtacgtcacaacaaatcatacagacattaaaagtattatgacagaatgctatgaaaatgccaataaacaaaaatgacaataaatttgacaatttacattgttaaattaaattaaatttggtgtaaagctttctccatatcttaaattcctacatagcaaactaacccaacttaacataactgcgttatgcaaacaaactacagcctaacttaagagtgttgtaataaatagctgagtctcagccaatcacaggctgccaagtgatcatattatgtcccccataaggcaaatgcctcatcacgccatgcccatataaggcaaacactgagctgtaataaattggctggttttgagtatcacttcctgtttttatctataaacactgccttcacatgttgctggacagagctttctgaatctttctgggttctgagggctccccaattcatgaattgttctttgctaaataaactctgttaaattcaacttctctaaaatttttattttaacaacatgaaatagaaacatttcttgaacgattcaaattaccaaaactaaatcaagaagaaatctctgtcaatggaagaaattaagtttgtaattttaaaaatccttctcacagagaaggccaaatggtttccaggtcagatggcttcattgattaatccatagtattctgtcataatactgtcataatacttttaatgtctgtatgattaattctattatacatttaaggaagaaacaatacaaactcaatacaaactctttcaacaaaagagcagaagaaaacacatcccaataatttacaagtccaatatactaacatcaaacaatgacattaaaagaaaaggaaactaaagacacacaaacatagccatgaaaatgtttaacaaaatattttttaaaattgaattcaataatatattaaaaaggatgatataacatgatcataaaagtttatgccaggaatggaaggcatgtttaacatgcaaaaaatcaatgtgattccacatcttaacagaatacaaaagaaaaattatgtaattatgtaaatggatgcagaaaaaggcatttgctcattcatgataaaaagtcctagaaaactaggaataaaaaggaattacctgataaggtgtgtccatgaaaaccaacaactgaaattttcaattttgggtgggggaggggggcgggcattttactttctccataaaactattaaattatctaatgtgaaagtggaattcagtgaagaaatgttccctactgcaaaaatacaaaatgctggacattctgtgaacagtttctatgcattctatataaatgaaactattaactatataatacatttattgaaaaaagaagatggccttctttttttttcctaatggctgttgaatttatttgcttgatcaataatggtcctggcaaaaattgaccaatgctgagacatttgtaatgaaatactaattttaaaagtccatgacaccttgatagaaattagagtttacacaaacaaaaaaggaaccttcgatatttccagcagctacaaggtgaatgtactgagaccgacaggacagcaagaaggcatttgcacatttatatctgacaccagaccacactttcagccaccagaatatcttctctccatattttaaaaaatagtgtctctccctctccctctccccacggtctccctctccctctccctctccctctccccacggtctccctctccctctctttccacagtctccctctgatgccgagccgaagctggacgatactgctgccatcacggctcactgcaacctccctgcctgattctcctgcctcagcttgccgagtgcctgcgattgcaggcgcgcgccgccacacctgactggttttcgtatttttttggtggagatggggattcgctgtattggctgggctggtctccagctcctaaccgagagtgatccgccagcctcggcctcccgaggtgccgggattgcagacagagtctcgttcactcagtgctcaatggtgcccaggctggagtgcagtggcgtgatctcggctcgctacaacctccacctcccagcagcctgccttggcctcccaaagtgccgagactgcagcctctgcccggccgccaccccgtctgggaagtgaagagcgtctccgcctggccgcccatcgtctgggatgtgaggagcccctctgcctggctgcccagtctggaaagtgaggagcgtctctgcccggccgccatcccatctaggaagtgaggagcgcctcttcccggccgccatcacatctgggaagtgaggagcgtctctgcctggccgcccatcgtctgagatgtggggagcacctctgccctgccgccccgtccgggatgtgaggagcgtctctgcccggccgccccgtctgagaagtgaggagaccctctgcctggcaaccgccccgtctgagaagtgaggaacccctccgcccagcagccaccctgtctgggaattgaggagcgtctccgcccggcagtcacctcctccgggagggaggtggggggggtcagccccccgcccggccagccgccccgtccggcaggtgaggggcgcctctgcccggcccgcccctactgggaagtgaggagcccctctgcccggccagccgccccatccgggagggaggtgggggagtcagtcccccgcccggccagccgccccatccgggagggaggtgggggggtcagccccccgcccggccagccaccccatccgggaagtgaggggcgcctctgcccggccgcccctactgggaagtgaagagcccctctgcccagccagccgccccgtccgggagggaggtggggggtcagccccctgccccgccagccgccccgtccgggagggaggtgggggggtcagccccccgcccggccagccaccccatccgggaagtgaggggcgcctctgcccggccgcgcctactgggaagtgaggagcccctctgccccgccaccaccccgtctgggaggtgtacccaacagctcattgagaacgggccgtgatgacaatggcggttttgtagaatagaaacgggggaaaggtggggaaaagattgagaaatcggatggttgccgtgtctgtgtagaaagaggtagacatgggagacttttcattttgttctgtactaagaaaaattcttctgccttgggatcctgttgatcggtgaccttacccccaaccctgtgctctctgaaacatgtgctgtatccactcagggttgaatggattaagggtggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtga

SEQ ID NO: 1666 - DNA, 28786 bp, Homo sapiens
  misc_feature (1)...(28786): n = A,T,C or G, or insertion/deletion polymorphism (see Tables 1-2)
tatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcactcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaamtgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctaaacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaacgatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaagacacaaagtcctctagcagttattggaaactcatcttcttaatacatgaatgtcccttgtactttttaaaatgctttttaaaaaacactttcacaagttctgcagtccaaagatcagccagctatggaacagattatttttcttcaaaatatcatttccattcagacaaaaatatgtattaaaagactactatatgtcaaacactgttagatgctaaatacccaaataaaaataatacatacgtcctgttctgcagacgcgtataagtcacagaaggaaacacaagtgacaggacaacagcaggttcagaaggataagtgcagatacgtaggtatacacaagatgcgaccaaacagcacatcagggaaggcttcctggggaacagatggcttcaatgtaggcattcagaaaacagggcaaaagccacttctctcagggaagacagcctgaccgggagaagatactgagtttactgtggggctattgcacttagaagacctgaaagtcatctaaggagaaataatacatagatatttgtggattatgggtggtctcaggagaggaatttaggccatagaactgagagtcattagtggcaggtgcaggttaaataagattttccaggaagagtgccaaaaatcagaattgccgagatctcagggtataatgagagaacatgatagttaagaggtggtttaaaagatgataaggaggatccaggtaaacaggagaaaaataaggacagggtagttcatcagaaagaagtggattatagtgcaaatgttattagtaactcaagtcagaggcactgagaagaacccactgaatttgaccttctgtagaggttcctgatggccaagatgagaggatcctcagggatgtaccagagacaagtcagaagcttagctccacgtgtgaggacacaaagaaagtgtctctgggacaggatgcagactgaaggcaaggttgttttttatcagttggtttgcacttatgtttttaaggtaaatgacatgtttaaatgttaagagactgggcagggaagccctgaagagacagctgagctcattaggaatttctaccaagaatactaaaaagtatttgcatctatgaagagaagcctattgtggtgtttattataacataacattagaaataactcaggtgaccgcgaacagggcaatagatacttctggttctacccagcctgacctcctctttattctacacatcttaaataaaactgtctgaagccagtgtgcatcttgtacgttatggattctaaccttccccatcactagattttggaatgacagcatcatgcacaggcttgatgtcattctccctgatttcagctacaggaaaaaggagcattcactacggtccatctctggctgagtccttgcagctatcaaaagtctaggcctcccttgcagtcctgaatctctcagaacccgaatcacaaggctatcaagaccatgcaaccctgctgtcttgagagaggaaagcttgtgaccacccacaaagacccaggaagagccctagggtcctagaagagagggaggatacagaaacactctttgcacttcgtctcctaatgcagagtccatagctcggagttcctgtaaagcagccacaaaagatagaggctggggatcccagagagataggagggccctgatagtaggtcactgtgtgcaggaatctggggaaggcagtgtatgaccctcagagctgggtctggacttcaaacttggctcgttgatctgctgtgtaaccttggaaaacttattcatctttttgagcttcagttttttcaaaataatttctaaataaaaggaataatttctaaatgaatggaatattatcttcattgaagattcctgtgagatgtaaatggggaaagaaactatgcaggagtctcataaattctggctgttattgctgttattattatgagggccagagggaacatagactatgaggaccagatagatcaatgagcccctaaaatctgtgatccctgaagcagcaattgatgtgaaccaccccatcactcaccccracgctcytgcgtcctcctgascactcacccttgatggccccagctcctcggagactcagcaggaaagccaaggagagggctctcaagatcacagctctgatatggaacattctgtcttcwgggcgcatgttgtggggtctataattgatgactgtgagcacaggaacagtgatgaggaactgaggccgagtggaggcagatgagactgaaactgtgggcctctagcactggaaatgggtggagaggaatcagcatggctgggattcacctatcagagaaatcatagagctgacattctctgttgctgggtaaagaggacgctggaaggtgctggggaagagatgggagaattttaggtaccagcgtggtcaagagagctccagttcacagttcattttcagagttagagaaagagatgtaaaaagataagttacaccttcttctgacggcaaatgttttccattatgttccttctcccgagccccacccccatcccagacagtcagatgatctttgatgttttttggtcactatattttaaatcatgttttatgttatgttgtcaatattttacaaaaatattctgctgataattaagaatgaatgtgctatctaataaaatatataattaatctttctttcaggtccacctccctgagatacctcctttttatttaatcatttctgcagaagtgttataatttctatttagaggttttaattaacttgaatgaagttgatctttaattgtttatctattcctggttacctttgttagtgaaatttctagataatttttatttttcagatttcttagtatttgatttttcctggtatttaaacagtgtaataacatttttatctttaaattactagtcttgttatttcattttcatataagaatacccaggacagcattacctgtggtaacaatgtgcgcccatattttgatcttgtttttaagaagggtttctctaatgtttttctgttacaggtaatgttaattttttattttatattctctttaccatatttaagaaatacttttctagtctcattttaaatatttcaattttgagctatttatttgatactcatagagaaggtcacaaaacatttactatttaatgtaatgatgaagtacatatattacgttaatattttatcttatttgtggtagccttaccttgcataaataataattactaacagattaggacatgagagattctgttattagtgctttgcatgcattacctcatttaaacctcatattaaacctgagggaggtattattaatgtctactgtaaaaataaattacctgagacatcgaggaagtatttgtctaattatctatggcaggtaaatgacaaggagaaaagtcccacccaggcagttactaaaaaaactgagtttttctccacaatcctctcctggccccttaatcctactagacaccttctactacataattattttcttctcttgcattttacatgctagccttctatttacattttaatattgatttaaagaaatgatgccaatttgattttttttgaaattagaattggtggtccaacaggatcacatttataagtgtctaaagtaagaagtaatgttctttgaaagtttgtaaaaatattcactctaaacaaaatagaatcagatgctttgaaggaggtggggtctttgatgattttttttcactttcttccttatttaccagtcaatttatattctctatggactttatttttccaaagcaatttcagacctattgatctcatttgatcttaagagctttgctataaggcaggttatatcatccccatattgaagacaaggaatcgaagtccaagagaggcagtgtcgttaaagctgcatatttacatggtagggtaggtggtgtgtccacgctcccagtgtaaggtccctagactgagccctcctgaccctgatgacagtcctgtggaagaacctggtaactcctgcacatcgcaggactcacagacctctgggagaaagtaaatatgaatgggtgctaatcttaaacacacccttggacaaaggcaagacagacagactcagacctcatttgagttctgagatgggtactctaatccctctaagtcatgccactgaatgaccttttacacactaagatagcactttttccacaacagaccatgtcctgtgggtgtgtgaggtgtggcagaattggggaaatgataatccctgtagatgggccagcagaatatttgagatcaccttcagagcaaagaaaacgcataatctccccaaacatcatgacttatctgactggttaaaatgagtatcactgtctttcctccgtcatcttaagtgcatcacaggctttatattttcagacctttcatactaactttctgcctagtgagcaatgactcatacaaagctcagtgtccattggttcttttctcagactctgtccaatcccagggtcacagaagactacttgggttcatggtctctaatatttcaaacaggagctccctttagcgagtccttcttttcctgactgcagctctttycattttgccatccttttccagctccatgatggttctgcaggtttctgcggccccccggacagtggctctgacggcgttactgatggtgctgctcacatctgtggtccagggcagggccactccaggtaagagccgarctgccattcttggagggtctrgctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtgcttgtctttggggaaaatgggaccaagaggtccwggataaccttggacagacaaggtttgcasagagagaagttggcaagtgcaggctcctgggcgtgttcayrtctgcatccagcctggaggggactcaggcagagagccctaagctggagtgtccaggctctgaggatcactgaggattcagtgctcacgaagaatgcctcttattccccagggtggagcaggagcccacaycccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctcaggatatttctttttatatatatatatactttaagttctagggtacatgtgcacaacgtgcaggtttgttacatatgtatacatgtgccatgttggtgtgctgcacccattaactcgtcatttacattaggtatatttcctaatgctatccctcccccctccccccaccccacaacaggccccggtgtatgatgttccccttcctgtgtccatgtgttctcattgttcagttcccacctatgagtgagaacatgtggtctttggttttttgtccttgcaatagtttgctgtgaatgatgrtttccagcttcctccatgtccctacaaaggacatgaactcatccttttttatgrctgcacagtattccatggtgtatatgtgtgcattttcttaatccagtctatcactgatggacagttgggttggttccaagtctttgctattgtgaatagtgccgcwataaacatatgtgtgcatgtgtctttatagcagcatgatttataatcctttgggtatatayccagtaatgggatggctgggtcaaatggtatttctagttctagatcyttgaggaattgccacactgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacytttcctgcttacacccttcctcctagacctctccacacccctcctaggacacacctaraaggtactgacatcatgtcacctcctcatctttcagggtagcaaggttggaatctcctgaatacagcccctcaagccctaaaacctcttatctattacctygggttcattgtccaggaaggggaggagaacttgaacttrtagtcacagaagggtgctgagaactaaccagcaggacggctcagccctgggaactgcagaggggtgaggctggggagagaggaggctggagcagcactggtgacactgaacagtgtcaggaggargtgacggatgcrgcryccccatcccataggcagagctgtcatgtgggatgagggacagtgttgggagycaccaaggaaacccagaggtgggggagcagagagcagaagggrgcatgtgatgctggrcagtgaaagggaggacrggcaaaggctgggttgaggtttgtagggggaatgagatgaggcagtggagccatgtgacagggactgagggtagattactggagctccctgcgtagaatgaatgttcaatcaaaayytgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaaytgaacaggcaggggcggatggatggcagaggaggaggaatctggactcaaggagctggggggcyctgggcctggaatttyagggtctggsgcccaasgcaccaggagaagaggcaggtcaggatatctgagtcaagacctgggatcttgccttagcaatgacactggagactaaaggtggactccatggtgcccttgagcccagccctaccccatctccactatcctctgccaccagctgtgcaacttctgcwaggggtgaggttaataaactggagaagttaatttgtggagcatgaaacagatgagcagaacaatcacagcaccttaatttccccagtgtgcccaagaacagagcaggcctgaagayactcaaacagaaacaaacatgtgccgtgtcactgataattctgtgtagacacacacctgccagacactgctcatggcactccctaggaagaacagcatgtgggaaaggctgccaaaattgttcatgtaaaaattacatcaatgctgtcttcctcggtgctgyctatgcagctggcagccatctcttcctccacatcatggcctccctcagactcctcatgaaggataagatcctcaaaaagaggaccaacaagttcatgaggcaccaatcagactgaaatgtcaaaattaagcataactggcggaaacccagaggtcttaacagtagggttcgtagaaggtccaagggccagatcttgatgcccaacattgcttatgggagcaacaacaacaacaaaaaamacatgctgcccagtggcttccagaagtttctggyccacagcctcaaggagctgaaagtgctgctgatgtgcaacaaatcttactgtgctgagatcgctcacaaaatttcctccagaactgcaaagtcatcatggaaagagtcacccagccggccatcagagtcaccaaccccagtaccasggtgcacagctaagaaaatgagtagaaagttcatgtccacgttttgtgtgtaaataaaaccataaaaactgccaaaaaaaattacatsaatgcctctaaacccaaaggactctacccccacaggtccctggttgttgtggtgattttcattgtgtaaaatacttyccacatcttttgacaccaagtctttctgcagccatgtttgaaaattaactttcaggctacagagtctttcttataccaaagttgaagaaagttttaagaaatatatttctacatytcctamatgcaaaacaacaggagcaagttgaggaattctcaagaaactggtcgagaagagagagcgcttagctatggaaaagagaragaaggaagggagggcttcctggaggaggtggcatttgaaccaggactgacatcaggatggaaatgtcagtcagggagttaagtagggggagcagctccgccctccacgtccccagctcctcccgcccctgttttttctcccagtgaccccamgtgaaacgtctccgcctcctccagccaccagcagaagggactgccttcccctcagtgctcgcccctccctagtgatcactcagtgcccctgagctcattcttttcagtaaattctctctctgcrtggtgagaaaacaggcctggagaggctctgcgacccgcttaggaccacagaactcgrtactaggaaaactcctattttaaaatcyagccctgrgtgggwagatttgggaagaatcsttaatattragagagagagggagaaagaggattagatgagagtggcgcctccgctcatgtccgccccctccccgcagagaattacstktwccagnnacggcaggaatgctacgcgtttaatgggacacagcgcttcctggagagatacatctacaaccggsaggagywcgygcgcttcgacagcgacgtgggrgagttccgggcggtgacggagctggggcggcctgmtgmggastactggaacagccagaaggacmtcctggaggagrrgcgggcagtgccggacaggrtrtgcagacacaactacgagctggdcgrgscsrtgaccctgcagcgccgaggtgagtgagggctttgggccggsggtcccagggcagccccgygggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgrgagcagagagaccccsgggacttcatcaggcctggcagctgactgcatgtggggtgaaaaaaggaagccacaggacagcgcacaagggtatggtgtggagatggaggtggagatggcacagcaggccacacagagaagaaacctacagggaggtagctgggtttgaggtgcttgaggggcagatgggtggtctgatgggcaggtagacagaagggtctgcagccggggaggagactgrgatacatgagaccatccagggagagrggacccagggggaagagcaaaggacyggatcctgggaactggacagttgtgatttggccaagacagaaaagcctgtgaaagagaccaawaaaacccaagtgcagtgtgaggagaggcccgcagagaagagtcttggaagctgaggggaggtgacctcagcagcacagtggacagcggtgccagtgacttgggaaggtcagaaaacagaagatggaaagtgggtttggaaaccagggagacctggggagagcaggttggccgcagcggcaggagctggaatgggagggggtgcatgaggctgagtgtggcgcatcctcctcggggctgagatggattttacttgtcttgggttccccacggctgkcacagggcagtgtctsagttcattcrtctttttccttcaggaagtctgggtgtaaagggatggagagaggtgaggtgtgtgcagtaagaggatttctcaaggatgggacaggaaggccttggagctttggcttcctcctgtgaacttgtggggtggggagcctggtgcaccaacctkwgggacytgagggagtagtatcaggatgtgggattgagccctggaccttttttctagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtgacatgagcttaggaaagttgctgaggtaattggttgagagaggtgttcaaataaaaataacgcaattggcaaaaactgttactaagactttgtagaggcaccaatcagtgacatggcagcattttctttcacagtaatcaactgccagattgcagacagccctgatgccagcctaaggagtgtgggtttctcctccaggcccgcaggtccccaacctcactcctctgaagactcttctggagatcctctgtgatgcacagatctccagactcagtgcccccagactcagattccctgggtrgggaggtckggggatctctgcttgtaatcagctccctagaggttcccatgtagccagataagtattgtcagaacactgaagatttttgaaaaatgaaaaagagaaggttggagatgtgtcttcagaagactactaagggtgctggctagaggagggaccagaggcagggagatgaggtaggaaactgctattatttgtcagggaaattgcaatcaaggcatgagttagaacagggaaaacacagaggcaagggagaggtggaagggggaggaaagaagtagtgacaattccagggtggatgtccacccaaatctagaagtaattgagcaaatgttttctgggcattagagaaggcaactagaacaaacaggaatccttgccttggtgaaatgtatttgaactgggtcagaaatgaggccattgggtatcargccttaactccagcgcmccctggaggtcrctgatgtggctccaggctgacctgctcctgtcaaagaatattgagcaagatgcctctcrtggaatgttctgggaccttaaaacagatacccaagtattccccctgatttcatggttcccagaagctctatggggaagaaattgtaggtaattcacaactgagatttagacataagttgaatagtgtaatggacattgagttaaccgaggtaatgaagtagtgagacacaggtgcccctgaaataaactcacattgagggaagaggctgacaatgtggatcagtctgaaaacaaggcaaaaatacaatagggagtaagggttgtgtgtcagttcaagactgtacttttacctggcccagcgccatgttagggtatttgtgttctccaggaagtagaaaggaaagaactgagtgattagggacctagaagactaatttgagacattcctcttgatgagctgttctctagggtagtcctctgaaagagctgttctctagtggatctccctgaatgaactgttctctaggagcacttgacccttttctgtgtttgttttttgttttgtgtttgtgtttgtttttgagacaggttctcactttgtctcccaggctggagtgctgtggcaccatcatggctcactgcagcctcaacctcctgggctcaagtgatcctcctgcctcagcctcccatgtagctagaactacagatacacgtaccaccatgtctggctaatttatttttctttttagagatgggttctcactatgttgcccaggccggtctcaaaaccctgggctcaagtgatcctcatgcctcaacctcccaaagtgctaagattataggcatgaccaccatgcctggccttttctgctttctgaggaggaaaaaggtactggtggcagagatccaaaagaaaagttgccagtggcagtgtggaaattcacctgagaacaacaggacaagctggggcacaaatgcaaagatgcagagggaggcaacacctggtcatctgtgagaccttcatgggacctgaagacgcagcacagaggaggaacttgaaaaaggacgggatttctactactcaagcatgtaggagctcaggatattctgtaaatatgaagattttgagtttttgtaggtgaggtaaaaaaatacataggttttttacagaataagacatgtaaagctctcttcattttctttgtattttcatgaagttattagattcacaggccaccataatgccattgtctgtatatcttaatttcaagatattatttgagtaaattttgcttcctttgtatcaagatagaactttgaaaaggtaggtaatttcacagttgatcaaatattctttgcccaaattacttttggttaaaatttctcctaaatgtgctacagagtgcaaactctgtctccctgccattccgctatatacttactaactattattttattcaagatcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccagsctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaggaaagaaggacaatctcaaattctatttcattatttttcttccacgctcctagtccagcctarggtgaaygtttccccctccaagaaggrgcccytgcagcaccacaacctgcttgtctrccacgtgacrgatttctacccagrcagcattcaagtccgatgsttcctgaatggacaggaggaaacagctggggtcgtgtccaccaacctgatccgtaatggagactggaccttccagatcctggwgatgctggaaatgaccccccagcagggagaygtctacayctgccaagtggagcacaccagcmtggayagtcctgtcaccgtggagtggagtgagtctctgatgaccvtctagaccccacctctgaagagcaggggactctctggctctggggtccactcatcttatcttctgcatctataccctggggccatgtccaaaccccatctttcttctataccagctcctgagcatagtttgaagccagggmaatggagacttcctgaccttggcttrggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatkctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaaagcctgcagggtgagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaawgtccctggagtcacagaaagaaggtatcagatgtgtctcactctgacatatgcaggtgtttatgaaactctgggatttctaaggaaggatgcagtgcagagacaggtcccagaggagacargagctgagagaccatccaaactgggaccacyttgtcactagacttcaaattttcaatattkatagagtgttttctaagagtcaggccctttgctgagtgctatgtgcagcaggatcaaaggcagccaggaggtagaggagtcttgaggtacatcagtcattggagttgaagagcagagattcaaaggaaagttggaactggagctttaaaggagatgtgaagtgggtgactcaacctctgactcagaaaaattgatacctgcagaagaaaaaacccggcgggcttaggactcccagctgagtgttgtatcctccatccctttccacctggtcccttcattttctacccctcacagttccctaacgagaaggtggtccacccaacagacaacrctgcctcagatggttatcaaggggtaccctaagaagaaatcatctcaccctctctttgtccccatttgtcaagtagcagtgaggccgagccaggggatggtgaaagtggaaggaggtgggagttgggcattgggtgtgaagatgctctttaaaggggttttaataaccacttgctaccaggccagtgaacacttaycatagttgatgccttttgagcatgttgcattgtaaactgtccctgaaattcctgtgcacttggcttatgggatgaaacatcctcctagttctcttgtctctcagcttctctgaagtctcattgagcaccttctcttcaatttcttttacacagtaagaataggatcagctgtgctaaactaacaaatacccagatatccaggtttggctcatgytacacgtccaaagtaagtcatscaggaagctctgctyatcatcgtactcaggaagycaggctgacagkctttctcctgcacatctgctcccagaacctccccagcagaatgaagggaacctaagaatttattcactggcttttaatgatccctcctagaaagaacacacttctcgcatttcattttccaatgtaaatcatatggctgcaactaacttcaaataagtgggaatacttgaaggtggaaaacatttaagaagtacacactaaataaataataaaatacttctacaagagatatttatggaggacctactgtgtaccaggagcaatgctaggcattatggatatcagcagcctttggctcctgaaaagcttacacactacctcctggcctaaggaggggcacagggatgctggcaacagtctatttcttcacccgggtactagttacatgggtgcttgcggtgataaccattcaacrtacattctattggtttgtgtgtttcttccaaatgtcccctagttcacaataraaagggcttaaatagagaagtaaaggagaatttgggaatttgaagcaaaagcaagaagccactgaatcaagcacaaatattgagctttgataaagattggaataagaaacataataaatgagayaagaaataggacttttgcaactgaagtgtaattaataaacaaaaagccaaactgagaaactgtcccaaggacaatatgatcgagtaaacaatagaaaatgtaaaggacaagtgaagagaaatgaaggatagaaacagacatctgacatcttaataattagacgtctagaaagtcagggaaatagtggaggaagaggaaataactgaaaacataatagatgtttagtctttatagaaagatgaaataagttcattcaaaatgctgcatagaatgtcagaytgttaaacaattttgttagagtaaaatgactgtaaacaaatgagctaattatgtgaattaagaggatggaaaagcagaaaaacagcaaaaagaaaatacatgtaaataataaggacaaaagctgaattcaatgaaatataaaaatagagaagayaaaatcaaattttgaggcaatgaaaactttaatgagacctctggcaagactcctaaggaaaatacaggagattcagaacgaaaagggtaaatgacatttatacacattttaaaatgcaaaatcttacgaccaactctatacatataaatttgaaaatttagataaaamggatacgtttctagaaagatataaaggtcaaaactacaggaagaaatagaaaactaaaatagagtagagaatatcaaagaaattgtcatgggaagcaaagaatcgccttccaaagggccctgtcctgatcttattgcagatgagggygtcctcccacatttccaggagcagatcatgcctcttacacgtgtgattctagaacatagaatggaacagaatttttgagatcattttatgaggttggttcatttrtatttccagagccagctaagaatagtacargagaacaggattgtggactaattttagccatgtcactgaatccaacagtacattayaaaaacaatacgttttgaccaattttagatttattctaggaatgcaatgattcttcagtgtcagaaaatatataatgtggttaacacattagtggactcygcaaaattcatattaatttaaactgaattcagctcaagacatagacagaatttaatcaatttcatgacatgttaaaggtagtgaaccaaaaatctatagcatatatatttcaaagaaatgaggtggattgcctttgagattgtgcaaaagataggatgtccttcgttgctggaaatgtttaacatagcattggaagttctgaacatcactctgcgggcagaagaaaattaaggctgtgtaaaatgtaggaagacagatagtgactgcagatgaaataatctaaatactggacaagactgcagccactgcaggcccaaagcctgggtttaaatccaagctttgcactttgaagctgtgtggtcttcacctctcccggtgtctgattccygctctgtaacatgaaataaataagaaccaacctccagatgtaaataagtgaacacatgagaagcacttagaatagtgcctagaacatagtaagcaactcaatgaatgtcatttctcattacatttgttaatnnnnnnnnnnnnnnnnnnnnccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtywgacagaaaagaaatgtcagaaagctctagaggccactgawatcagatartcggggaacaaacatgacctatrgcgagagdgggatcccaggctgggatcttaatgcagccagatgcatgaggtcccaagtactcaggctcctgcggagcgtccattgagtgatgggcaatggaatttggtgggatggaaatgtttctctaattatctgaggtggtttcaatggctgattatataacctttcgtctttcatttcagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgasctcacygaaaagactawtgtgccttaggaaaagcatttgctgtgtttygttarcayctggytccaggacagaccytcarcttccmaakwggatactgctgccaagaagttgctctgaagtcagtttctatcrttctgctctttgattcaaagcactgtttctctcactgggcctccaaccatgttcccttcttcttagcaccacaaataatcaaaacccaacatrastgtttgytttcctttaaaaatatgcaycaaatcrtctctcatyacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaakaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaattttcatacagacagaaatgactccccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgcgtagtaatttcagctgtcacataataagctaaggaagacagtatatagtaaataaggaccctttatctgtcttattttcccttttggcttcacaggaaacttgtgagaaacctatgcagcataaaattaatatgatttcaatccagggattcaacgatggaaggaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatgctcaaagagcccctggtgaagtgtttctctttcccactcttcacccctaacttgttacctcgtcttttccactctgtccctaatacacctataggatgactcataggagcccctggacccggggatgctgtcagatcgcttggtctttgagacaatggtgccattaaggacccccgccaggcccaccagcaggccgagggcacagaccagcatctccatggtctcaggcacctggattagttcatggacctctggggcaccaagggaagacagagttataaggtacagagagcaggggctggccttggatgtgggaggtgttgggtattcgaaaccatgagatggtgaaatttggataaagtgaccataaaacatgggattgaggaaggcaggtgctgaggggcgatgggcccaggaaataaaggtggtgccaaggccgtgagggcagagggagggcgctccataccccagtgcctgaggagaggctggtgcaggccccagtgctccccctggaggtcacaggtgtcctcggccatgggaacgagggtcagatagtggaacctgtgtaatctgagtttcttgctgggcaggaagatggtctctgcaataccctcaatgactggctccccattgcrcagccacgtgatgttcagcactggtgggaagaacttgtcaacatggcagacgagggtgttgggctggcccagatccacaggctccttgggaaagacgcttacctcggtgggggctccaaaaggggatagaacccaaggagcctactgccattggctgattcttaaaggttccaccaccccaagtcctatattcaccagattaggggccacctctcccaggcccatcctcctgctcccctagggctcctggacagggtcacagcttctcgtgctcctgacctggccccctcagcccagcctttctcttgagtaagaagaaaatgcctcctcctctgctgtcctaagaacccagctgtgtggacccaagatttctcgctctcagggaaggggctcattcatgagtgggcatcatggcctctagttctatgtgtggcagagaggccctcccatccctccagctggactctagaggaacaggcagctataggcagtgccatttgtggcccaagtctgtttggaccattgatccgggtgttcaagtgcttccttgccatgacgatgccagcaatacccctctgagaggaacaggcagctataggcagtgccatttgtggcccaagtctgtttggaccattgatcygggtgttcaagtgcttccttgccatgacgatgccagcaatacccctctgagcaccaaagtcaaaggtgtgaataaactctggtagaggccagaccatctccttctcatccaggttcacgtagaactgctcctcctcatcaaattcaaacatatactccccagaggktctgtgcgtctgcacaaactccgcatatgttgacacatggtctgctgcatgaaggagaagatggagaatgggtgaatacgtaggatgctacacagaatgcaggaagcaaacaggtaacaggaaggttattgggaacatgaaggaataacacagaaaatgagaaatgcaaatgaaagaaaagaaaaggagtgagaagaaacaaagacagaaatgacccatggacgatataggttgtttcccttgtccctgaagacttaacatccgtctatgataatggtaatgctgaatacagtaagataatatttattgggcacttactatgtgctaaacttactcattgaatcttcacacccccatgtagaagaacttattttccatagtagggaactgaccccagaggtaaagtaacttgtccaagtcacacaactcctggtagaaacaatattgagtagtcctcctacctcattcctgtaggatctcagaaaccctacaggacaatacattaaaaattactgatatagccataaagcaaggcagggaagtggaaggatggaataaatatttcagagtggaacaaaatcgtgaaggacatgaaaatacctccagagtcttagtgacatttatagacttcaagttacattcttacttttagaagaaaaatgataccttctataattttatccacaacacttacattttaggcagagtaaatttaaaagtattatcattcacataacattcacaaaattgtcttgtggagtgtagttttcaagtgtagtttcacctggaaatacaagttgttggcatttgaaagacctatgggatagtatcttagctttacctgatacataagaagcagcaactggttgataacaaaaagtgaattattattacagtgaattacagagagtttagggttcggcctggaagaggaagtgaagccaaatgacactgcatggttggtggtccctaagtgaggatttcccctcccagcccagcatggggagaaccagtcctctacttagatgcatagtgtgacagcaggttcagtgccgcacacggatggtgagggtcccccactgagtttagggtctagaggattactcacctacagaaatgaatcccaaaggaaaaagaaaaatacatggtgtatagactgggctacacagatgtaattggttcagcttaggttactttgtatttattatatttacaaaatctgaaaactaaaggttggcacattttgaagcaaattccacacttcaaatgttaattttcattcagttaataaatgctttttgtgaactttcactctctaggtaataaggatgaaactctaaagatgggaactttgtccttaatctacttgaaattcaagaataaaacagacaaagaaaagatgattgctacatgtgtggtttgatcaccactgagtatcacaaggtatacacaagagctactcaggagcaaaattaaaatacgatttaggaaaggttcctagggacagtgttcacctgcagatagcaaaacagagaaaggggaaatggcatttccagcaggagaagcaggctcaggagcagagaggcatgaagttgcaaggagaactgcagttcttcagtgtgactgaagccaggggagatgtgggccaggcagcactgtaacctgccttgtgtgctgatggcaagtgtttgcattttatcccacaggacataggaagttgtgaagtatcttaagcaggagagtaacacggtcagatttgtgtttggatggggcacctgtaggaaggatgggctggaggaggcgggactcaaggcaagaccagtagcacttttaagccctctggtgggaagtaatgaaggcgtaggccagggcaggaacatggggtgaggaggacagcagatggatttgatggcagtaatgacatgagaggccacaggaatcactaaatcacatgccagaagtagggatatgaagaagtcgagaataaccacgcaacgtggagaattgtggcatccgtgcctgcaaaggtgataattaagtgattgagagaaggt

SEQ ID NO: 1667 - DNA, 21579 bp, Homo sapiens
tccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggtgagcgggccagcatgctcggcagggccccagctccaggaccttgctggattctgtcttcgattctcctctcttctttttcttcttccttttttttttggagacagggtcttgctctgttacctaggctggagtgcagtggcacaatctcgggtcaccgcaacctctgccttccaggctcaagggatcctcccacctcagcctcccaagtaggtgggattccaggcacatgccacacaggcctggctaattttttttttttttttatgctttgtagagatgaggttttgctatgttgcacaggttggtcttgaacttctgggctcaagcagtctgtctgcctcagcttcccaaagtactgggattataggtgtgggccacagcgcccaacttcctccgacttttttgttttgcctgggagaagctgaggtaggagtgagtgaatccaaggatgagattggagcccatctcttccagttttctcccatgtgaatatggagctagatggggcctttgagtccatttatttcagtttgctcccttatgttacagaagaggtgagcaagtggtttgtccaaggccccatggttgcagagctaggaccggatctgacgggagtaggcccagtccagaagactggctggggttcagtaggtcccaccctgatctcagtgacttctgtgacctgactccaggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggtaaggagcctggggtaaccagtgtgtggagcaggaggttggccaaagacaggctgggaataggtaggcatccagaggccagtgtgttgagggtggggagtgtgacagattgggcctggagactcccctttcacagcttcccctgctcccacccaaggcccatgaacaggccctggctgaactgaccaagaggctgggagctttggaggagcctgacatgactggccaactggtcgacctgcctgaatattacagctggggggaggaactgacagagacccagcacatgatccaggtgagcaagtgtgagtgctgaggaggtgataggagaagggaagagaagatcgtgttactctaggtgctactaaacttagtccaagtgtctgtccctgtgatgcctcctcccatctgtcctttgctcttcagcgacgcatcatggagtctgtgaacgggctgaagtctctctcagcaggaagggtggtggttgtgaagaatcaggagcatcacaacgcattgggagtgatcctacaggtgagggtgatgggaatttggactccagagggtgggagggagcaagccctctctccattttccccacttggccagggcaggttgcgtcatcatagggccctcattttcccctcttgccctccttttcaccctctcccttcccatcaccacatcatgctcactccttcctcccaccaccccaagaagtctgctctgatcgcttgacttggttgcccctctctactggtgagctctgcatggttgcttcctgattcctgcccaagggtgggtatctggtctctgcctttgatgtctactcatcacacccccctctcctggcctctctgaccacccccaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaaggtgagagtgtggcagatgtctgttttctgccagcagtataagcaggatgcctgggtccatggcaatgtctgccctgctctccccttttcacagggccttgtgaccacaccgtggtcaagctccagccaggagatatggctgccatcaccaccaaggtgctccgggtgaatggggagaagatcttggaggacttcagcaagaggcagcagccaaaattcaagtcagagatgctagggaggcccttctcctccagaggggcacgtagaggcagggaggggcagtggtctgggagtttcctccagcctgagggagaccatgaagtggtggggttgtagtgagggggctcccccagcctaagggagactgtgaagtggaggttgtagtaagagggcttccacagcctgagggaggcttctgggggagagaagatcttaccccagatcttaagatctgctccctcttcaggaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccaggtaggaccctgggtggtaactcccaagctgggagtaggggcttttcctctgtggtcccctgtagactgaccgcccccatctcagcccttgtcctcagtgcacccctgctaaggggcaaggagaaggctgacgggtggctctctgcagtacctgaagctgcgggagcgaatgcagatacagaaggagatggagcggctgcgcttcctactgtcggatcagtcattgctgctgcttcctgagtaccatcagcgagtagaggtgggtggggcagtggttggggcaggggggctaggggacagcagtgtgtccaatgcccaccctttttcttgcaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcaggtaggggacaccacccctttctccctgccagggctgtggcattcctgaccttcaccttcaggtagtcccccaggtgaccccctccagccctgtaagtgccccaaggatggaaaatggctgccttcttgatctggtccttccctgtcctggagcaggaaggcaggccttaacctctccttctttcctgcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatggtgagtacctgaggtttgggattttgcagacggctggctggggagaacctgcccaggctgagtgcatccagtcctcaccctactttccccacagcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcactgttgtgtgcttgagttgctggacagggatgactcagctaagaagacagcgagagaacctcttagaaatatgcttttattatctgcacacagagatatgactgcctccctctaaagcattactatttgggagagggagtcttggggggtgatgggaggtcctgagtcatagcttccacataccatatgggcaggaaggcgtaaggtgcatcttggtgtacagacacggtgactgggccgccaggctcccaagagaagagatgaacgagcctggggggcagatggaggcatcagttgagggccagaggctggatcctgggatccagaggggagggacagagctgaatgcctcacctggggtcatcctggacaaccgtgctctgggcaaagctaaggaaggcggcacagaagttcatgcacacagagggattccagccgtcacggtcattctggagcaggcagaggaggaggcagaagatgggcagtgggggtggtgggaggagagaaggcaggctgttgccctggatgctagacctgtggtcttggtgtttggggatacgggtgggagctgcaacatcgttcccttaccctgacatattcaaacatcttcatggtaggaaaggtcttgagggaagagacaaaaccgtctgggttacggaagccagcaacaacattcgggacccctgggaggaatgactgagcccaccatttcaggagcttgtgtctgacaggaaaagcaagggatcagtgggacccctcgtgcaccctccattctgccttcaccctcctccccaagtccctttcccagccttcaagcctaagctctcgccctgcccaccccgatcctgaacctgtagaaactcctccattggccagggctgtgcatctccttggaggtcttgagctccacatagcaggttgggggctgtgtggatggggcttgggggtctgtgcagtctacctcccctgagaagagcagagggtggcttcccaggcggctgcgtagcacagagcagaaggccacgttggtgttaacctccccagaggggtctggggagcttccaggtttgtctgcacaaggagagaagcagcagcaggcgtggggggctctcaacctctgggaaggggaagggggctatgaagcaggggcaactcacctgcacacatgtactgctcaaatttgtatcccatgtacataagctcccggaggagcggtggccgagcaagcctctgggcccgagcgttcggtgtctccacttcactcaggtatagtgttccctggaaccgggaggctgccagctgccagccctcctgccgctcatacggtgtcgtcagcagttttgtcaggtgcccccgccacgtcactatggcctctgccagccagcctggacccctgagaggcaggagttacaggctgaaggtctgacacaagcattagtgagatgctcccctcgaagaatagtcttgtttcttctaaggactgattctcaccccggctttggctctcctaattttagagggtaggtacgggtctccagatatactgcctaccacgctttgctcacccctccaaccggcctcggtgttccaggagccagcacagcaggtggtccagcctttcctggacctcctcgtcccggggctggtatcgatccgggtatccgtctctgaggtcaaagttggggcctggaccgttagtggggggtgggctatagtagcgcagggctcgggcatctccatggtactggcgttgagcatccagggagaagcagcccagttccgaagggcgccggtagaaaggaaagggcccagagtagagggcagggtctgtgggcagagaaggtgctggacgaggtagtttgttccgaggctcagctacctctgtcttctcagctcctctcttggtccccctgggatccatgaggtcctaagacaagcaggggtacagagtttccattctacagaggaggcctggagaaggatgactggtttaggactaagcgagccacctgatcgccaggctctggccttgaaacattcaggcccctcagacgccaccgcggccaagctctcatcctgcctctttccttgcccttcacccaccctccctccaggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggmcaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccaggtaaccatggcaaccccgggggtgggkcctcgcttccggtagccgagagttttgttagaaccgcgtccccgccccagttccctgtccgtgagccgatttatctgcccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctggtgaggggcgtcggtgcgaccgccggaagcccctttcctaactcctggaattccctgtcactcagtcactccgccagccgttcagcaagcattaggcctttcaggcgagggcactgtgccaggcactggggtgccacagagaccctgttaaaagtcccgcaggtagtacagggcatttcaaatcatggaggtagaagaacgaggcttttggggaaaccgagtcatggggcatggttcgaacatacagcgctgggagtgcagtcagacgtcagatcatgacaggccttgtacatcagtgttgtttccatcttacactgaggcgatgggctggtagagaatatcatagagagagggaatggtgtrttggagatagtggatgaggcagggaggtcagctaagaagatactgcatctgagaagtggtgaaggcctaaattaggtcagtgcagtagggagggagaggagagtgaggaagagggaggagtccaggacaactcagactttccagatgactgcgtggctggtggtattaggagcacatttagttgttggactacagataatgtgtttaattttatacaagttgagttgatggtgcatgtggagcatccaaagacaaaggtattagacagttggatatgagagttggagagaattctgggccagtgataatagaattacaagtcatggaggtgtgaatagcaagtggttaattctgtgatgtggtgagatccagtaggaagagtgggtagaggagtgatttctaacctttttgtaatctttagaaggtgataaaagctatggctatctctctccagaaaaatgcacgtttgccacrtatacatagggtgtatgtrtagttaggggggaaatattttactaatcctgcgaggtccgtggttaaggactccaggtttagagtggaagttaatagggtcaaatccacaatgctgggaaacaccatcatttaaggcagtgttactgaatatatgagctgagttattatgcctgtgtcaaaattacrtgggctgcttgttaaaaaaaatacaggttcctgggactcatccaaggttaatgaattacgctctcttggggcgggatttgggactctacatttttgaactgcctcaagtgctttttaagtgtgccttaaaatttgagatccactgacrtaaagggaaagcagaagaagaggaatctgtgacagaggcagagagggacttgcctgagttaagaggaacccagaggccggcgcggtggctcacacctgtaatcccagcactttgggaggccgaggtgggtggatctcttgagctcatgagtttgataccagcatgggcaacatgacataacccmakctctacaaaaaatacaaaaattagccaggcgtggtggtacgcgcctatagagctactggggaggctgaggtgggaggattgcttgagctggggaggcggaggttgcagtgagctgagatagcaccgctgcaccccaccctgggtgatagagctagactttgtctcaaaaaaaaaaaaaaaaaaagtaacccaggaagaggcctactgtgaaagtaaagagatttttgagaaagtgaagtagttggcagtattagaacctgtgattcaagacagtggtctaagaagagggaagaggtaaagtaaaatataaactgaaatctaggctgagtgtggtggctcatgcctgtactcccaccactttgggagactgaggcaggagwatagcttgaaaccaaaagtttgagaccagcctgggcaacaaagtgagaccccatctttactaaataactgagatcccatctctactaaataaataaattaaaacacaaaaattcttagctgggcatggtggtgtgcacctattgttctagctgtttgggaagttgaggcagaaggagtgcttgagcccaggaatttgaggctgcagtgagctatgattgcacgactgcactccaggctgggtracagagggagaccctgtctctaaaaaaatgaaaacaacaacaaaaaaacccagaactgaaatctgtccattggatttagcaggtagaaggttaatagtgatctttcaagaaaagaggaaagaaaaggaaggcagtctagcactcacttgaggtgagctagtctccctgactaggtctcccgtgaggaagcatgccagatggaaccactccttaaggagtatttgttgattttaatgtattggtgttagcttttgtttttaaaaacctttaaaagttgcagaatgaaaatataaacatatataatttaaatgatgtttataaagcagatacctatctagccactccctaggtcaaactatagaatatgaccagtatcccacatatatccctctctgatcaaaatgtctctgatcagaatgtccctgggaggtgactgctgtggtcattgttgccttagttttcccttttttttttttttttttgaggtggagtgtcgctctgttgcccaggctggagtgcagtggtgtgatctcaactcactgcaacctctgcctcctgggttcaagcaattctcctgcctcactgtcctgattagctgagactacaggcacgcgccaccatgcccagctaattttggtatttttagtagagatgggggtttcatcatgttggccataatggtcttgatctcctgacctcgtgatctgccctcctcggcctcccaaagtgctgggattacaggcatgatccaccgcacccggcctaattttgtatttttatagggatggggtttcaccctgttggccaggctggtctcaaactcctgactcagatgatctgcctgcctcggcctcccaaagtgctgttttttttttttttaattgtctttttgataattccactatttttttttttttttgaaaagtctcccatgtctacctctttccacacagacacggcaaccatccgatttctcaatcttttccccaccttttcccgctttctagtccacaaaaccaccattgtcatcgtggcccgttctcaatgagctgttgggcacacctcccagatggggtggtggccgggcagaggggctcctcacttcccagcaggggcggccgggcagaggcgcccctcacctcccggacagggcggctggccgggcggggggctgacccccccacctccctcccggacggggcggctggccgggcagaggggctcctcacttcccagtaggggcggccgggcagaggcgcccctcacctcccggacgaggcggctggccgggcggggggggctgaccccaccacctccctcccagacggggcggctggccgggtggggggctgaccccccacctccctcccggacggggcggctggctgcgtggggggctgacccccccacctccctcccggacagggcggctggccgggcagaggggctcctcacttcccagtaggggtggctgggcaggggcgcccctcacctcccggacggggtggctggccgggcagggggctgacccccccacctccctcctggagggggcggctgccgggcggagatgctcctcacttctcagacggggcggctgccgggcggagggtctcctcccttctcagacggggaggctgggcagagaccctcctcacctcccagacggggtcgcggccgggcagaggcgctcctcacatcccagacggggcggcggggcaaaggcgctccccacatctcagacgatgagcggccgggcagagacgctcctcacttcctagatgggatggcggccgggcagagacgctcctcactttccagactgggcagccaggcagaggggctcctcacatcccagacgatgggcggccaggcagagacgcccctcacttcccagacggggtggcggccgggcagaggctgcactctgggcactttgggaggccaaggcaggcggctgggaggtggaggttgtagcaagccgagatcccgccactgcactccagcctgggcaccattgagcactgagtgaaccagacaccgtctgcaatcgcggcacctccggaggccgaggctggyggatcactcgcggttaggagctggagaccagcccggccaacacagcgaaaccccgtctccactaacaaaatacgaaaaccagtcaggcgtggcggcgcgcgcctgcaatcgcaggcactcggcaggctgaggcaggagagtcaggcagggaggttgcagtgagctgagatggcagcagtacagtccagcttcggctcggcatcagagggagaccgtggaaaggataattccactattacttgtcttttggggtttgtttttattctctctttgagttttgtttccttatgcgcccagttacttttgaaaatgttctgggcagatttgcctagattaataaatgccctccatgttccaattacttttttttttttgagacagtgtcttaccctgtcaccaagctggagtgcagtggtatgatcttggctcactgcaacctctgcctcctgagttcaagtgattctcctgcctcagcctcccaagtagctggcattacaggcacctgacaccacgcccagctaattttttttttttttttttttttgagacggagtctcgctctgtcacccaggctggagttcagtggcatgatcttggcttactgcaagctctgcctcctgggttcacccattctcccgcctcagcctcccgagtagctgggactacaggtgccygccactatgcctggctaattgtttttttttttgtatttttagtagagatggggtttcaccgtgttagccaggatggtcttgatctccggacctcgtgatccacccgtctcagcctgccaaagtgctgggattacaggcatgagccaccgcatctggcctatttttgtatttttaatggagaccgggtttcatcatgttggccaggctggtcttgaacttgaacttctgacctcaagtgatccacccttagcgtcccaaagtgctgggattacaggcatgagccaccgtgcccggccccagttatttttatttttattttttgagttagagtctcactctgtcacccaggctggagcgcagtggcatgatctcggctcacagcaactttctgggttcaagcagttctcctgtgtcagcctcctgagtagctgggactacaggcacacatcaccacgcccggctaatttttgtagttttagtagagacggggttttaccatattggtcaggctgatattgaactcctgacctcaggtgatccacccacgtcagcctcccaaagtgccgggattacaggcttgagccatctcgcccggcctacttagatgttatattagtggtaattcctgttatcctgtgagctctttagtgtctaaacaattttttttaagagatggggtctcactgtgttgcccagttgcaatcatatcttactgcagcctcaaactcctgggtcaagtgatcctcttgccttagtctcccaagtagctaggaccataggtgtctgcccccacgcctggctgtttttacattttttgtagagatgtggcgggtgggggggtctcactgtgttgcccagactggtctcgaactcctgtcctcaattgatcctgctacctcagcctcccaaaatgctgaattacaggcatgagccactgtacctggtcttaaacaattttaaaataacatttttatccaggattttagttaattttcaacaggtggattagttcttgctgtattctcgtaaacagaagtcctggtttatttttatttgttttaaacattgaatcccatactcctccccaccttaccctacccagaatttagactgttaatgttttgaagccacagcctgcatcttaatcactattttatcttagtgcctggtcttagaaattatattgactctttgatagaccatatataaggcaggtggatgagaatgtgggtagctagttggaaaaggctgcttggtcatttgcttgattattttctcacacagtttttcctttactaagagaaaatgcccccatattggcaaacaaaatctccctgcctgagagcrcccagagtatagcagagcatcttaccctgatacgcctcttttcactctcttctctgtggagacagaaggagcttcaagagcagggggagatcagaatcgtccagctgggcttcgacttggatgcccatggaattatcttcactgaggactacaggaccagagtatgtgactgtgtgcrtcaggggtgctggggggagggcacaggttgggggagacagggaasttgggaaacagaaataaaaacaaaagaaagaatttccctgcccccacatcccatggagagggcacagggccctggtaaatagtaatatgagggagagagacaggagggaaagagggaggagtgagagggtaaagagggggggagaggagggggaggaggaggaaggaaggagggggaggaggagggggggaggaagagggggaggaggatgaagaggaggaggaagaagaagggtatgagaggtggaargatctgagcaagaggtaagacaggaagagaaatgctktcctgggggtggaggttggtagagagtgagggtggggatggaccatgtctctcatctctgcttgtaggtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttcttkttaataaaatgacccaagtttgtattcctccccacaagagaggaggcctatcttacctgggccttagaaagagccctgaaatagaattcagttcttggtggcttatcaaaagcacacaggggcctggcaggaastgtaaaagcttgatgttaatcatactgggactaagaggatagagaatggtaggagctgggatacccctaaacattcacattaaaacaaaaaaaacccaaagctaaaaaacaactgggcaggagctaaataaaaatctaattttgagaggctgtatctggctcaggcctcctactttgtaacccatggaatatgtgaaagcatttgaaaaactatagcactgatctcacatgggcagacacactctcagagagatgtggtgggagccatggcgcagtctgcctaggcagtggcaggagcgcagaagactctgattcctctcctcggtcctaagaccgaatgtgtgtcaggacakgtggtcagggaagagaagctatttaactgaaccagtaatagtagcaggaaaagaaaaagtggagggagggcagtcmaggtarggggcctggaacaagcaactgcaccaacagaggcagttggtgcgagcacagaaccaccccaggctgggattttgttatccagtctctcttgcatggttgcccgtgtttctggagacttgtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaaggtatcccatctgcagctcaagcctgcagcccctcaccttttggtggctcctcaggcctctaggccttattcacckttcccctytcctgtgccacttctcctctagggcgccaggctgtccttrgcatggtccggaaggcaaagtaccgggarctgctcctatcagagctcctgggccggcgggygcctgtcgtggtgcggcttggcctcacctaccatgtgcacgacctcattggggcccagctagtggactggtgagtctttccctggcctctggcagattatggagcaatgacccaaagtgggatttcctcccagctcatgcttagtttcctagtgaaggccagtggctctcattcttctctggaacccgggagcaccccttcccaagttctaagttctcctcacagcttgagcctaggcgtctggctccagccttgtctttctcctgcacagcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtrctgttattactctgtcttgaaataggaaggtgggatttctggggaggctggtgaaggagggcagggttcttttctctaygtgtcatgttaaaattgccaaataaagtacctctgcctgtgatattttctggatgtcctttatttactgtgacgtgtgtttgggtgccttgtttaggggtagaggtgaagtctragctttgcctcattcagagaggaaaggggtcaggggttcactctgacgttcaggccattctccctgtggagtggtgagggtgtacctaatctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggtcctggaggcgggatgctgggtgcttggattggggcagggctggcatcgggacccgattcaggagtgagggagagcaggggtggaggtgtcagagcgaagtctgactgctgatcctgtctgttctccccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtaaccagaccccatgccctcctgctgcttgtgggggcctcctgccctgttcccatctgtcttgtaagtgtcatcatcttcccactggcctcctcccctcctgtcttcccaccctggcattctccttccacgtttctcccttggtctctgtcctttttggtcagctgtctcttgctctgtgacccgctccctctccctctccctctcctgacaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcggggtgagtctcagccccagggcctcaacctttaaccccctccgagccctctcaggatgagtttggtgccccctaagtgagataacctgaaagaaagtgccacacagaaggggtgcttaggaaacatttgtcccctgctccctctgtggagtttgacccaccctccccttgcacatggacccctgctcacctctctcctcctccactcccagttcggtaccgggtctttgctctggatcagaagatgcgcccgagcactgacaccatcacagtcatggtggaggtgagtccccgacctctggmcttcctgatcctggccactgatgtgacctcctgcctgtgagcacttctccccttgcagaactctcacggcctccgcgtgcggaagaaggaggtgtacatgccctcgtccatcttccaggatgactttgtgatcccagacatctcagagtgagcgctcccaatgtgggggctgcccccaagctacaccaccccaattcctgttaggctctccacctcccacacagaggcacgtccccagatgccctgaccctcagcctcctgagcctctggttaacccccacagtcctcttcccagggaagcaggctgctggctctccgtgccccactgtacagatgggctgagccccttccttgtccattctcaggccagggacctggaagatctcagcccgattctcagatggcctggaatccaacagcagcacccagtttgaggtgaagaaatatggtgagagctggaaactggagggacaggcagctgctttcctgaaggaaataagggtggaaggagaggtactgggagcagctcagggcagggagatatgggtgccacagccctgagcagaggggagtctttgagctggagtctgacctgcctatcccttcaccctgggtcagtccttcccaactttgaggtgaagatcacccctggaaagccctacatcctgacggtgccaggccatcttgatgaaatgcagttagacatccaggccaggtaatacctccctccccacctctgcccaccagcaccgggtcctgctccctactcagtatgaatgggctcctgcttccctgccctcgggccattattccccccagcccttggcccaccctcttctctctgccacgacaggtacatctatgggaagccagtgcagggggtggcatatgtgcgctttgggctcctagatgaggatggtaagaagactttctttcgggggctggagagtcagaccaaggtaggaaggagaataggggctggggaggggaaggggcaagggaggtgaggtgggagactcagtctcaccctatgtcctgtttctttctatgccccagctggtgaatggacagagccacatttccctctcaaaggcagagttccaggacgccctggagaagctgaatatgggcattactgacctccaggggctgcgcctctaygttgctgcagccatcattgagtmtccaggtgggtgactttcccttattgtaaccccagacccttgcctctgacctctgagctaaccctctgtcctccggcaccaacaccaccccacttctcacatctcatctcagactcaaaaccaggaaacacccaggagacctggtttctctccaactctgtctctgtgactcggcccttttccctggctgagtttatttatttctttgctcgttctgctcattccttcactcctccagtggacatgtgttgttcaatgccccgtgctaggcctcagcatgcacagacatgttggggaccagcctcaacgccacccgtagggttcctgaagtccattggtgacacaggaatgagaagagacaggttaagagttcataaagagtgggggccagggggccaattgcaaaatggaggctgcaaaaggctcagagctctggtctccacactattttttgagtacagtcactcagatctaagaagcagatgttcagggagaaacagtgaaagggaggcagtgggtcataggcgtaatctatagcaatagagttttaaatgaatctcctttgtgctcaaacagcatgtctttaaattatcggagagtagctggtggaagtgggcttagctagaagactgcatgtctgtccaatgcttcaaaggagggtctttctccttgaacacagtgtttacagataagacagggggtctcactctgagcatgggaacatgatggcaattaggaggcttttcttctcagaggcctcttgtggctttccacaacttattgtctcatatttttatggacagtttatacaggcaccccacaagtccttttcccaacatgcccccctccstttttttttttttaaccgctattgctattatggcttatttgtggtgtttggtctgttttcagaagtgtcttttgcatctgtagactaaaagtaaacagcataaacagatacacattaaagtaaaatttgtaatagttgatcctttaatggtcttaatctgtttaagaggatttatgtttgaaagtccgtcagtagctccaatgagaatgtcagtctcaggcaggagggttaaatgagcctgagatgctttaaaaacctgtttttttaaaatttggttatatttaatgttaaatttttatttttttcttttagatgatgtctaactttttaaaaatgatgtttagtagtattatacgaatggggagttatgtagaaattggaagtatttcaattacattgtacttctaattgatgttttaagtttattgtacgatcttccatttaaataacagtctgtctaagatcatttgtttgatttgtcaattgttggtctatttgggtctgagaattccacaattttgaggaattttttgttaactatttatatattttgtagtttgaacagaggagtgtaaagcaattccagcagccgcagcagtagctgtgactgcaataaggcccataagactgttataagggtaaaaataaatctctttgttttggtaaacacttttttttaaaacatttttgtgacaatatgaatggaaggagaggctttctaaggtctattgagggaaaccagtatccaaactcctttcttagtttttatcagtaacacagatgtttttacaccgaacgtggaattaatacaggtgaaaaggtgacagttttgacaagtaatagtttgagaattaggtcgaatgtcaatatttttgaccattaacataaaaggagggttgacacaactctgaatgggcactgttttgttggaagaaaactgatacgcaaattgaagtttttaaccttttttttttaaagataatatatttttttctaaacttaaatatgagattgggccattattaactttcataatttggagtgtttagggcctattattggattaattattttgggatgtgggccagctgtactaaaattggtccaaattatgggaaaatgagcacgtttttcagtgtaagtagtgttacctttttgatagtatagtttctgttttagttttgtcttgtatttattattttgatgggtacaattaactgtaaaggtcccctcaggggaccaattaatgacaatttcataggaattattttgtagtaccatagtgtgatcagagatgtaattttttttaattaatatttttaaattatttgaccattgttaaggttgttggcacctcttttttgggggcttaaactgttaattgaattgaactctgtgaatgatccgggctccatccagaaaataaatgataggatactggtctttgattatgacctggaattttaactagtcaatgttgtcggtagccttttaggcaaccgatagttggccttatgtaaagaggggggaactgataacctatggacacatttattaacttttttttttttcctttgggtgagagggcccatgagtatttgtaggcttagggatccaaacgctattattaacataaacttcaactgggggttttaaccatgtgacaggcctaattaaaggcaggaatgggacacatgcccaataggtataattttgggctgttgtagccacaggtttgttaggcgaggaggtcactgtttttattttggctttgtattctaggattagtaaataacagaagacaaacatgagtataattagtaacttttttttttagtaaaagagtgacctgtagtgttacttggcatcttagtttactatatgttattaatgaggaaccccactgggggtatgttaatttattctagctaagcagttatgttattagaagctgagaagggggtgtttgttaaagtaacagggcagaagaaaggcggatttaagatacgagcttaatacagtgtagcaggtataggtagtaggcaaagtgagagaattaaaaatgaataaattatttggcttagacttttgtttttttagtataatgtctgaggcctgtgttgtttgtggaagtcgcattgttgaggctgtagttcctgtagggtcttttttaggctggttcaaatgttttttta

SEQ ID NO: 1668 - DNA, 58337 bp, Homo sapiens
gagggtagaaactgcctcataaggggaaggaaaaaaaacaccatactatatcccgctttatacaaactaaatattagttgaaatcttatcaatcatcaaaagttactagaatgaaccacagcagctaaaaaagtttcatttagtctctataaagatcacaaatctttaatgtggtttcaaagtaaagacatatcactttaaaggaaattaaatcgtggtagtacctaattgaaacagcaataaaaaattataaacagtgtttggttcaatgaggtacttcaggtcacacttttaaaagaatccaaagactaagaacaacatttgataaataaaagatggtgcatcaaggaaggaaaatatgaaataatatatggtgattttaaattggaaaatctatatttttatcaatataaaatgtaataattcttttgatataatagcaattaatttttagtgattttaaaaacagaattacttcacagtaattataaatttaagaaccagtggagagcatcacataaacaataatttgctgcaacacaaaatcaattaaatattaattgttctccaagtaaggaactacacaccaattctacatactggtgttagcattataagataatctttgatttaatttttcttagactcattctcagctgaaatgtgaacatacggaggagaagctggtaaaatttcctatgtctatttgatttactgagcacgaaaaaactgaaagctaagtggagctgagaaagatctagaaaatgtagagctttgagaaaaacttttttaacaatatatatccaagcatgattcaataataagtaaatgtatcacaatgtataagaagtttgagaaaaacataaagtttcattatatattgctacattaatatacaaatatagagtaatcctcaaccaataattcaatttttaaaacatttcttaataaacaaaattgaataggttccaaaatttccttatttgctagttatgtagaacttagaaaacaggcacaccctcccaccacactgcctcaagtggactaacactaattttttatttttccctccactgtcactggaaatgagttagttctgcccccaacatctctactacccccaacatgcctccactcccagctcagtctccttcaaaaaattcaatggtaatggtttccagttaggacgacaggctatttattatcgtacttattatacttaaaacattggtcatctatcatctcctttctttttactttttgagggttccaggtattaactctacagtttctttttctggtctgtcctctgttgcctgattcgcactactctcctcccttgacctattgctttgctggtctgagagcttctctccaatcctagactccctaaggcaaactttgaagatttcgccgggcgcggtggctcacgcctgtaatcccagcactttgggaggccgaggcgggcggatcacgaagtcaggagatcgagaccatgctggctaacatggtgaaaccctgtctctactaaaaatacaaaaacaaaattagccgggcgtggtggcaggcgcctgtagtcccagctactcgggaggctgaggcgggagaatggcgtgaacccgggaggcggagcttgcagtgagccgagattgcgccactgcactccagcctgggtgacagagtgagactccgcctcaaaaaaaaaaaaaaaaaaaaaaaaaactttgaagatttcaagggttggacttgctatgaaagacaatcaagtgaagactaatgatccacctcctcacctccctcaccctacgcccatattctttccacagagacaaaattgcttttaccagtgacatcaagaactattcaagattcacctacatagtaattatcccaggaatttcacttgcagctactactgtactgagtctcccaatttagcgaagaaatgaaattaagtaaaaatgtggccaagcgcagtgactcacgcctgtaatcccagcactttgggaggccaaggcaggcggatcacgaggtcaagagattgagaccatcctggccaacagatcgagaccatcctggccaacatggtgaaaccccgtctctactaaaaatacaaaaattagctgggtgtggaggtgcacgcctgtaatcccagctactcgggaagctgaggcaggagaatcgcttgaacccgggaggtggaggttgcagtgagccgagatcgcgccactgcactccaacctggcaacagagggagactccgtctcaaaaaaaaaaaaaaaaaagatgtactctactttttctcagactccaagagtaccatactttgtcctaaagtaatacagcatctgagtatgcggtctgggttacagcaaggtcctggactgaacatttaaaacaagaataatgacaacaataatacacacacacacatattcttaataaaatgttctttaatgtgatatatatatgtgtgtgtgtaaaacgtctggtgaaaaaagaaaaaagcagaaactgaagatttctaactgaaaaaattcttctgatcatccatgtaaaaacttccacaagtagtcaacaataaaatgttacttaaatattactaatgagacattcatgaatttgaataaacaaaatgcttcatgcttgtaaagaacacaatatataactttaaaaatcccatttatctaaaaatatacacactatctacaatacagcagaaaaacatttcctttttcatatattaaaactaaatgttaccaactaatgtgacaattagaattttcaatcctatttaaaactttgggcccgtaaaggaaaatgaacaccacaacagttaaaatgtagattttcggggcgggaaactttttcaaattatgtatgaacaggctgaacatgacaagtaaatgcttcaaagtatatgagaaaaattagaaaccataagataaaaatgtaaatactaaagtctttcctatcatagagaatagaaatcaaggtcataccaataacttactaatttactcttctatgaaggttttcctccatttttgttttcaaattattatttggtttaagttgccatcacacttccacccacatcatcaagtctttctcaaacacgagcattatcaaagacagagtggcactagtgaaagcctatttcgttattttcctatttctcctctccatttgcagagcaaatgaatatctgaagtctttataatctcttttcaattaaaaaagaaaatggaaaaagaaaaagaaaatccgggacacaaagtttgagtctattaataaagacacaacaaaagagggtcttaaatgggaactgctcccttgccccgagaaacttagaataacactgtactcagaaggttcacattataattatggctgagaaaggagaagcatacaaaagggtctctttttgaataatgactccagaagctcaattaataaaatcttgtcaataaacacatatgcgttctagtatcttcacttcaatccataattaattatcttttccaggtctcatctactggaagcataagtgaaagcataacactttaatccggatgagtagcggcataatattagggaaatttcaaacaatcaggcaattaaaactacatgaatgtactaactagtaggataaatccctatactctgaatttctaagattaaaaaggtgatactaaaaataaggtatcttcacatttatacttcatatttttagaaagaaaaattaactttatttgatgcatagtttgagagaattttttaaaaagaactttctaaaacaaactttcagattgcttccgtaaatttaatgctaaaacaattccaaactaaattccaaatacaactgacagaactaagctgactacataggaattagcaaagcaacactgcagtactatgcagaaaaaacaatttgttaaaaagactgcacagaaaacatcccatgctggtacctactctaaagtgaagtaaaaagaactgcatcatacaaaaatacaaaaaaaaaagaataaaagactctttctatatcaacagcagttaatgcttcaactactactaacagctggagaaatagctccacctctatatgagatggagttgggagagatgaggaggtgaggaagactatcatccactgaaaaccaactctctaagtaaatttaagttaaacaatgtgtttcctctatgtaaatgccaatgcatattataaatactgatgatattacaattttaataatttgtaaagatgttaagataccatccacttgctggatttttagtatgttaaattcatattacaaatatgaaaatcacataagcttgcaaatctcaaaatatgcaatgttcatttagaatgaccagtaatcaggaagccagtaagaggcatacatttgataaaactgaatcctaccagatgcacagagtgaaagccttagtttcagagtgcaactatttttaaagccgcaattgttacaagcttgcatcaactttgctagtctctagttgaaactgtcatctgttataatgtaaatagttcattaagaaattaaaaattatttgaaaatctatagattgtattcacaaaacgctccaatatattgtactaaagccagtaatttcaaatgttacagaactagaccccgctaactggcaccatatacccatagactgaactgcataagtatttattctccaacggtatcgcggacttcgaaaacttgaggtgtaaagatgttttccaaatttttaaaactactttaaaaatccaaaaatcttaagagacttcatactcccataattttcaaagtagttcgaattacctgaaagccccatagtataaccaaataccttaagactacccttcacaaacaacatcttaccaacataattcaagtattatcaactctaaataattttcaaaccacataaattgcgttagcctattacagagagataatgccgccaaacagactctcttctttctattccactttcccccgtttctgacagttgccaaaactacctacctaaggcttgtgaagataaagtagcactcaattcccaggacctaaatcgttatcactgctgagggaaaaaaaaaaaaaaaaaaaacaagaccaatcacaagtaagatgtttttctctaacagatctggaatgagtatagaggaagattctaaatttaagcccaaattgctgcacccttccatcgcacacaaatacgaacaccatacaagggttcccgtgcttacatcaaatggtaacgaggggtacagcctattgtctgagtctacttatcgcccttagacaaatgccagaatcataatcagagtgagaaattacgcctgagcacagggggctattgcagagttaagggtgggatgctcaaggaaagctcaaaatcccagtgactcaagcaaagacgggggggggtaacccgggcctccgcattacgggtccgctcaatgccttccccagatacccacaccaattcacagaacgcttacttcctccccaagctcccttcgcaagtgcagtccggaggcaccaccgccgccgccgctccgaggagcgggggaggcgactctgtccccgcgcctggacccaggaggacgacgacgaggagaaagcgatgcgcgcgcggctcccgggaaccggctcttggctagcgaggagcccccgggatggctgagaagcagaaccaacccgcccgccgcctctccagggtcaagcgaaactgggtcgcaggaagaaaaataacgaagagattgtagattaagaaaaggcaacaaaaacactaccaggccgctaggaggaccgcctcaaaatgccgccggaagtcagaggtttgccctgttcctctgtagacccaggcagcttccggccgtcagattagtcgtcagtgcgcagacaccacccttcgtggacacgccctctaggcgtaaggttccatgcgagcggtaagagtgcggcgggacttggaaatcgaatctgtgctctgtgagagatcctaggaaaggaaactgggagcccgggagaactaaaattcccaattaaaagtgaatttaagtgagttttctctttttattacataattccttaccataaacagctgttgtaaatgcgcaaaatgcggcatttgttgacagtacctagagccactcattcattcgttcaacagtgtttattgagcagctgagctggaatgagaggctatgtttgtcgtttttgacacccctcccctttctgggccatcgcctaattaccgtggagcaaacggaatgcatggttgtatttytaaaggcasaagmagaaatttattgaaaatttggagcagaaatctttaatgtacttctgaccacccttccttttgttgagtaggatccaatgatcagcgtgagatgatcwttgabtaaacttgcttgagatggctagtcaaacgtcgaaasttgcttgagatggctagtcaaacgtcgaaaatcaaagaaaaagtaggtaactagacttttacaattttttttaaagggtaaaaagacatgaaccctagtctgccttaatggcaaagtagcacttattaggttctctgacagaaccaaggaataggaaaatcttttatcaaaactacggataaaacttaaaaataatytgatacaatgatttggtcttgctggaatcagtaaattaaaatacggaagcagaatgataaaatcaggggcattaaacattcctaatgacatgccaagctattttagagacagcggcaaaagcttctctacaggtgggtttgatgtaacgctccggcagcaagaatccgtatgtgcccgtatctcgaagttcaattgtaaacgaatatttgatgcccaaatcatagatccaatcgtccccacctccaggagctaggtctaaaagaagaagaaagaaattgttgaaatacagacgtttcaaattaatttacaaactgggaattgtttgatttaaatgtttatttgtttgtatacctttagatttttttcagtttttaactaatataaacaactttacaatgagtacccttgtttatacataattgcttctttgtctctttagaatattcttccctagaatagatttgctagtctaaggctctgtactttttgcaattacggcatgttcccaaatggacgtcaaaagaactgaattcatttatacttccacaagcagggtatgaatttgcccatttccccttcccataccatcaataggaattatgaattctgataattttatgggcgaaaaataatatccaactgtcttaatttatgttttttgattatcagtgagttgcacatttgtttggcatatttattggctatctttatatttcctatcaattgtccttcctcatttgtctacttggttcattttatcaattgcttataaaaacgacattagtgttattagctttgtttggcatgtagacctttttttctcctttcattcatttctcctttcacaagaattttttctccttactgagatttcaacttggtttatgcagggttttcatatgaaaatatatgctgtacctggaatttactttggtgaaagacatgttaataatccaattaatttttttctaggtaacttgttaggttttccaaccgcattaattgaataatctgactttttttgggggggtgctaaattgagtccaggtttatggcaaagtctgacccaaaattttaatttataattttagcatctatctaatacagtttgggaagcatctcatgaaagctacaattgccagaagacttgttacagtttaatgcatgttaactaaaatgtgtacatattttagtgttcatgataaatacagtttcgaccttttttgagatggagtctcactctgtcacccaggctagagtgcagttgcacaatctcagctcattgccacccccacctcccaggttcaagtaattcttatgcattagccaaccaagtagctggcattacaggcgcctgccaccatgcccagctaatttttgtatttttagtagagacagggtttcaccatgttggccagtctggtctcgaactcctgacctcaagtgatcctcctgcctcagcctcccaaagtgctggtattacaggcatgagccacagcacctggcctctttttgtttttttctaatcattaaaaaaaaaaaaaatggaaaaacctggatttggccttcaggctgtagttttctgatgcctggttacaggtttattttatgctcctcttttcccatctcccttcaaacttcaaaagggcaaaatcagtctgtcctcccactgtgtgtagataggagttactcactaaatatctttcagcaaaaattaatcaaaactttttgttaagagtttgtcacaagttttgtgtgtgtaatatatattaaagacaatcaactgtaatgtgttatgagctatactcttgggaacaggctaacactaaaaaacacttgatgcaaatggcatgccctagattagtgtagtgtacaacctgcacaaccttccatggtggccctgggaatcatgcaaaagttttatgaacttttctgcttcactcaactagtatgatgccaattctgtaattcctacttgattgtgataaatatgatttcttaaataggattttggcttctttttagtaactcatttattaatatagctttgttcagcattgtcatagctattatgcttctgttcctaattattacaattcagttgtattacatgtgaccctatttaattcagaaaaattaaatacacaaagaaaaacagatcacacagatttctttagtagctcaaagttctctaagatcataagaagaaatacttacataaggtttctgagccatggccatgtgtatacctggtatttttactarttttctcaatagcacgaactgcttcactggctactagagactggaagcaamaagatatagaatttcagttaatgtgcagctttgaaacatgacaagtagaagtttctaaaaaataatcatacattaattgaatcaaagtatacaggtagaaaatctagattcatctaaaaggcaaataaataaggtaaacaaattaatttaaaatatgtgcactttatggcaatcacaattgggtggctttaaacataaactatttcaatatattgaaataatttatataaataaatatattaatttgcagaaaaaaattatcacatgcctttttgggaactcatttattatggaaaatgaagtataactacatctcaaaggcttagaggtactccatttctgaacaaaattatcaccaaactttaaatccaacctttctaaacacatacaaacacctaatgcatgcatgactcacttcttatccttctcacaacttctattttcttcttgtgtaaaatgtctaatgacttccatagattcatcaaatcaaaaaagattatgcctctggtatggagcaggataataactaagacccccatttgacttcattttgtctgttgatattcattttgtcaaatctattctgaagttctcacttatctggaacttttcggaaattggaactagcatcatggtatacactgtyaccttcttgaaaaactcaagagatttatcagcggatattattttatgccatctcattgttcaaaaaataagttttaatgtaaccccattgtctacataatgaaatacaaatttatctgacagtcacaccccttcagaagccaacctaatctactttctgatgctatcaccctccacttttgcatcctcttatggtgaacaccaacttctttgcttggaaggtccttccttccctgtctgcctatagaaatcctctttcaatgcctgtctaaaatgtagctgatctttgacatcaacagcactttattatttgtagtttttcccccccttaatagattgtaaattcctcaaggacagtaactactttatctcctcacttatctcagcatttccctctgaatgcattagtgaagccatcccttgatattctagttagaagtgagttgtactgtctgtgccacgtatttagtagttactctatgtcgccttagagtacaactatttgtaacatttgctaatggttgagctccctaaccataacacattctcttaaagggcaggattttacctaatgcttctttaaacatccattgacaaggtattttacacgtaatggctctcaacatatatgtgtgctggcagtgatgcaaaaaaaaaaaagcataattagactaattctacttcccaaatcatgataaatttccttttatttcttcaaagataatatttttgaaaggtgctttccttaacagttttcccttgagaagaaaaaagctcaagtatcaagtacatttatgttctaaatgggctattttcagagaatgcaaataatcttatatttgtcatcagcaattgctagctcctgtaatgtgactatattttattctgttaagagagccagaaaaaaaaatgagtcactaagaaacaagctactacctaaaaattagtcccttcccaagaatggggctgttgatgtaacacttccactgtctggagagcatctgggatgaggatttgtcraagcctagctacaatccttcaagaatccttgcatcttttgccatgaacccaaacatacagtatcttggactaaaaagtgctaagggagtatcaaattgtgtgagtcctctttgaatttcctgtattgtctgttatgttccaaaaaacagactctctcctcaatgctaaaattggaggtactttaataggaccaaaaccctgagggttarggaagtcagggcaggaacaattcctgctgctaataccaaaacaatgagtgctgtgttgagacttaatctgtggtgtgctgttgtaggaagctagtgaccacaaagctgtcgcatgattccatactcatccttgcttataccgcttcacatgcagatcaggtcaagtgtagtagtagttccttcctaaccttcaaggaatttgtctgacattttcttaggaagcccacgtgctagaataaagtgtgtgttgttagggtaaggcacgttctttatattcccttagagaacactgacccagggtgactctcaacaggatcacaccatgatttaaaacatctatcatttgccttctagaggmcaaaatttttcccagtttttgattcttcaactaagtattattttatttccaaaatgctaatgagaaaaataattaagtagcacttaccagttcctcatggtctttgcttttacttcgtgtataggaatatggaaacactatatgctgggagtatgaatgcatgctgatgtatgctttaatctggttgatatttcttctcaagaaactagccactgccttcacttctggttctgactcaggataaagtccacagtaggtttccgagcatgaggaactggatgcaccttcctctgtaacgaaattgttaaggtgaaattatgaggggatgcacatagtactgtaatttgtggtttcccagacaacgtattctcctacctatgttgcaacacttttagatgaatggattaggtagggctctgcaaagaacatagttccactaagtgttatgtttcttttgaagtcaaatacttatctgctcacatagctgaccttctaacagtcattcccagcacctgtctcccttgcaaccttgagaaagtggctaagagatcctcagagatgccagccctgtctccagacttatggttatgggagaaaaaataaaccccaytttccttaatccactgtaaatttagtttttctgatatttgtagttttaaagctaccatcaatatagcccataaaagaaaagcctcacttcagagctcagaatatgtaaatctgccttcagtgctacttttaacttgctaaagtggtttagtaagtttagtaaataaaatgggatggtgatatttgttgccagaccaacgttcattcattcctttgrtagattataatttgcatcacttgagatggtaggctgccttccaacacttctccccctgtccctaattcacaaggtgaagccccagcaagctgcatstgacacaagagattattccttcctgcaaacagttgagggctcaggatwgggtctgactcttgtgcttgccaatctgaatcccttcaaagataacttgaaatcaatactaagagtctagtctcagtctagctgctctcttgaacagacagtaaaaatagtaatactaccagctgacacctgtggagcacatgctgtacgtcaggaactctgctaagatttttgccacatctcatgtaattcttacascagccctatgaagtaaatactgtcattttaggagatgcaatctggatattcttggtggtaaccaytcttcagaataagaggctatacagcatattgttaagcacccaattacttgattctaaatcttgactaccatttattagctatatggctttgggtaaatttttaaaaatctatctgtatctcaatttccttatctgcaaaattgaaaaattatacattaaatgctgattgaatgagaattaaatgagctagttcatacaaagtgctttgcacagtgcctggcatgtagtatgcatttcataactgttgctgtttatcatcatcatcatcatcatcatcatcatcatcatcatcatcatgtggactgagacctgaaagaagccagtgtgcatcacagagatgagaaggggagaggaaggattcactgagcctctctagggctccaggcccagttcctttctgtttctgagtccagctgcatctctgcctcaggagtccatggctgaggctactcactatccttacagagcctgcttttcttaattaagctcattctgctttattcctgttattatacaaacacaacattaatgtttgttaaaaaattgtttccctgagaggaaatgtgaacatctaaggtcttcccaagtatttcatttttaaccaataaggtgattggataaaccatttttgatagttcggtcacctttgaatattcctgcccttttatgtgatatataattcttagagaatagagattatatattgggtatggaggtcggggaagacataaccactaaatagagaggtggtgccctaatatgaatcctcagaccagggttgtttaatagaaatataatgcaagtcacatatttactttaaattttcaagttaccactttaagaaaaataaaaagaaggccaggcacggtggctcacacctataatcccagcactttgggaggctgaggcaggcggatcacttgagatcaggagtttgacaccagcgaggccaacatggtgaaaccccgtctctaccaaaaatacaaaaatagccaggcatagtggtgcacgcctgtaatcccagctacttgggaggctgaggcacgaaacttgcttgaacccaggaggcagaggttgcagtgagctgagatcatgacactgcactccagcctggatgacagaacaagaccctgccacacacacacacacaaaaagaaatatgtgagattaattcaatattgtaatttatttaaccaaatatgtacaaagtatcatttcaagtgtaaccaatataaaaattattcttgaaatattttatgttacttttttcatactaagccttcaaattctggtgtgtatttaacactcagtgtatgtctcaattcagacaagctacattttaagcactggatagccacatgtggttagtggctactatgctggacagtgagcctcagattctcattctatgattgtcattctagagatttcaagcattttagtggaaagagccctgaagaggcaggaaacttgaggtsgagactctgctttaccattaagcagtcatgttaatttgggcaactacttcatcgtctcagcctcaggggcmtcatctgtaccaggaaggaacttgggccactggatccctccaagctcaagcattctttgatctatagacatggaaccaagcacactgtgaratatctataataggcaaattcatagagacagaaagtagataagaaattaccaagggctggggagaaggtagggatgaggagatattgcctactggttacaataagtaaaaatctctctttgggacaattaaaaaattttagtaatagatagtagtaattgtgaatgtacttaatgccactgaactgtacaattaaaaattgttaaaatggcaaattttatattgcatgtattttatcataataaaaaataattttaaaaaacactatagtctcctagaaaaagaaataaagaattttccattcaagccagttgcaaaaactttgtagttgaactcagtgttttagaaaatgtgtggtgctatcttaggaagtttgagaccaaaggttctcataatgtactcctgttatgaactgaattgcatcctcccaaattcctatgttgaagccctaagccccaatgtgactgtatttaaagataaggcctttaaggagacaaagtgaaatgaagtcataggcatggggctctaatccaatgtgactggtgcccttataggaataaagagagacaccagggaggtttgtgcagaaagagaaggccatgtgagggcacagagagaaggcagccatctacaagccaatgagagaatcctcaggaagacctcactctgctggtaccttgattttggactcccaatcctcaactgtgagaaaataaatttctgttgtttaagccacccaacctatggtatttggttatagcagcctgagaagacaaagacacccctacaacctaccctccactctcatctccaacacacacacacamaaaattttaatacagaggagcataaaatgagtaagtaggtttgatatgtcacttcctgttaataagtgaggtgtttttggatcctttatataaagaatcataggggcacattctagttgtagggatgagaaaagattaaattcttctttctcactgtcttgcttacatagtacagaatagatactggaacagttggtaataaggacagttccttacaattactttttatttggttttttttttttttttttagttaaaaacccatatgcttgctgcttctgtttctgtttttcactcttatgatacrtaacaatatagcaccatgcccaagaggggactgagacatttcttgatgacaataacagaatatattttgactacttggctatccaaattaaataacactgacttcaccaagaaaaatattaagtaaaatcaagcaccaaaagagcttgaagataaaataaaaacttccaaaagggaactgataacttgggtttatagcccagctctgccacgtacttgcacatacttgctacgtgcccttgaggaagggacttaactgttttcagcccgggtttctccatctatgattcatagataatgaaatctggaagatgaactatgtcaatggctcagcgctgagtaactgtcagctctatttacttagattctttttacatggctgctgttcctgtgagcccctggcatgttattagtgccrcagcaaactttgggcctctgggaacacgagtggttttttagggagaaaccactaaatgattccctggaacctaagtcgggatgaactgcttcttcctctgagttcctaccatatctgtagctctcagagcaactaaattcattcatggactcatttagttaatattttatgaggaccctccttgtgccaggcactgcactagataatgggtattggtttctgtctgcatggagtttctaacctagacagggaaaaaaataaggaaataaggtaagtgctttgttgtgaggtttggttttcttttgttttagcaatcagctttcccaggctgaatgttgtgaggttttaataggtattctgggattttgataaaatgtttaaaatcatgaaattttaccttttttaaaggaaataggcaaaattatgtgcataggattgtatagggtccaggtctgggaggaagaagatgtttctgtggatacaatagcttctctcccttatgggccccatggagcccaaaaatatagatgatgcatactccttgtcaggttagtttattttcgtagctgtttctgaaatgtagtactatgaaaaataatgttgagtgggtgggaagaaagagtgaactaacacctacccccctaaaagcaaacttctttgtcttcgggttcagggggtacatgtgcaggttttttccatggatatattgtgtgatgctgaggtttgggattctattgaacccatcacccaaatggtgaacacagtaccacttaggtactttttcaactctttcccctctctctccttccctgccccttttttgagtccccagtgtctattcccatctttatgtctgtgtatactcagtgtttagcttttacttataagtgagaccatacagtatttgattttctgtttctgtgttaatttacttaggacaatgccttccagctgcatccatgttgctgtaaaggacataattttgttcttttttatggctgtgtagtattccatgatgtatatttaccacattttctttatccaatccgccattgacagacacctagattgattccatgtctttgctcttgtgaatagtgctgcaatgaacatatgattgcatgtgtcttttgggtagatcgattcattttcctatgagtatatactcagtgatgagattgctgagtcaaatagtaattctacttttagttctttaaaaaatcttcaaactcctgaaagcagactgttcttgaatgcataactcaacatcatcgaatgccttaactcattcgaattaagaaataataaattcccactgtgctgctttttatactatttttaatatttttatattttctttatattatttattaaagaaattaagaaagtgaatagtgaaaaaaatgtcttcaaacactatagaagtaaacatttacttgtgcaattaaaaatgaggggtccaggccaggcacagtggctcactcctgtgagccactttgggaggccgaggtgggcggatcacttaaggccaggagtttgagaccagcctggccaacatggtgaaatcccatctgtactaaaaaaaatacaaaaattagccaggcacggtggcatatgcctgtagtcccagctacttgggaggctgaggcaggagaatccttgaacctaggaggcagaggctgcagtgagccaagattgtgccamtgcactccagcctggtcaacacagcaagactctgtctcaaaaaaaaaagagaggtcctccccccatctcaggtctttgatattctaatgatgaatgtttttgtttattaaaataggatctttaactgtcacttctttattattccaagataatagattttagaattttgaagctagaagggatcttaaaaaactgattcaactttcttattttaaagatagggaaacaggagagaggagaggccaaagtgatttgctgactctggccaacagtcgcagcattacatttacctaagcatttatcatttaaattattccctgattcagacaggccagctctgtatttaatttgaattcatgggcctttccctgtgaacatcaccctttcagtgaagagacattgcaagaaataaagccaacaacctaccacaccagtgtttggaagcaaagttcctattcaggtctgttccratgcaatgattgttcgcatagaaagaacggttctttctccacattcgattctacataaacaaaatacaaacagacaacctgggtagccacgttcaaggcctgaggaaagacatgcatttgaaagtccatgaagccagaattgcctttctctccttcaatcccataccttgcatggcttcatcacatcactgttgttgcaatattcctttgcacggtccctattgctatccgggtttcaatcacatccactcagactattttagttgaaccaaacataatggtaatatttgatcaattttgactgatacaaataaagatttcctttcattccactaggctgcttattagccttcttgtttagtcttgtttcctttacattaattttatgcacagggtcattctgagctccttcgaagaaaagcaaaataactttgtgtctcaactgaacgctgagtcataagttaaaatgctctctttaggtagaattcaccactcccctttcaaagctagaaaaggtggagatgtgaagacacctttaatctgatgacttcttcgattgtgctgatttgactctggtttttaaatataaagcaaattccctattgggttcttggggtaaactgggaaagtttggtcatgtaaagagttgcacaggccgggcgcggtggctcacgcctgtaatcccagcactttgggaggccgaggcgggcggatcacgaggtcaggagatcgagaccattctggctaacacggtgaaaccccatctctactaaaaatacgaaaaaattagccaggcgtggtggcgggcacctgtagtcccagctactcgggaggctgaggcaagagaatggcatgaacctgggaggcggagcttgcagtgagccgagatcttgccactgcactccagcctgggcgacagagcaagactccgtctcaaaaaaaaaaaaaaaaaaaaaaaagagttgcacatacttcatttaagttctgagtttgggatgatgtagcacccttttctcctactctcaccaaccctccgccaagccttccagcctgttaccactcccaggcctgtggttccgtggcaacaataggccctggggatatcaagttctcaaactgtgggaattaataatagggtaatgatacaaagaacagttgggaagctggaaatctaaagggtgactgaattccactgtgattcaggttaaggtgtaaatatactttattaccagtttacagatatgaccattcattggacaccaaatttgtgttaggcattatgctaggtaattctcatttacttagtttggcatttgcccacctccacctacaaaattttcagttacagtattcctctcaccagagatgactttttcctcaatctcctgtgccatttccatatcttctgcataaattacctcctacatgaaataattcatgtgtaattccatgtttccaatcacaccaactaatcttattcctcttagtatttatatgtgctactcaagtaggtttttctaaatttatatatacctagttatgtttctatgtgcccctctttaaattagaaagcagagtatttcatattgcttgagtaattttacatgaatcacaatgttgagtaaccagaaaatacagacagaagagcatgttaaactacaagatggtaatgcaattagcaaatcctgataatgggaaactcttttctttgacaaataaattgcaaggaaaaaaagaagagagagaaagagcaaaagatggaatgtgagttcatgsattaaaatagaattaaaagacatataaaccaatcataatgtaagagccttatttggatccagaatcaaagaaacatactttttaaaaagttaggaggccgggcgaggtggctcatgcctgtaatctcagcacgttgggaggccgaggcaggtgcatcacaagggcaggagtttgagaccagcctggccaatatggtgaaaccctgtctctactaaaaatacaaaaagcttagccrggcatggtggcaggcacccgtagtcccagtggctcaggaggctgaggcagaaaaatctcttgaacccgggaggtggaggttgcagtgagccgagatcgtgccactgcactccagcctgggygacagagcaagacaccatctcaaaaaaaaaaaaaaaaaaaagttattatacaattgaaaatactggcaatattttatggtattcagaaacagctagtttttaaggtataattatactataattatttttttcagagttcttttttttttagaaatgcatactgaaatatttattgatgaagtgatatggtacctaggatttacttcaaaataaaatgagtaaggtagaagtgggtagagagaatacagatgaaacaagactggtcatgagttaattattgttgaagctctatgatgggtagatagaagtttactacacaattatgtgcacttatatatatatttgacattttccacaataaaagttaaaaaaaaattaataataaagccattgtgcctagatccagaattctatgaataattcaacctgtatatcctatatccccaaggagaacatgatttgtcttctttgccttttctcctacctttttccatgagtagtcataaccrtccacattaaccacyggcataacatagaaatccacaagcctcaggagattggtatattgccctattatcccatagaattgagttatctgcaaattaaaccaagtatatttaattagatgttttaagttcttctaaacttagtgtgtttctttttcttttttttaatttgtcatttggcatgtttagatttgcagatttaactttcagaaagagtgctarttcctcaaaagaactgaacttagggtgctacgaagtggtgataaatgccttacacgtggtccagtattcctagttaatgaaggcagacaatcgaaccataaactttctaaattttccttaaaaaataaaattaattctttattaaagccatagagcccactaagaagatttaaggaaacaaaaacctagatttagtttagctcctttttctgtaattcatgttcatcagagcttaaactacctaccatgttttatccccagatgtgattacatgatattggctacattgtccttagaacttgtggagctcaagttttgctagaattgagtgtgtttcccaaggctttgatcatctagctgtagaattagggtagcttttcctaggaactggctatgaattcctaacggacatcatctcaaacttgttcctctctactttagagtcatccagcttagtggcacatattgcartgtgatccaatggcatccaaatttggtgactgagaagtttaccccaaaatgacaaaatgtacaggcaggagaactataaagacaaattttagctggtcaaatcgtttcatctaggacaaagcttttggttcaaaatcttaatttgtggcaacattgctatattttaatttaattcacatttaattacattaaatatttaatttagtttataattgtttgttgccttaaagcatactcatgacattgttaagaaatgtctttttcattattgacaaaataaaaacaagccttttataaactttactattttccctttaaacgtttaaaatattatattcatatttccctagaacaatcacaagagtcacattaaaaatctttgccatgaataaatacttatgaaatcggagagaaagaaaagaaaaaagttattttaaaatctactgtaggtcagaaataaaaggttaatgaaaaggaagcaaaatttgtagaatgaaggaagccatgttttgtttttttgtttgtttgttttttattatactttaagttctgggatacatgtgcagaacatgcaggtttgttacatagttatacacgtgccacggtggttagctgcacccatcaacccgtcatctacattaggtatttctcctaatgctctccctcccctagccccccacccccgacaggccccggtgtgtgatgttcccctccctgtgtccatgtgttctcattgttcagctcccacttatgagtgagaacatgtggtgtttggttttctgctcttgtgttagtttgctgagaatgatggtttccagggaagccatgttttaaatagtcgagcaaccagttaaatacatttttatgttacgaatttataaatttatgttagcatcacttttcagtaataatgtagcattcattattagaaaaatattaggagagcctgttccttttaaaataataaagcaaataataaagcatttctcattttcatttctacaacatgggccaaacttttaatagatgcagcatatgaatttctttttctgcttcactttttaaatttccttcctacctttacctctggttggatgggaatctttctacaaaaagttatgctctgagagatkaccgatgttaggcccagaacaatgttacctatttctttatctaataggtaggactccagacagaaggagtgagtgagggctgaratacagtctgtgctgtgtgccaagccacaccttcaagtgtggctatagctacaatcccgaaggaaggggtgcccattttttctttaacagcttattgagatataatttacattccagaaattcaccattttaaagtgtgaaattcagcggtttttggtgtattcatagagttttgcaaccatcactartatctgatttttggaacatttcatcataaaaaatccccatgcctrtgcccattataactcactcccctttccctcctgccatttccccaagcctctgacaatcactaatgaactttctgtctctgtggatttgcccattctggacatttcatataaatggaataatatatgtggcattttgtatctggtttcttttacttagcatagtattttcaagattcatctatgttgtagcatgaatcagtayttcattccttttgattgctgattgatgtttcattgcatgaatatgctgcattttgtttttctgctcataagttgatggaaatttgagttgtttccactttttgactattatgaataatattgctataatcatttgtcaacatatgtgttcacttgtcttgggtatacacctaggagtagaactgctgggtcatatggtaactctatacttaatcttttgaggaacttccacattgtttttcaaagtgrctgaagaaattttgcctgacgacaaataaatatttgttgaaggtacgatttaccaacatggcaagtaacataaytgaaatcctgtcctactagagwtggtctgcaatatacaatgayttcacttatgattttttgactttacaatagcgcaaaagcaatgcatattcagtagaaaccatacccatgccaccattccatttttcagttttagtgcagtatttaataagtgatatggatattcagcaatttattataaattaggctctgtgttagaagattttgccctactgtaggctaacgtaagtgttctgagcacatttaaggaaggttaggctatgatattcagtaytcggtagattaggtatattaaatgcattttttacttagaatattttcagttgtgattgtttattgggtatattgagacataaccccaycataaattgagaagcctctgtataaaagaaaaagaagatgagaatagaggagaatggagaagagtgtaagactgagtgatgagagggtgggattgattcccatcagctggcctgtggtcaatgattactcagctcttcctctcactttgcctggggtgcactcaagctttgcctttaatgtggccctaaacaacaacaacaacaacaacaattcctgcctaggaattaaccaatgaccatttgagagataataaattagtacataacgacatataggtcagttaatggggttgctaaaaaaaaatataagacacatgaagggaaaattttaaaacaaaatgtcattttcattaccattacaaatatatcagagagctatcygtctcagtttttactccaatctctatatatgtatgtatagtttgaactgtagccaatgacaataaagtatttatcccaacagtaggtactgtttagatactctctgcaacccaaaattgtatgtcagcctaaacctgcaacattaatttaaatttcaaattccacaaggggatattgagcaccaattatgttgaccaaacaatataccaggttatggggaacaaaaaaattactttagacytggtctctgccttcagaaagctaatagaagtgataagttggaaagggaaaagcagcagttcaatgctattaatataagtatgataataaacaatggcaagatgtacaaggtggctcagaaaaaggatggttaattctgtggagtgtttggggttggaactccagaagagcaggtcaagggagcaagaaattgagggttcggatgaatttgtgatgggaccaattagtgaagaaagtgttcctggaaagggactgataaattaaaatgatatagatctgtgtaggaactagaaatatgctaaggttgaaaaaaaagcagtcatagtaggggtgagaaatgagagaagacaggaaattaagaagttacattgctagatggcttcttctaacattccttgttgctgtccatggccacattctgggtctaaggwtcagcaaaacattacttctgagatccagaggatggctacaggagaaatctgctaaagaggagttgagatgaggtttagtagaacagagaacaaggaactgtgaagatacattgttaggtgactctcacacatggactttgaattcactcagaatgatggcaagagttggaggggaataaagaatcatgaaccggrtaccaggaaattatctgaaggtcagtgcacgatagcaataaaataagagtgcaaccagtttgtgtaagtttctgagaagagaaggatcattggtagtatcaggagaagagaatgctgatcyactccaccaggcctctcagcacatggtgatgtgaaaaaaagagcagcccctctacttgaaggagccaccagggagcagtgtccttaggtcatgtgtcagctgtggtgaggaggggcagagataattctgtgaaggccctgaggttgtagagctctaactttgtgtgcaattagatgagagttttctagggcagaggtttggcaggaggttagcagtgagaaaagccatttggcagaaaaagtacttggcaagttgtgatggttaacatatattcactgggtcctatgatgtgccagccctgtgccggattttggcttggtgatgcagtcatgcacaaattggtctcagctctgcctttgcggaaagagaaggatctaaatttgcctcccgagagtacatgaatgagaagcttagaaagaaatgactggcttcaagcttctcaaagtgtagtgtagtggatttccactgagactagattataagatttttgaaatccttattgagttgtagaaaagagtgagagacttaaaagctaagattttaatttgcctttgggtggtttagtttttgaatataaaacctrccttcacaattgttgaaaggtaaatattttattttactttccctcctccagtgctttgaagtactaagagagtcagatgatctgaattagttttaggcaggcaagaatggagtttaaatgtcgatttaaaaagcccttattgattatgtttctttgggctacacaaatcaggttcacattgttggagcaaaatactcagctataagatccttgggctatattttgttcatccttgtatttccaggatctgaaacatcataggcaatytataaatatttgtggattaaataatttaatcttacaaagattcagcaagcagtttgggtagagggtaggatgtctaataggagggcagaggtgtcagggtgagaagggcagtcattagggacaacctcaccgatataaattagagtcaatatgaatggaggtttcttcttggcccttctcatgttcagtgatagaatggaaaataaatgttcttactctcctactttggacctttctctattaactgctgctcccttcactacctaaaataaccaaactactcaacttggggaaggttccagatcatgatgtgactgggatatgttaagggtctgatcagttggaatcatcctcatttggccaaggtagtaccaatggtgtttgggaatttccagtagactcagggaggttgcagctcccatccatggagaatggaggatagaagattcacagtgaatgaaggcaaatagggatgttgcatttgtcaaggtcaagcaaagacagaaacagttttatcttgatgtacttaataagtgccaatatcttaatttcctaactcatttattctgttactatgtatctgtgaatgcaaagactgcaaaaatcattatcagaaagacacatattttgagttatttttccagtggctatgattctttgtagaaatcagtgtagagaacatatatgcccattttataggatttgaagcataatttttactgttttcattcatcagggaggttaatagtcgttatatcttttacttttccaacatacagtttgtcttatatatggcttttttgatgcaaaacccttcttcaggaagaaaattccctattatgacatatgagaaaacatattctgtttcacctctgtaatgttgtgctttatgttcaatttccaagggcaaaggtggcaaaagatgtctggataattaaaaccaaaagagaaataaattaattgggccccaacttagataactccttcagtcctttcctctacttagtaaacatattataatcaatgtactatttctttttttttttttttttttttttttttttttttttttgagacggagtctcgctctgtcgcccaggctggagtgctcactgcaagctccgcctcccaggttcacgccattctcctgcctcagcctcccgagtagctgggactacaggcgcccgccaccacgcccggctaattttttgtatttttagtagaggcggggtttcaccatgttagccaggatggtctcgatctcctgacctcgtgatccgcccgcctcggcctcccaaagtgctgggattacaggcgtgagccaccgcgcccggcccaatgtactatttcttaatcattttccactgtttagctccaggcagaaatgtagaaaagaccaaaaatattttgggtgatttaaatgcttgaagtcatgttcttcaacttactaatgcataaaagtcacctgggaaacttgtgaaaattgtagattcccaagcttcatgatgtgacctaggaaaatgcattttaataaatagcccagttgagtctgacacaggtgatcttgggcaccattttgagaaatagggttaagagaatgtgaatacttacatggcctatgaaccacaagcagaaagcaggagagatccattctctggcatggattccacagtcaatccatatggcatttttggctgyttgttcttttccagaaacctgctcaaagaaaccccaaaagtagcaaaaacagtaacaataagcttcaggataataactttcatttatatagtgcttatatttaatagtttcagcaaatctctgagatatgcattgttctgcatttctttgaaaattctcaagggaaatttaaacactggtgatactaagtgacattagttaaggtagcaaagctggtgtgaattgaaactgaagtttgaagccaggactctttgatttaaaactgtttttatcctccacaattatgcagtcatgtcagagctgcatgtggaagtttcaaagaagagaccagagaactaatgatttgggctgtatcttcatgcttcatttagaggtaaatgggtgtgagttggatggcaatcttccccgggaggtgtggagacacacccrgagcaaaaactccctcaagattttcctgagtgcatatttttttatgtggattatttctttatttcacacaaaaagaagcayacatctaacctctcacgaacttaccagcaaatccagggacagaggcttttttcccagtatggtgggctaacacaagctgctaactctggaataagaatcatcaaccttttctcaataatagcctttgatgtctttagaagaattatcaagaacacctccaaaattaatcataatgtatttgcctttaaaagtcagctacaacacagtttagggtatagagcagtggtccccaacctttttggcacyagggaccagtttcatggaagacaatttttccatggatggggcagagttggggtggaatcagtggtggggatggtttggggataaaactgttccacctcagatcatcaggcattagattctcmtaaggagcatgcaacctaaatcctttgcatgcgcggttcacagtggggtttgtgctcctatgagaatctaacgctgccactgatctgacaggaagcattgctcaggcagtaatgcttgctcgctggctattcatctccagttgcgtggcckcgttcctaacaggccatggactggtacctgtctgcagcccaggggttgaggaccactggtatagagggaagggagaagactgttgtaaaatcaaacaaatatgtagacttgcaattccaaaataagaaaaagaaagagttagatatttagattgtcatttgaaccactccaggaggttttttcctaacttggagctagcaatatttaacaggatagtaagtragaaagcccaatggcattggccactaatcgtcaaattgtatagtcaaagagaactacctagcttaatctactcaatgcaaagaaaatcttaagttgtctggattmrttactttacttgacctttctaagtcctgggccaattttcttggcactggttctgacaccgaaaagttggcaaaatcccagagactcacattatctgcacatccttgatcaagtragagtaggaccaaaccatccagaatgcatgatttttcaacgtgtacaggttccagataagtatgttccaaggactacacacaacatggctgaaagcaaatgtcatgggtggatatgccatgatacatggatccaatctgattgaccaactcartraccaaggggacccaacatttcatatgtctgccttgagtctgcactgtaagttcttgtaaacgacagattaaaattgagaagtcctaacccaaagtcttatctttgaatgactgaagaggctcacctatcacaatttagataatattgggatactgtgcataaattatatgttactaaattaaatgtacatttttagtgactacattattttccagagctttaaaaaaaattttttttaagagagagaggtagaaaacagaactatagagttgtttcctagttctgaaaacaattggctgtggctatgttcactgacctttactaaggtcaatttattcaagagagaagacatccaatccaagttaggttaatcaatttctcttgcataatattttgcractgaaaataaataaccaaatgggtggaaattggagtagaaaccatcataagaaccctactgcaaaggacttcagccttgtccggctgtttgtccctcgctgggatttgttgtcctggtcttactttagtttcaaaagctgtaccaggaagtactaaccagagcaaacaggtaagagaaagaaataaaaggcatctaaattggaagggaaaaatcaaattatccttggttttagatgacacgatcttatatttagaaaaacctagcctccaccaaaaaactgtgttagaactgataaattcagtaaattgcaggttataaaatcagcacacaaaatcagtagcatttatatacaacaatagcagacaacctaaaagaaaaatcaagaaagaaataccatttacaatgaccaaaaaaaaaaacctrtaataaatctaaccaaagaagtgaaagacctacaattaagaccatagaacactgatgaaagaaactgaagagaacacacaaaaaaatgaaaagatacctcatgctcacgggcttaagaattaatattgttaaaatgtccrtactaccgaatggaatctacagattcaatgcaatccctgtcaatatcaatatactcttcatagaaagagaaaaaaaattctaaaattcatatggagccataagagatcttgaaaatccaaagcaatgctgaacagaatgagcaaagctggagtactaaaacagcatggtactggcataaaaacagacacatggaccaatggattagaatagagaacccagaaataaatccacagatctacagttaactcattttcaacaaaggcaccaagaacatacattgggaaaaggacagtcttgtcaataaatggtattgggaaaaattttattcataaaattcaaactaaatgcctatctctcgccttatatataaaatcaactaaaaacagattagaattaaatgtaatacctaaaactataaaactactagaagaaaacattgggaaaacaattcaggactttggtctcagcaaagattttttgggtaagatctcaaaagcacagtcaacagaagcaaaaatagataaaggggattacatcaaactgaaaatttgcttctgcacagcaaaggaaataacagcgtgaaaagaaaaaaatgggagaaaatatgtgcaagctatccakccaacagggacttaataaccagaatatataaggaaygcaaacaattcaaaaggaaaaaaacaaataatccaattttaaaaatgagaaaggaatctgaacagacatttctcaaaagaagacacacaaatgggcaacaggtatatgaaaaaatcctcaacatcactaatcatcagggaaatgtgaattaaaaccacaatgcaatgtcatctcattccagttaaaatggcttttatccaaaagacaggcaattacgaatgctagagaggatgtggagaaaggggaacccttgtacactgttggtaggaatgtaaattagttcagccactatgaaaaaccatgtggaggttcctcaaaaaactaaaaatggaactaccatataagccagcagtcctattattgggtatgtatccaaaagaaaggaaatcagtatatcaaaaagatacctgcactcccaygtttattacagcaccattcacaatagtcaagatatagaatcaacctaagtgttcttcaacagatgaatggataaagaaaatgtggatgtggataaagaaaatgtggatatgcatgtggaaaatgtggataacaaatggaatattactcaggcattaaaaggaataaaatcctatcatttgcagcaacatgccctgaaataagctatgtagggaaagacaaatactacatgttctcactgatatggggagtggaaaacgttgatctcatagaggtagagagtagaatggtgattaccagaggctgggaaaggaggataaagagagattaattagtgggtacaaaatagatagaaggaataagttctagtgtgtagtagcacagtagggtgacgagaatcaacaatatttcaaaatagctagaagatgaacttaaaatgttcccaacacaaagaaatgataaatgtttgaagtgatggatatcccaaataccctgatttacacattgtatgcatgtatcaaaacatcacatgtgaggagggagggagaaaaaaaatcacatgtaccccagaaacatgtacaattattatgtatcaatttttaaaaattaacatcaaaaagctgcaccactttttttaatttttaattttattttttcaagtccctgttttattttctgttagtgtttgtcccctaacagaaatagtgtttgtccactaacgaaaataaaacaaggacttgaaaaaaataaacaccacttccttcattttatggaaatgttaaatggcttatctaatgtcacataaacagaaacagagttaattctagaactgggattcatctagaattgaagccttaaccccctagagactgtatttggagatagggcctttaaagaggtgattaagttaacatgaggcccttagggtgkgtactaatccagactgactggtgtccttgtgggaggagattaggacatacagaccaggacaagactatattattaatgggaaaaataaccaacccctaaatagccaggtattaaagttgaggaacacttgtaatgcaaatattttcagaactcaaaggaaacaaactcaagttttaacaaacacgactggagaattaatccctcccctcacagtgaaagatcaacaactttccccacaacatacctttaaaacatasagtgggwacttctcaaatgaggatccaatgtggatttttgtaagcatrtcaggatgcctctcagttataaattctatccaagaatagatctagcaaaatggaaaccagaggttagtcacgaagccaagttcaaagcatttccctgaccaaagcaagcagacaacttcttcagagaaaggaaaacctctgtatgtggaatgcacgaggacctaaagcacttagggcagggtgtttcttctgctgtttagggaaattaataaaattaaagttttgataagtgtcaaggttttgagaaagagtgaaaaagtgctaagatacttataatgaggtaggaaaagttaatctataaactatggcccctgaaagttacttttaaagtcatcacattgagtcactgcccctgtgtatgaaattcttgttctcattcattcaaaagttcacttttatatgagacttttttaaaaatgcacttttcaagatgaagggagcccttagcactgtcttcatgcaggataaatggaagcatcattgtttcccactaaagacctgtgcaagcacagtgagattggcacaatgatgagaggcaaaggtggggaccatctggaggaaaaacaaacaaactcaattatccccccaagaagtagttcgattctggacctctctcttgggtggaagtccagttgtatttgaggttctgtcaagataataggggaaggaaaaagcaaaaaaaaaaaaaaaaaagaaaagaaaagaaaagaaaagaaaaaaattctgactttaggctagcacccacttcaaagcaaacattgaattattgtctggtttgggattgctgggattgaactgggttatgttttaatttggaccaactttccagggtccattcttaaactctgatgccttctgaaacagaagcaatcaaaccctggctttatctctgggaacttttctagaggtgatttcaaatagcaatcctagctggtaaaaactggagcaccatttatccttgggttctctgagatcacataaccagcatgagtggtaggtgtgagtggttgtccccatgctgagaattaagggctcctgcccacctgccaccaagtaccgaccctgtcagtgtctggggtgtcagaaatgtaactgtcagcaatttcctaattgaatctccatttcctgtgttactcttctaggcataaatacatctgagaaagctaccacaaaaaaataatttatgcattgatacttcagtagatttcctctaacaggagaggctgtataatatgaaggcagtttaaccgacagactttattcatttctcaaactaagctggggtaataatgtaacatcctttgaagaactcttttctctcaccatttcttctaagaagtaatttttggccatttgtttctttctccctacaccggatcatttaagatctcctggtgtgagtcaatgacaaaataacctctgctgcccaccagtccatcttgtaggtagggctgatcaagagaccaccgatcaaagggaaagaagcacttagaggaatattctgagagcaaaatgcttatggttcctatgaacctgttagaaaataataggggcgggggtgcaaagagaagcacaagacattttctataatgtcatagttaaggagtagatgttgtacccctttctccaattcatatgttcaatccctaactcccagtaggttagaaagtgactgtatttggagatagggcctttaaagagatgatcaagtcaacatgaggcccttagagtgggcacgaatccaatctgactggtgtccttatatgaagaggagattaagatatacagagagagaccagggatgcatgtgcacaaacaaaaggtcatatgaggctgggcatggtggctcacgcctgtaatcctagaattttgggaggccaaggcgagcagatcacttgagctcaggaattcaagaccagcctgtccaacatggtgaaatcccatctctactaaaaatacaaaaaattagctgagcgtggtggtatgcgcctctagtcccagctactctggaggctgaggcaggagaattgcttgaacccaagaggcgcaggttgcagtgagccaaaatcatgctatcgcactccagcctgggtgacagagagaaactctgtctcaaaaaaaaaaaaaaaaaaaaggaaagaaaaggcatatgaggaagaacgctgtgagatggcaactacctacaagctgaggaaagaggcctcagtagaaaccaaacctactgacaccttgatcttctagcctctagaatcatgagaaaacaaatttctgtgatttcagctacacagtctgtggtattttattaccacagccctagaaaactaatagagccatgtgcttattttttcctcctgtgtcattccaactctttcctgaacatatcgtaagaaaacataacttttttgaacaaaataattaaaatatgttttaacaaatatttaaaaatacttctgtttayggcattcccctctccccaccaaacttatcacagcagtgacagtttcaccttrtatgaaggtgaaatcccacctatgaagcctctctgcatcaagtttgctcatgcagtcgtgctgatggatgctggagagaggtggtctaagttggatagatgtaggagagattaaaaaagggggggtgcaattttaaggccccctcaatcaaccaggcacacattctagaagcatactgactctggcttaattaactgggaaggaacagatgcttttaaagattatatacataaaattgattctcattacctaagtcttagatgtcttaaaaatatggatatggtccctaatagtttctgggcacttagtcaaagatgacaaaaatagttatattaggcaatatagctgcatactcataaaaaggcatcaaggtatttttactacttggagaatatcatataaaaaagaaagtcctcctgcgmatttattctttcaactaacaaatacagggaatggcttttagtggattatgtgaaagcttgctgaggtctcacctgcacatcaacatcttactcaagttctctctagaaggagtggaacctgtaagtactgatagaaaaaaaatccaatttcttacagattaaaacaaaggcattattattattattagtttaaatagcttccttctaaggaataaaatgcaattagttatagtgtattaaatataagtgaatatattcctttaattcagtgagctaatctggtaattagtaaaattagggtaatggtccaaagagacatgattaattggactggtaattttttggtggcagttttaattaaaagccccaattctttaatttctgttgttccatagcataaagtgttattcccagcagttagagatattcttagctgtagacaaacatcctgcagtttaccaaatatgatgcagtcttctcagggaagakatctaccaaaaaatgaatgaccaccatttaattaacctargtgtgtttgtgttttattttttaccatcttccaccaattatgattcttgaatattcccctgattgaaatggcaatactggttaaatgaaaatagtagctttgaagagctgtgtgatggcttacttcatttagtgagtgatactgttcatagtacgatgcggaggctcgggggctgactgtgtcgttggaaatctgctgttgaataagatcttccacrtctgccagcaagacactaggtgatgaaacagagagtgagctagtttccaagcagagggtggatcttcccacatggcccattgcaggcacagcaggtgagcatgaagaaaaaaaatcactaagaaacttcataagcatttcatcaaggtaaaagtaagacatctcgcattgtggtaaactggttgacaaaccctttcagtagagcctacatgggcactagagaaaaagtagctcctattaggtataytttcaggacctccataaaaaccaccgtttcccaccattaccaacattactcaatggtgattcttcagtgtcttttatatgaatatatggattaatgtacctttgttcaatccagrctaacactgtattatgctgttttcagttaaagaggaagaagaagcagaaaagccttttctttctttttttttttttcttattttttcccccattgacctgcatcagatgttctgcagagccaaagaaatagaacaggaaaagggaagtacaggaaaggcatctcattcaagttctcttcagagcaccacatttgttaaccaggcaaatattttagctgaattcaggcattctatcgcctgagatggacaagttgaaagttagctatcatactaataaagggttctttacttttatttaggccaataaataaaagccgcagtgttgacatcagaaaggtctaagttcgactcctaactctgccatgttctttctgatttaccctgaaaaattcctttataagtaaggatattttttcatctatataatggggttgcatctacttcacggggttaaataaagattaatagacacaatgtcaattaatagaaaggttcagcacagttcctggaaaacagtacacacctataatatactctataatatattactaataattaacatagcatattatccagggggcacccattgatacacagaagagagcatggtctcaaggggccaggccaccaggaaggtactggcagttgggcagtggatatggaggggagatattaggagactccataagaagaaggctagactgtgagcagaaattgtacctgatacactttttaagaaaaggaaatcatttctaatccacagggtaggtgctgtttttacccttaatatacaaaacttgggagcagagaggtgaataattcccccagggtcatataggtggtaaggggcagtgccagactaacccgaggtctctgcagagtccaaccacctgttacactttttaaagccagacattcagaaatggtcactgtctttgtgaagaagaattagcagaagctaaatcccctcccgaagctgctttttcaggagatatcaaaaagcctaccaaggcaaatgacagttttgctccctgagtctgggtacagagtcagagaaaaaggaactatgagagcctttaccaatcactgagtctaacctgcattttagataagggacggaggtcatgargggttgaaccatttatccaagatcacagagctggaccttaggctttatcaccagtccatttggtccagtcagagacttctatgctgccatggttaatacattttatttttccaggaagcaattataccataccctagtcaagtgcatagtaagtgtttataataactactcaatacgtattgaacggtgcctacctgcatggaattccgctcacatttaaatgggctttcacattgtcgacatcagatgcatttacaaaaaaatggacttgttttttcttcacaataaggtcagctgttaccggctgccagagaacaatctacagtttaaggggcaaaattgataaaattaaaaaagagttgttcacatcattctcatctgtagctagagccatgacagttttatctataaggagtatgaaaaggacactccctggtgctggtccccatccacacacatggtaatataaacatttattttgcagtgagttttttaaaattcctttctataactctagttgctaaaaaaaaataaaataaaagggcctggaatrtacaagataatccataaatatttgatgagacaatgatgaatgaatgactatattcatggcttaactgtaaaattgcatgtgtacatcagatatttgaaaggaaacaaaattttttctagaaagaaagttgattaaacattgattttatttaataaaaatttcatgttcttgtaattatcatcatgtcattkttcctttttttaaaaaggcttccaataagatttacattttttctctcttaatgtgctttttatttatttatttatttattttttattttttattttttttttgagacggagtctggctgtctcccaggctggagtgcagtggcgcgatcttggctcactgcaagctctgcctcccgagttctcgccattctcctgcctcagcctcccgggtagctgggactacaggcgcccgccaccacgcccggctaattttttgtatttttagtagagacggggtttcaccgtgttagccaggatggtctcgatctcctgacctcgtgatccgcccacctcggccctccaaagtgctgggattacaggcacgagccactacacgtactttttcaaagcactttcacactcatttcctttgatatttataacgctttgatatagactaggcaggtgttattatttgcattgttcaggtgaagaaattaaggttcatacctgacatctaaaatcatacacctagaaatgacagaacaagaactagaattctaaatctcagatgcttcctcttgtagtatttcctctttaccatgatgtggtggtcgtgaatatgcaccatttagctcttcggttgagagaaatacagttggctggtgttttcagtggctgccctggtgacccactagaagctgaggccatgtggtctcagggctgcatccagccagtaaccgagtcctgtggaagtgttaatgcaggcccattcttgccagactgagactgacctagcccagccttctttggacctgccctatagtctgagattctccaaacaaaattcccctttctgcagaggtgtcagagctatgacatggtctgatgatgctctctgccttctccagctcccgcctctatcctccaacagcattcccctcatcgcttgctcctccagtctagtcttracctctgcttcttggaaaacactaacaaacaaggagccatcaattttgtaccatgatattgttacaggatccctggggtcgcttcaccagcagaaacctctgtggtcagtggcgcctttgcctaagctttgctcaggcccgctgagcccactcggcctggcaggctgcactcatctcgtgctactggcttgggtctcattcgtgccaagggcgagctgagcggtgaggggtgtgtgagtgagcaggtgtggggtccagctactacacacagcgaggcatgctggctgcggcagggtgggcatctttcggctccctgcaaggctgtggctggaccaggtgtccctcaagcagcttcaatggctggcaccggggaaggtggtggcacccagaagtttggagacgtcaggaaccacagagccctaaagagggtgtcatagtcctgcctcggggagttcttaggtctgagctccccaaaaggctgcagctcttctctccttcttgtcacccacaacgtggcaagcaaggggcgtgtttcagcyctgtttgtgttagagctctttcacctccaccatttggcaggttcagcgcccgggaacaatgacgtacgtggacaagcggagggtgagcaaggtgaagaggagctttactgagtaatagaacagctcagaggagactcgcggtgggtagctcctctctgcagccagggtgtcctgatgagtgttmgttctcagcagagaggagaccctggagtgggtggctcctctctacagctggtcctccccatgtctctccagaagagtctggctgaatccgggggatttctatgggcttcagatgggargaagtgagtgctgattggttcatgggtggccataggcgggtgcggaaaaatcaccgtcagttcccactgcggtccacgggactggcagccttcctgggcttgaaggtggggcttcaccagggacccgcccttttctgcctaggatcctgtctgcctcctacggctatttatggcacccaggattttccagctgagggggcctgcaggccagtgccgagaagccctcagccacccccttggcttccctcctgtgctcgtcagtacccaaagtccagagggggctgaggcagcagggggctagcatgtcagtaccgctctgatcatgcacacagccagccaggttgtgacaacacctaggctcagcctcaattttgctccaagattggagtgagcaccaggaactcggagagaccagacagtgggagcaggcacttscgagcctgtaggggaatgagggtccttctcagaacactgagagtgcagaaatgcctgggtctgcaaccccagctgggcagctgcagctgcgcccaggagggcagggctcctgcctgcycctggcccccaagagcacagggatgtccaggtctgtagctgcagcgggcagctgcagctgcgcctggggagcatgaggctgccgccctgccatcacagaagggggcgggacttttacctcctcctggcttctgctggctccgtggagcacacagccccagccgtgcctcccgcatggcagcagccgctctagatgggccgccactgccattaatattctgtaattcttgtcaattttctacatcttagacattatgtcgagatgggtgcctgggtgagaattttaataaatgtactctgtctttctggtgcatccttggttaagaaccattgtttcatgagtaaggttttatttataaatattttaatttctgttactgtagcctctttgtaagtgcacactttatatcccaaggtactattatgaaattggctggaaagccaatagcacaagtgaagaagtgttgatttggggaaccaacaaaatcatgtgattatgagaagggagagaagactatgagaagaagagttcataccagatacatgtaagccagacaacatacaggaggaaactcaacacccagtgcttatacaaagtgaaaccaatataaacataaattagggagaaattacctcatatgttgtagtaagattctgtagaacttgaacttgcctagaggttctaggaagagcagctagaacttggccactggggaaaaaaataaaagaggattttgataytaaataaagagtaaagatggaatatattayactgtgaggagcttttaggtaattgcaaaagggaaacaaaatttaaaatgttattaggacagagratcttactacagattcagtgtaataagagaacatatactctcagtctttatgctcctaagcaattgcaaaatcaacagctctcttgactgggggtcagtttacagagtatttacttctttcctttttcttgtgcgtgcatgtgtgttttaattttaaaaattaaatatttgatgcataagggaatatttatgctgatcctagttaattatacaataaaatgaatgcctgtgaacccatcaccccacttaaaaagtccagcttccttgacatcctgaagatccttgtgtgctcctctctgtcctacccccttgccacatcaccagaggtatcctctaccttaaattttgacttttgctcattcccttgtttttctttatagcatggatttttaaacacatgtatgtgtgaattctgaaacaatacccttagatttgcctgattcaactttataaaaatggtatactatatgtattcttctgaatcttgtttttcttttgttcrgtattgtattctcaagattatcatctgtgttgaagtagctagccacagttcacacatgaaagcattttcttacaagtggaattgccatttcatgggatatgcacagttttaatttcataggatagtgtcatatcagtcctcaagttttttgtatcaatttatattgtcagtagcagtggaaaagatttcctgttgttcttcctccttgccaatacctgatgctctctgacttttcaacttttgcaatcaaatttttatgaaatgaaattttcttgtgattttgattttcattttctgacttattaatgaagtacagttgtttatatttgattatyggccattcatatttttgcttatatgttatgtttattcagatcaactgcccatttttttctaatttacttgtatttttgtagtagttaatttgtataatttctttatatattctaaatactaatttcttgtcagttatatgtattgcaaatatcttctagcagtttgtaatttgtcttttctctttcttgatgatgtgcttttttttttttaatcatttccttccaggtttgtgtggtttaagatgtctttctagatatctgggatataaagatattctcatatacttcttctgtccttcttatttaaattttaaattcaattgaaaattatttggttgggtgcagtgtaaagaagaaatagacttctttttttttcttcttagcatcgtttattattatgattttttacatcatctatatttttcccagggatccactatgtcaattttgtcatatatcaagtttccatactgtttggcagagaaaatgttggttcatcaacaccactgcctcttcctgcatagacagaaaaacttcattacccagccttccgtgtggttgtgttgagagccagtgcctgagctttgccaatgggaatgcgtgggagtgttataggtgcctaagagtaggtgtgtcttcatgtgcacgtgccccctctcatcctgcggccagaagcaaagagcctcaaatgtggagttgcataatggaagcagccaagatctccaagttgaaggagagcaccagggagagttctatgaccttcatcaattagtattatgagtgagaaattgctctgatctgaatgtttgtgtccccccaaaattcctatgttgaaatcctaacctccaaggtattaggagatgagggttttgggaggtgattaggtcataaggggagaggcttcatgaatgggattagtgaccttaaaaaagagatcccctcccccttccaccatgtgaatatatagcgggaaggttctgtctatgcggaagatagtccctccccaaacacaagaattagctggtgctttgtcatgaacttcccagcctccagaaccgtgagaataaatttctgttgtttataagctacaccacttaaggtattttttgttataactgcccaaacgtactaagacagaattaaccctatattgtattaagtaaagctgtttcaggttttattagtgattatagcataatcaaggattacccttgctaatataatgtgctctatttcttagttctctattatgttctattgatatatttgtctacccttgagccaatactactcatcttagtgatggtagcttcatattacatcctaatatcttagagaacaaactcttgcttcccctctgccctgcccaattcttttttttttacaagcctcttgtcttgatcctttgctttttcacataatttttaaaaatcagcttgttatgtttcatgaaaaaaatgaaattttcattagaattatattggatcaatagattaataatttggaaagaacagatatactcatgattctgagtgtcattattaataaatacagtgaatttgtctatttgtctattctttttttttttttttttggagatggagtctcactctgtcacccaggcaggagtgcaatggagcgatcttggctcagggcaacctccgcctcccaggttcaagcaattctcctgactcggcctcctgagtagctgggattacaggtgcacaccaccatggctggctaatttttgtattttttagtagagacgtggtttcaccatgttagtcaggctggtctcgaactcctgaccccgtgatccacccgcctcagcctcccaaagtgctgggattacaggtgtgagccactgcacacagcccatttatctattctttaatgcctttccaaaagttttacaattttatccataaagatgttgcacttttttttttttctttttgagacggagtctcgctcttttgcccagactggagtgcagtggcgccatctcggctcactgcaacctccacgtccctggttcaagcgattttcctgcctcaagcctcctgagtagctgggattacaggtgcacaccaacacacctggctaattttttgtatttttagtagagactgggtttcaccatgttggtcaggctggtctcgaactcctgacctcgtgatcctcctgcctcagcctcccaaagtgctgggattacaggcgtgagccaccgtgcccggctgcacatttttaaattatgttttcttctaacaaatttgccttttcgttagtaaatggtaacttttaacatgccacctctaagctcttttttgctaagatatagaaataaaaatgatttttggtgttgattttctatttagctctcttggtagttttgataattttggtatagatatttggggggatatttctctttgcaagtaatcattacatctgcacacactattaggttggtgcaaaagtaattgcggtttttgccgttacttttaatgtacttaatgtacttttaatacgttctgcttctttaatttcaatgcttatagagccccttttccccttcctttttgtcttgctgtgttgcctgggacttcagtacaacattgaatagaagtggagataaaatgcatgattcctgatttttaagaaaaaccttaaaatattttaccattagaatgcttgttgtagatttttggtagatgtcttttatcagttttaaaaaactccttgctctttgttaagagtttttatgatgaataagtgtggattttaaatgctttctataagatgagcatatgggttttctggcttaatatcttaatgtggtgaattatatcaatagattgtttaaaaagcagacacttggttggttttctcacctttgctttgttgtatttctattttgcaactgttgctaaggttgtgagaattcttggtgattcttacacagccaaggcaatagattaatgtgactcaacatgaatttactttattttcacataccacttagaaaagaaagaatttcttagcaaatgtcctcatttctgcagctctccatccagttttataggtaagtgataaggagagaaaggaagcagtgaggtgagggattgtggactctgttaacggcaatggcattctcaggtttccagtataccactgagtaacctcacaagaactattttatttaaattaaaattaagcatgttggtggcatttgccagctctgagcccccccttttttttaactgaacgagatttttcttttattttcaaacaaatattgcccttgaaatatgacgatagatatattttaaattagaaaaaatgcttcctcttgctttatttaaaactaatcttagactttgcttccagttataccctcctttatgaaataactaaaaacctggacaaaatgtatggaacaacagcactcaagacattagacaacagcaacattatgactaaatgcaacatggtgttctggattagatctcggaacagaaaaagagctttagtgggaaaactggtgaaatccaaaaaagtctggagtttagttaatagtaatataacaatgttgatttctcagtttttactaatacatcatgataatataaaatgttaacattagggtatattgggtgaggggtatacagttgtattacaattggcaacttttctgtaaatctaaaaatattccaaataaatcatcttatttaagaaaaccatgtaccaagagctctcaaagcacaaaagaggttatgataacttctgtttgtcattattagcaaaggcttcatagaagggatgtctgggtgtgtaagaatgtctaagagtgggtaaaggcacaatagcaagagataaagggcatttttggaaaaatggctcttgttcattgttgccaagtataggatacgggtgtttaaagcaagagaagaatgggagctaaacagaaatgagtgtgggaagttatgttcatccttccctagagaaggtcttgaatgcatgctgagaaatttggactttatcttgtaggcaattagaagttagaaaggtaacatttgagctgtgatttatagggataattttatttgttttcctttgtttgtttttgtttgtttgtttgtttttgagatggagtctcgctctgtcacccaggctggagtgcaatggcgtgatcttggctcactgcaacctccaccttctgggttcaagcgattctcctgccttagcctcctgagtagctgggattacaggcgtgcaccaccatgcccggctaatttttgtatttttagtagagatggggtttcaccatgttggtcaggctggtcttgaactcctgacctcagacaatccacccgcctcagcctcccaaaatgctgggattacaggcgtgagccaccgcgcccaccaaggataactttaacaagggtggagggtggctttattttggaaatcctgagtaaaatattctgaattctggaaataagtctatggagagacttgcttattagaagaggggaaaagtagctagactgagaaattttatgtcaatctctggtacaagtttagcataaactattaaaccactgattaaagatacatgttcaaggatgtgtattacggcattattcatagtaacaaaacctaaaaaccatgtgaatgctcagcagtaacagaattgtcgaatgttggtagtgtctccacattctagaatgcttttcagtcattataaaaaatgagtttgatttataacagttaacttgggggctttaaatggcatattaagggagaaaagcaagatatggagaactttatgaaatatgatcctatttttggaaaaaagttagaaagataaagaaaaattatatgtgttaaaatcaggagaaaattatacataaataaacaacacattgttagctttgatttggagggtgggaaatggcaattgaagccttgggtaagtggcaggggaagaacaaatgagattctttttaaaagaaaggtttctatagtaccaataggagatacaacattgaactagtatacaattatacccagggaggtataactatgtggagaaatgtatgaaaggatgatcacaaacatgttcatattttcaccaggatggtgaaattttagtattttctccctaattttatgcttttctgtattrtttactttttaaacccaaaagaactcctattcttgtatttattcaagaaaattaaatttaaagaaaaatctcctttgactgtgaaaaagccactaacaagcttctcagtgatgctggtaaccctctcatctcaccagcacattccttattattttcataaacagaatgttctctgggcccttggagtagcrtagtcacccagtgggttttctagccttacatagcatttttattctagtgtgctctatctcttttttcaccatctgccacattcgctctgacatttctagctcagatggtgcaggccatgctttctccaagcttccaaaaactaccctaacagcatgtttgtaccacctctcaaggaactaactagaatgttaaattctgtagcatgggtgagtgcacctcctttggggtatagtccctttcctttgttaacatgcccagcacttccacagccagcttatgttgtgactaccctaggttattggcttgaaggccaggaggggaggtgggaatagatcctgagggctaactacaggacatgccattacagaactgagctctctgataccaatggagatgttaagatccctgtatagagaagccaggcgggagggcttaaccaccagtaacaagttgggcacagttattacaatgagcagtaaggtcggagtggcagccagaggaccatgacccttagaaaattgtggagtcggttaggagaacacagagttcttaggggcaagatagagaagcagccaacaaaaggattgctcaatctttacaataaaaataaatcaaagctggataatgagagaggctgaggacagctatcctaatcaaaagtcataatccattgcccttttccagatctgagctgttcttagacccagaatttcttgcctgaaggaggartcaggtccccacaaggaaagaccctgcaactgtataaaaaaagaatctaaaaagatcatgactccttcagtcctttcccaaagagacctatggaaatttcctcaggtaagtctgcaccctggggaaagggtaatactcaaatattttcaggtgtgttggatgcagggtcactatccaagttgattttgaaacttgggtatctggagccctagcctaagactagctcatagcgggtgcaccatgttaatggattcccccatcattatttccctggtcaccaaatgtataattgacatgaacatactaggtagttggcagaacctccacattgtttccttgactgtaagaccagagctatcatagtgggaaaagccaaaaggaaacctctgaaattgcccaacctcccagccaagatatcaaaattaaaaaaaaaaaattcatccttgaggggaaatgacaaatatcagtaccacccttaaagacctaaaagatgcagggatgatagatcccatcaaawccacatttaatttgccatctggatcccacaaaaaccagatggatcctggaaaacgacagcaaacaatcaaactcaaccaagcaacaatctcaattgcagccatagtgcttgatgtggcatctttgccggggtagagtctcaggcatatggtattcagctattgcgctggatatgtcagtcggaaaaagcatcagaacagttaacatccacttgggacagacaccagtgcatatttacagtcttgcctcagctttaattaactttctcactctccagctgcaagatgtgtacttgatataagcccccagctactgtgctctgaaatctgtccctgtgttagtgctaataccacatttcccactggcttcttgcagctaataactgagtatggtggggatactaagggaggctctttctacaaaactggaaactcttctgatgtgtgactctgsctataggactttttttttttttttttttttttgagacagagttttgctcttgtcacccaggctggagtgcaatggagcaatcttggctcactacaattctgcctcgtgggttcaagtgattctcctgcctcagcctctcgagtaactgggattacaggcacgcaccaccacacctggctaatttttgtatttttagtaaaaacggggattcaccatattggtaaggctggtctcgaactcctgacctcaggtaatccacacacctcggcctctcaaagtgctgggattacaggtgtgagccaccgtgcctggccaggactcttggttggttttgccaaaactttcttagaactgcactaygacctgaaatgttccctacctgcttccttcctttcctctctcctccacaggggttaagcttgcattgcagtctcatggctctcccagcctcctccagccctctccccatttcttgcacccaagcattttcctcaacacacctcttgcacagctaatcccatcttggtgtctgcttctcagaggatcataactgacacaagtaggaagaggaagtctgatacatggacagtcaagttgatagtgcatgggtacaagtaaaaaatgaagtgggctgggcacggtggctcacgcttgtaatcccagcactttgggaggccgaggtgggtggatcacctgaggtcaggagttygagacgagcctggccaatatggtgaaatcccatctctactaaaaatacaaaaaattagctgggcatggtggcgggcacctgtaatgccagctacttgggaggctgaggcaggagaattgcttgaacccaggaggcagaggttgtagtgagctaatatcgcaccactgcactctagcctgggcgacagagggagactccatctcaaaaaagaaaaaaaaaagtgaagtggtgctgcattatggactcactcgggtgaccgaaagagagcagagagggaaatsgtcccaaataggcagagcttcagtgttgcatctcatcatacaccttgggtggaaaaggtgtttccagtgttagaatatgcaggaattcatggagagtggcaagtgacatgactggaaaacccctcaagaacctggaagaagaaatcttgacagattggagacaaagagattggagaaagggggatgtgaatggaactatgagagtgggcagaaagtgtgaagatctttgtatcatttattaatgcctaaccaggagcacccacaacagaatagacattaaacagctgcataaacaaatgactcagccagttgatgtcagtcagcctgtgtcaacagccaccccaatgctggcacaaaaggcactagaacagaatagcctgatggcagagatgaagtgtgcatggctccagcagcacggactcctctcattaaggctgatctagctactgttgctgccccatgtctaacttgccagcaacggagaccaaagttgagccccggaatcagcaccattcctcatagagaccagctagtcactgggtggtaagttgactacatctgtcctcttccactctgggtatgggtttatctcgcctgcctgtagggcctcaggcaagcatcaccatacaagggcttacggagtgtttgaccactgataaaacatctcacataacatcctatcagatcatgggctccactttacaacaagggaattgcagaaatgggtccattaccatggaatccacttagcctctcacataccagaatacctagttgctgctatcctgttactgaaataaaaatggtttgttgaaggatcaattgaggtgctaacttggaaggcaacatcctccagtgcacactttaaatcaatactcatgtggtgctgtgtccctactaggtagtatacatggttccaggaaccaagttggagtgtttccatataccgtcactccaagtaacccactcggagaattagtactttaaatctacaaatatggactctgtacttataaaaattccggtttccagagagcataggaagagttcctttaaactgaaagctgttgttactgtccagtcatttcagtttcctcatgctgattgattatcaggaaggcgaggagttaccatgggttttctagccatgcaggaagggtaattgactccaataatcagaaggacattgagggctgcacttacatactgaatgtggcagggaagaatatgtttggaatccagcttaggcgttctgtaatattcccttgtccaaatttgatgtatacagacaattgcagcagccatggcccaagagggcccagtgattatgactcagatccttgaggattgagggtctgggttgtctcaccaggtaaaccacctagattagaagaggtgctagcaaagggcacctctttggggaaaacagaacgggtaggggagaagaggaatgacaagtattggttatggcctcgagactagctgtagctgtgaaggttgtagtttatttcactaacgttcctcttgtatatttcctttaggaagagggaccaagcaaaaccccagaagagttgatctcaaagcttattttatgaagaaaattgacctgagtgacacaaagggttggactgtagtagatgtcacgttttgctgcctagatctccatccagggatgaactcttatttcctcagcttctttgtctcctcagcttctgggagggttggcagctgatattctcacctgagtccctttctaggacttgcccttgcctgaagagagctgtgctgcccaacatgatgcctcctccaaggtacaatccacacccagtgactaataaacaggggttacaaaggcatgcctgcttgccccagtttgggwcaamtttaccaggccaacccagcctcaaggctctccacaggaacaggtgasgccatagttgtgattacatcacaggtcagtttctcctctgcccaagccttcttccttcattcctccacagatgctgatcctgagattcctttccagtaaacttcctccatgcaatcttcatctcaggagtctgtttcctggggaaactaacctgcaactgatacaaatgcctattctgtgagataaaacactaaaagtacaatgcgagtggtataaatattctgctacaggaatacaaagtcaggtatcatttttgacttaggtagtcagagaatggagatattctgagttggacttctgagatactaggattcaataggtgaagggaagatgagatggtataagactaacataggcagaattttgctaaacgaattggagatgaaacatcataagtgcaggtgcacaagtagaaaagtaaaatcagagctcaaggaaggagaagtgatccagctgggcagaaatatggggcctatatagagatataccaggaaataaagccaggacgaatggcagggtaggacctgattgttaagggtcttaaatgctggggtcaagattgtggcccttacttaaaagttggttgggcatgattttgggagttgtagcaaaagatgtggcaaactcaaagcttccttttcatgtaaagtatagagaagtggaggttcatatcattaaatcactgtaatttcagtgtgaacttctaacaatttgagctaaccatgagataggacaccttatcaagcaatgagctcttcattatctaaagagatgctgaatttcaagtccatgtagaggaagtcttgtgttgactagagcataatatgtctggggggacttttcttcttttttactgatatttagtaacttggatattgtgctaagtgctttacaggtattcttatttaatcctcacaaggcagtatggtagataatctattatattgaaaataatgggccaggcacagtggctcacgcctgtaatcccagcactttgggaggccgaggtgggtggatcacctgaggtcaggagttcaagaccagcctgaccaacatggtgaaaccctgtctttactaaaaatacaaaaataagcgtggcatagtagctcacacctgtagtcccagctactcagaaggctgaagcacgagaatcacttgaacccacgaggtggaggttacagtgagccaaaatcacaccactggactccagcctgggtaagagagcatgactaggtctcaaaagaaagaaagaaaataatgaacaaaaaatgttgagtgggcagtattaaattaaaaaaaaacctaatgtattaaagaaggagaaaagtataaaaattagtcaacaagcagagaaagaaagaaaatataaaggtaaaaatgtatgttatccaaatgagacctcttaagaagaaaaaataaaggaaattcaaaaaataagttaggaaatagtgagtaaaattatgaagttaaaaattcaccaaaaatttattgatatgtccaagttcagcttgtagtgaacagactcttcttatgcagaatttgagcaaagtgctaacacaacagagttaggtaatgggatgagggtcagtcagatcactctatttttggaaactggtttcatgactgcttccccttacttagtcataaacaggctatataaaaagctgtcagagtggaaagagggagaggatttgtgaatttttttttttagcatgtttttatggttctgtaagtcaccaccctcccaaagggatgaagtttcggggtgcactccccttacctcagcctagtagggggacttccaggagataatgagagagttggatgtttcctcaaatttacagacacaaagactggtgcctggcttctcctgataaagctaaacctgcatgtggctggtctctagttggctagatagtagtagttaaaatgaaaagaaacacttaatgttagatgccatccaatagggccacctaaagggatggaaagttctcaacaacaagagcccagaggtagaagcaagactcttagcggggaaggatggagtcgcaagtgaaaacctagacaaagaagcatctgtcctggtccagaggcttccccaataaagatgtctcacacaactctaagaagttagaactcgagaaaaagactaacaagaaaaagagtaaggtgtgtttgtggaagaggtgaggcagttgttttcctataaataatgttaaattaaactaaatttggtctgaggatgcctcgtaacttgagtcgctacataacaaactgcaacctaacttaggagtattttttttttgtactaacgaggtgagtctcagccaatcacagcagccaagctacagccaatcccatgtggccaactgatcagcctatgcccagtaagacaactgctcacctgtaactactcaagctgcttctggacctcatttccatttgctgtttataagtgctgcctgcccactttgctgagcagaactctctgaacttctttcgtttttgagggttacttgattagaaaattgttctttgttcaattaaattttgctaaatataattcttttaaagattttcttttaacaacaaagatggggatatttgaacaataccttggttggaggtgacattctaatttctaaattgaggctatttgtatttttagcaggacccaaggactgtcacttaaaagcaggctaaaaagccttgaaattttctaactttccatgcgagagcagtgatagataaccccactacgcaaaatgtcatggggcaatgggagacaaaaactaaagctgtgtttcaactgcgtctctgaatgatacgattatagcacttacacaataaccacttgagaaaaaagaacagccttgcaccaaaaatcgaatgagaagtacaagcacagtgaagtaacaggtcactttacaaaaaaagtaaaggctgaaaggggacgagcaaattgcccaagtctgcatgggtgataagtagcagatctggggctcgaatccagatcctgagcttttaatacctatgcaacacttcctctgttccttcccttctgagaatgtcattatgttcattggggtgtatcccctgctatggtttacaggggagggttcacactttcaccattctgaaagattattttgaatttaaaaagctggcaagatgtctctgaacaatggaacatagcccaaggctgcaattttgttgcacacattacagtgttttaaggccactggtggcctgttctttgagatgaaaacaatacatcagtaggaacaaagtgaaagagagtaaactggtctccaggtacccaaacagtatgtgaagtcaacagaggaacacttcctgtggtctattaataattcagaagccctttatcctcaaccctcctccactctctaattcctaagtcttcttcctagtgtctcttacttcctctttccaaatagtctgggctggcaggctgcatttaggtaatcactgcacaatacaattactgattctgtttacaagattcttgctagtattttatttttaccctttatagtgtttggcttttaaaagcaaatgaatatggagtcatgattttttggctgcctttccctttggcatatgatatttatgcctttaaaacttgttgttgttccagggcatttcactgatgaaatttatcaaaatgaacctacaaatcagccactaagagactgcatgaataaaaactgttagtaggaaaatgattatgacaaaaaaaaaaaaaaaaaaacaaagaacagctttaagaaaaagccagactgttagtttttttttttttttttagaagggttgatattctgaaccccagcaacaatttatcaaagtctgttgccctgaatgaaattagatttcctttttagcttcaggaataggccattcctggaaaagtggagcacagaaacatttggtaaaaaaatttatttttactcacagaaagagtagtttgcaatgttatttccagtgaagggatgggaaccaggattcagatattcatctgtctacaatactgaggtcctcctacctcctctcctctgcaaagggaccctcgcagtatgcaaaagtattaaatatttttaatgtgatattctttggttaaaatatagtcacattctcattccttttttcaagcataagtatcagtcagatttcagagtataagctgaagcaacaaatagtaacaaagcccatgcatgaagatatgttctcactcatttttttactattttattgttggctacttcttctatttgcgttatatttagtgtcactaagctgctatacacgtactcatttgaagagatgtgctaaagcttttagtgtgttttgctattgattatcctatccaagagtttgggttactctacgatcaagatggcggtctgcagtgagcccacctgcccgccaacctctgcaacaaccagctgaggataattgcactgggctgacgccaaggccatgattagatctgctagtgggtgagaaccatgagactgaacctctaatcccgaacctctcttccaagctactttccaaaccaactgctgcctgcaactccctttgactaaatctgaccttccttcaaactggctctcttcctaatttccagattttatggaggcaatgctgtccagtgcatggagttgaaatgaggctaaagtgggtttgaatccaagctctacatttactgtttgatcttgggccaattatttattcttcctgaggctcagtttcctcctttgtaaaatgtcagtaaagattcctagcatgtaggattttatgcatttaaagagataacatttctaagtgactagttcagtgcctggcacaaacacaggcactaaataagcagaggtttcctccctttcccctaactgtcaatggtactgccactgtgtacagtagccaagttggacatgttgataccaatttttctcttctccccctttcccttaactgaagccaattatcaagttatggaatattagaactagcaagaaccttagaaatcctgaccatatgattcaccgataaaatacagagaaagacataagtcactgatcattgcagcaatcttgacccccacgtcaattaaataacaaaaataatatcattttatgatagaatttgttgctcgacattcgacaatcatgttgaacaaaagaagatcaatcaactataatcagttcagtgatcatgtacaaacacagcttcaggctcacaagtcaagatctattttccaaaccattgtcctatggttatttatgaccgtgaacatttttttggtggtagaatgttccttgtcactggtatattcctttgccctatgtctcttctttctttgtcatttactaacatgaggagagggatctgtctcaaagataattggaggagaaagcgatcatagaaccaaaacaaaggggaaaaaataagataattccaaaggaaacaatatcaatgttttaaagcctaaaaattgactacttaataaattacattacatataccctggaactattttctccatgcattgcatgtgctatagcatgaattcatttgtgttcttctagatagtttatcctaagggaatctactaagcaaaataagaatcagataatagttctttatcacacaactcttcttcctttcatattccatgctaaataatcatgcatgatccaaacctcctatttaacacttcaccctcttcttcctcctatgttccatgtacaaggggaaaataaatgatccatagttaactttttttatgtgaagacaggaagaatatgaatcatacatcaagttagagtataaatagttacgtttataaaagatttaatttcttgaatctccatagtcactggatatgcgtatcatccaaggttctcccaataataaaaccagagccaggaaagaaaaaagaccctgtctttagtgatagcccattgtgctaaagtctacttatttgtcagggcaacttggaaagttctgaaagacctggccttcaaagtttaccattttgtccaccagctcagtgcactgacttgacacgacatgaggcaaacaagtgagga

SEQ ID NO: 1669 - DNA, 18316 bp, Homo sapiens
gacatgatgggcagctgtaggctccagtggcctttggtgttttcaagagtgaccggattccaaaagctgcagcagagaatgatttcagtgaagaatgtgctcctgggttctggacatggaagaaaaagatgtagagacacagagaaggaggccatgtgaagacagaggcagagataggagtgatgctgccacaagccaaggaactccaggagctaccggcagctggaagaggtgaggaaggacttttccctagagcccttgggagaagcatggccctgctgacgcctccattcagacttctggcctccaggatggtgagagaataagccaccaagtttgtgataatttgttgtggcagccctaagaagctaacacagcagacactagtcaaataaccacaaaatatatgtaaaatttaactgcactaaaaaaaaaaaaaaaagtggctgaagcatttttcatgtccaccaacaaagcatgagagttccagcgatgccacctcctcatcagcacatggtagggtcaggtggccttttatccagtcattctggaggtgtacagcggtctctcgttgtgatagtaattgccatatccccagtggccccacaggaaggaggtgtctttcttcatattttccatactcttgcccttctcccggtggtgactaccaggctggctgcccactaccaggtttgtggtgaggaggtaagtgtaggctctctgctkcccggggctgtggagctttctcagccttcccacccatccgcttcagtgcagtggaccctgccttatatccggggcaggtccttcatgggagagcttcccactctgccccagaggcagctgacctggaatgatattaacataggatcttggtcccagtacggtttcctggacctcccccaagggtaggggggttctcctaccagaaatgagccaccatggggctgtgcgtgccctgggagtgacagggtttgttggccctcagcctgtggcttaaggcttttgctccactgaacagggggcttaggacagggggttgggcgcttttcccacagcaaaaacagccccttcagcccccacactactgagtgggtccctctccttccctcatccttccccactccctcaccggatgagcactctgagagcatgcacagagaggaagcagttagtgtgtgcaaactctcaccttgtctgggccccctgctgtctcagaccgacacgccagcccacacctggcttccaacaatttgttaaaactgaactgatttctttcttcttacccactttaatggaggctgccccttcctccaagcactgcccaagtgagccagactgcacatcctgcctctccttggagggacctgcccccttggaattcaggatacttggttgccctgtgagctcacctccctggtgagctcaagaaaagtgatgactttgtagtgcatgcagtcttttctcattgttaagtatgatagcaaggctttctgcctcctggatggaaggtgaatacttcttgctgtccttaagtctttccttccaccgtctctcaccacccattctcaacctaacgctacacattttaggttgcttttatagcaacattccactttcaggcaccaaattttgttcctgccatttgttcctattgctgcagaacaaatcatcacgctgagtggcttaaaacaaaaattatgatttctcatgcttccacgggttractggtctcacttggggcctcacgtgggattgaagtcagatgtctcctggggctgaagtcatctgaaggtttggcaggtctgagcatccaagagtctcactcacgtggctggagaatgatgaacagttcccagagtttctttggcttagtcttagaagttatagctggatgtggtggctcacacctggaatcccacacttgggaggccaaggcccaacatttgagcccaagaatttgagaccagcctggcaacatagaaatgtcctgtctctgtaaaaaatttaaaacattatccaggcatggtgactacctgggggagctgaggcaggaggatcacttgagcccaggaggtcaaggctgcaatgagctatgattgcaccactgcactccagcctgggcgacagagcaagacactgtatcaaaacaaagtcacatggtgacatttctgccatatttgactggtcatactgggccatcccagattcaacatgggtgagaactatgcagggtgtgaatattgggagtcatggttcattgggggctatctttggagactaacatcctgcctaacactacataccaaaagggacctttcacatttaggtcttaaatctatctaactataaagttaacaaaagaaaagggagtatatttttgtagcagggtggggagaggacttatcaaataaattttcaaatgcacaaaattataaggcagagggaaaaaagataaatcttattacaccaaaatataagatttctgcccacagacatcatggatctcatgcaagaagtcagtatacagatggcagaatgggaggagatatttgcaatatcaaaactgacaagcaattaatgtctagattttatataaacacccacaaaccaactaaaaaaaagagagcactaaaaattctcaaaaattggcaaaggatattaaaaagcagttcacaaatagtaacccccaaatggtaacaagcatatgaagaggttctcaaaatcattagtcatcagaaaacaatgtagagtaaaacaattgaaagcggcaggaggcagacaatttcctaggcagatgggggtgggtccccagtgaaaccccaccttcaagccaaaaacagcctggactgctggtttgggatgaaacccctcaacccagggtgagaacttctgttcctgtttgcccaccctttcctgattggttctttctgaataatgctttttaaccaatcaaatgttgccttttctaatactacctacagcccgcccctccccaatcctgtgcctataaaaccccctagactcagccacactgagatagacaaccccaccttctcaatccctctccactgagagctgtttcatcgtcaataaaattctccatcctcatcacccttcaactgtcagcatgacctcattcttcttggatgcagaacaagagctcaggacccaccaaatgtgggcacccacaaaggctgtaacgctggccctctaccctcactggtggagggcagctgccccacagaacagaagccgcagcagggccaagctggtccaggagccacgggccagagtggagaaaggggccgcctgagctgccaacatgccgctgtccatcaggctgcagatggtggagataaaagagctatttagcacactgtaacacccctctctggggcttcaggcacccctgcctgggtgctgccacagtctccttggggtgacacacctgatctggctgtgggccccacacagagcctgttcctgtgtcatggctcagtgcagctggctggaccctgcattcactcggtcacatgctccctcccgccaggggctgagcatacagtcgcagtggccttgtgagccatgggctgtaacacaagccagatggggcctggcaagctgagtagataaggcactccctgctgcaacctcagcaaaggggtcaagaaaaatcctgcatcacaacaagctctcattttatagctattagcctgacaaaaaaataaaaagctggctaatgggaagtgtgagtatgtatgtgtaagatgcatatggaaatagtaccccctcacaccatgcaggagagaatgaggactggtgtccccatcctggacatcatctagaactattttgagatacacacccatggggggaattgctggatttatagggtatggatatacttaagttgcctaagaaactgcccacagcccagggagcaattagagatgttcactgcagcagcattgttgtttaactctgtgtacgtatgtgtttgtgtgcccacatgctcacgggcttgggaggtggtggtagcagcagaaagttgaagggaacctgagtgtccatcactgatagaacaagaaacccatggcagattctcattacaaaatactaggctgcagttaaaagctacagattgaatatacatatagcaacatgggtagatcttaattttccactaaatactctgttttgtaagaaacagactgagaaatgtaatatatttacataataccatttacataaatttaaaaatacacatagacgaaacaacaccacacattttgcaagaacctgtgcaaacaaaaatacacattaacacattagagaggctgctatgggcggtggtggggggcggggaataaaagtggagcacaagaataaaagttaatagaaaaatgtgaaatgtgagaggacttttctaatctgactctaagacttattataaagctataataatcaagacaaggtagtgttctgtcatgacagacaaacagatcaatggaacagaagaaagggctcagaaataaacccacatgtatacagtcaattgatattttacaaaggtgcaaagacaactcagtggagaaaggaataactgagtcgccatgtgcaaaagtgcatctggatctataacttgaagcatataaaaatatttactcaaagtggatcacagactaaatgtaaaaccaaaagctataaaacataggagaaaacttttgatcttgggttaggccaagatttctatgtgtacaacatcaaaatagaaatccataaaagaaacatttgatatattggatttcatcaaaattaagaacgtttgctctttgaaaggcaccataagataatgcaaagaaaatatttgcaaatcactgcctgatcatgtccttatatccagaataaaacaccctcaaaactcgataagaagacaacccaatttcttttttaatgggcaggaaattcaaacatgctattcaataaaaaaaacttatccttagcaaataagtacatgaaaagacattcaatacaattactaatcaaggaaactcaaaaccacaatgagatactgctacacaccaattaaaatttaaaaggctgactatatcaagtgttggtgaggacagagaactgcaaccttcatacactgctgctaggaatataaaatgatacaaccattttgcaaaacagtatggcagtttcctaataagttataaaagtccacctaccacatgacccaggcattccattcctaagtgtttactcaaggaaaattaaaacatacgtactttcgaagatttgtgcaccatattcgcagcagctttatttgtaatagccaaaaggtaaacaacgcaaatgtccaatagtgaatcgctaaacaaattgtagtctatctgtacaatgcaatactataaaataaattttacttagccataaaaggaagaaaccattgatataggcaacaacatggctgaaccccaaaacagttatcctgcctagtatatactctatggtccatttacataaaattctagaaaatgcaaactaatttatagtgacctaaagtacatcagtgcttgcctggccaggtggtttcgggaggaaggggttaccaaagggcaagggaaaacttgcagggatgatgatatgttcataatgttgatctcggtgatggtctcacgagggaaacattaaaatttatcaaattgtacacgttgaatatgtgcaatttattgcatgtcaattatatccaaataagagatttttataaagaaaaaaataggtattctggcgcccagggccacccagctgtaagcggcggggtgggattccaacccagaagcgggcatttggagccctcatgcttcaccctagctccctgaaacaagcacggaggatggctctgagcagcgaggaaagtgctggaagcaagcaggccgagcgcgtccctggctggggacgttaatcattaccggagggcggcccgagcgcggccccgccccgggacggcagcctgcgcgcccrgccgccgcctgccctctccgctggccacctgctgccgcccgcgccatggtgagtccaggggtgcgcggccgcgatcggggcagcggggccggggcagccgcgggcgaggtgggagcgggaaggggcgggggaaagtcttttcgagtcccctgcggagccgccggggtccgaaagtggggtctctgcccggctctctgtcgcyggcggcggggaggggaagctgaagccctgagaggggcggtggcgggtycrmatcccacccagttgggaggccaggcctgccctgaccccggccagtgcttgttccgggacccttccgggggcggggcctacgaccttcctgggccggggaagacagtcgtggaggagtccacggatctcgtccccttggtggcccgattctgctttatactggggtgggagcgagagggaggctgagtttgcgcgctcgtgtgcgtgcctgtccgctgccccttcccgctggcactctgggtacggggtctgcctgggactcacgctctgcgccggtatgctggccccagagccastccccgcgccggcttgaggcccgtgccaggccacgggggcttggtggcgctggagcagccctcctcccgtgagcttcccccacccacccccggggcgggggcgggggcggggcccttgctctgctgtaagctcgsgagcttcatcagaccatttctggtccacaggccttcggagcaggcaagactgggagggccttttgataggagagggacttgggggagggaggatgagtggggctgtttgtgaggggcgctgaggtcccagagatgcaggcttgggaaatcggtaaccactccccacacctcgccagaggaggcaaacggggcagcgtccccctctctgtctccagagccrgcacctggaaggtttgtcagttcagccgcaggctgtgcgacctggggggttccagaaggctctaccgagaaagggaagcctyctaagagctcacctggactcacccacccctttaagagccaaggaagtaaacagtgggctctgatgctttggctgacttctggttgtctagatacacggaccaggcggtcagccacggggagaaggccagctctggagtagagacctacctactgggcagatgatgcaaatcgctgctgccattcaatccctatagtcatccagagccgaggggaagagaggggccaagctacatcagtccagagagagctcacgttttcaggagggaaaacagcagggaaaaaagacggacttaggaaagcactgcgatgcttcagctaccccaaatgctaccaggcccatcacaagcctgcttgccttaggaagttttttttttgtaatgcagatgacatttgctttatagcagtggagtttcctaaagtgtcccattggcacctcatgatgatctgtggaggtggaggttctgccaagagaggtacagccacctggctggtaaatggtgaaagcgggtctcaaaactcctgccaatcaacacatggtgtccagtctgcaggctgcctcataaawgctaaatcaacctccctcacattccctccccacccctaagggtatcttttcaattcagcactctatttctgccctggggtggtgctactctagaagcctaggttctgggatctgttaagctcctagacctggatcctcctaggatgaaactgacccttgcttccttgctttctctgaggttccactcatggcctgarttgtgccaatttgggctgccttgagggcacttcgcacattaggtaaataggatggggcactaggtttgccagctgcctttggccaagttccttccactttggcctgagcttcccaaccagccagaaaagcagacggaaaaccagagaaacctagccctggcggctcaggaccagaggctgcctgggagcatgactgaggacctactagaggtagtgccaacggcrgtcagctgcagtgtggctaagaatgggatggacacttattttaaatgtagctccttcgtccagccccagcaatgctgacacacagacaacactgcgccatcactggctaggggtgggcgggaaagaacagcagacaagtcgtttcccctctctaggcctgtttcctcttcaatacacgtgaaagttacggtagggacgtggggtgcatatgatgaagtacataataggaaaaggaaggggggagagtcatgggtactcttcctgagaggttgtggagtaacatatttgcatctgggatttattttgcttttacgccctcactgatgtaataatctcatggagggaaggtccgtaaggctttgagggcagggtgggggaagagtgcttctctgtccccgtcatatgaattacattgcttttgtgatttcccttgtgtgtgtgtggagtgttaaaacccaagacctgagggcctatcggcagacgagcctggaccccacctcctgggcagggtgccacccttgaggcctcccagcctattgctcaaagacctgctgccctttggtcacccacgtccaaagcagccagtggaagctaagttcccctaaaggttggagcccctctgttttgacctataaagagaaatgcccttgggcctctgtttttttccctcttctaggctggcaaagcacacaggctgagcgctgaggagagggaccagctgctgccaaacctgagggctgtggggtggaatkagctggaaggccgtgatgccatcttcaagcagtttcatttcaaagacttcaacagggtatggcaccagggtgggacagagttttctgagacgggctgatggggtcaccttacaaagcatgttctctcccttcacgtcttgttagccaagactctcagacaccacactcatccagttatttgggcactgtgccagtggggaaattaattttcctgtctaactcagaaagtatcatctttggggattggagagccataggaggatgtgtcttgggctctcccttcctggaacttttagcagcagtcttctgaggagatagttcaagtggaaaccatgcacatctgaagacatttgaacagacggccaagactggccaggccaaaagcctgttgtggtgtttccaccttgttgrcatcctaaatagcaagactttcttcctactgcaaggacaatctctaactcaagcctgagaaccagtgacaggatgtcaagggggaaatgattatagaggagtctcctggggggaagctaattcatcctcctgcgtctaggccttgaattggtgatgtccagaagtcctttctcttagaacactaacctggctctcactccacttaaataggcctttgggttcatgacaagagtggccctgcaggctgagaaactggaccaccatcctgaatggtttaacgtgtacaacaaggtgagtgatgctgtgtgcctctgttgtgctctgcccccatccaaatactgcgaactctgacacattctgaaggcttttggacttaacaatgagccttcctgacccataggtcatccactcatctcatttccaatctcactgagattgcacatgcctagaatcaacataaatacccctgggaaaaaaaaatcagtcttactataaagaaatgcaaattaaaagatgcatgagatagttgtggttaaagtagacatttaagtagacattaagaaggcaaaacccaagaaaggaaaggctgtgggaatcaggcatacttattcagtgttcatagctctaaatggctttaatcttgctggaggtatggaagaatgaaaaagtaataaacttgaactaagaatacacacatatttgggaggccgaggtgggcagatcacgaggtcaggagatcaagaccctcctggctaacatggtgaaaccctgtctctactaaaaacacaaaaaaattaggcgggcgcggtggtggacgcctgtagtcccagctactggggaggctgaggcaggagaatggtgggaacccgggaggcggassttgcagtgagcagagattgagccactgcactccagcctgggagacagagcaagactccgtctcaaaaaaaaaaaaaaaaaaaaatacagacacatagccaacctatcaaattatttgcttaatgaatagaaacagtcattaaatgtctaccatgtgccaaaagctctgctggtctctgtttataaaaacagtaagggtggaagaggtcgtctatgaatggatagtgtttaggagttggcattggtttttggttttgtctttagcttttaggttgctcttgacattcagatattaagcttttattctatagctgaagtcatgattatttttgagagacagcaaaggggagatgtagaagatgttgttacagacatgtcaggaaggagtccccaggagagatcgtactggccagctgctattctggagctcctagcagggctgagcccagcagctagtgactccctcctgttcttaagtgaagtcagtggaagcagaatttctggtttcatttcaggtccacatcacgctgagcayccatgagtgtgccggcctttcakaacrggacataaacctggccagcttcatcraayaagtagcagtgtccatgacatagaccctgcccttcctctttgaattcttccgggggaargggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacrgggtgaaataaagtcttgtcttagaaaccaggaccctaaaccccacactatgtaatagaaacacatgtgtttttatgtctcaaataaaactattatatcacttggtctcaggctctagaaacttcttttccacaggtcaatccaaattggagtcaataggcatttaaatgaaagcacttcctctgtgctaggcacttcctctgttcaaggtactggaaaatgacagggaccagaccaccttgccttcagattcattatcatctaggggataccatttgattatcatcaaacaggaacacaattaactattaccaattaccaattaactagtactaattaactattactagagtgaattaatgctaggtggcaggataagaaatgagctaaagggaacgcaagtgattaatggtgaaaagggcaaatctggaggctttgagttatgccttgaagacctgggtaggattcttgggaggcagagatggctgagagaacaccatgaacacagataagggtgtgaagggcacaggtattatatgcattgtggaacctatgtctagaaaggcagtctggggccatattacaggttgaacatccctaatttgaaaattggaaatccaaaatctgaaactttttgaatgccaacatgatgcccaaaggaaatactcaytggatcattttagatttctgattttcagattagagatgctcaacttgtcagtataatgcaaatattccaaaatccaaaatctgaaacacttctggtctcacacctttcagataasggatactcaacctatattttcttcctggctgtgatggctaatgttaggtgtcaacttgattgggccatggggtgcccaggcatttggtcaaacattccgggtgtgtctgtgagggtgtttctgaatgaggataacatttgaatcagtagactgagtaaagccgactgtcttccctaacatgggtggcctcattcaaccaggtgaaggcctgtacagaaaaaaagggctaaaaagggctgaccctcttccaaataaaagggaagtcctcctgcctgactgccttgaggtgggacattggtcttttcctgctttcggacttaaactgaaacatccactctccttaggtctcaaggctacaagcctccggtgtgcaacaataccatctgctttsctggttctccagcttgccaactacagatcttgggacttgtcagcctccataatcacatgagccaattccttataagaaatctctttgtgtgtattggttctgtttctctggagaatcataatacacaggcctatcatatcagatatggcagatcccaaatcctgatggtctcttcagtttcttaaaatcttagcaaagttcttagggcttgcctggtttactccacaagagagaagacacaggcagcttaggacctggcaggctatttattactggagcagttaagagatggtttgcacagtcagttccccagccaggaactctctaggacagaatattcccacgctgtcatgaagaagggggcactaagagcagcctcatctctacccccacgagaatgccacacaaattttacctcacatatgtcactatgcagagactgggaagccttcttcctaatagttctcacctgtgtctcctaactcaagtactaagctgacttgtaaatgccggggtcacttggaacaggaatctagccatgtcacaactcagtctgaatgagttggtcccccagcaaaggccaggaaaggggcagaggctggaggttgagaaataagcgtattgttcacaagagggattagcaggaccccgttcctagcatatatgctagtaaaggattatcaatacctatattgatggcaaacgagattcagacagtggtctcccatctgctccacttctgacttaaaattttccaagtgtgctttgatctgatgactggaggactgaaggacagaagacgccagatgcggaggtatggactatgctgttatgttacattcctgcctctgcttattttcatgggtcaagggttgaaaaatgttcacccgatgcagggacagctcatgcctgtatttccaacactttgggaggccaaggcgggaggatcatttgagctcaggagttagagactaggctgggcaatgtagagaaactctgtctctacagaatatacagaaaaattagccaggcatggtggcacacacctgtggtcccagctactcgggaggctgaggtgggaggatcacttgagcccaggaagtcaaggctacagtgagtgatgatcatgccattgccctctagcctgggtgacagtgaaaccttgtctccaaaaaataaagccaaccttggcagcactacagttgtatgaagcacattcatgtgagacaaagacacaggtaacactttcttttctttttttttttagaaataaataggtttattctaaaattaatccaaataattgaaattatagggaaggatattaagaagagaaaagattacaagacagaggaaagcataaaagaaaataaggtaattaaaacttcaaatcaggaaaaaggttctcaaaaatctgactttgcctacccaggtacagttggtggctatcaaattaggactcagtaattacttgtgtcactgagtgaaagctgctcattgctgccaagaacctacagagaaggccaaggggctgacgtacagctgtatggagcagcaataagcaccccagacacgacttcctagataagccaggcctcctcatccaagtacatcctggatcctctttctctctggtttccaggtactcaggaactaggccatttggcagaaaactgtagcaaaaaagcaatccttggcttgactctggcaaagtctgaatgggctaaaagccaaaaggaaaagctgggttatctgaatgacagccttcagatcctgactaacactttggaaaaacttctcgtttcttattcataatagaataagatctccagcagttacatgtgtgtgaagattatctgaggagctctgttagcccctaaaccaaatgcagggtttgaggccaatgccctttggttagacagaaccacactgcccagatggctagagaccacccagataactcaatccatcattaagttattgtaagcagcaaactgtaagcagaagtggatgatgaagatggaaaaaaatataagatagggcctgtccctggcaaactaagaacctgaatttcagacctctctgaaataggtacgactaccactgctggtgcaaggaccaatcagcgacctattgaagtgcctggaaatgagatggattgctgcttaactgtgtctctttcattggtcttggtatcagtgggcacacacgattgtttcaccaccagggggcaatctctcaccaggagcccattcaagcatggccactgccccatttgtcatctcgtgtgtgcccaagtaatcaaatgaatgcaaccatccacagtaattacaattagggtcatttaactatttaattgctttttgagattattgctgaaattaggaagggagcattgaaatgggaagggggaggttagagaagacagagatttaaaagaagcaagtaccattttccaagtataaaactcgtaatattaaaagtgacatagcagtatattcacatgactacttaagtctaatgcagaaacaagacagtacagtttttgcagaggccgatgtgacatctgcatgcracatgatactattaagtgtctctacccacctctgctacagagtagctgctatatgcacacatacacaaaaatacacaatgaaaagcctacaaaagtgttaagtcaaactaaggctcttaattgtaaattaaagtggctacagtaggtccctttgaaaaacaccatctcccctggcaccaatgttgtcacagcacagaggaagcgagtggctcggggtctggttctggggagacgctctacaggggcacatgcttctccatcttggcagctggcaagccacagtggtgtctgctgggtggctctgggttcctggacctcattcaacataatgcactgaccaaacagctctgaccacagctactctcaaagaggtgcctgccaggtctccctctgacacacacacatacacacactacccactcttggaacccacaatgcactgctgggcaaacaggaaaaacacacacacacacacacacacataaatgccacaccagccctgaatggcgtggccagctagtcacagttgttgggtcagtagtacagtgctcaagaacaattcagactaacatgccaaggagcctgaggaaaagtctggtagtcatggctctcccagccagcattcccagtgggggaaactagaagacaccagcctggagaggctgaatattcaggagtccctgagatggggaatggaacagaggaaagtgtcttttgactcatcttaagtactcccctccccaaatagaaacctcaaagactgatccatttcccctagggcctgggccaggagtagctcactgctcactgctgaggagaaaggcacaagatataatgtcataagagcaggacagtggctcagcctacagagttccctataggggaaagaaggcaggaaataggcgcagggtctggtcctgtccctgcaccaccctgagcagctagtcttgggaagggattacaggccctgggccataggctgctcgccattctgctttcctatcctgtttctctccctgtgctgctcccttttagccagggctgagaaatgttcagcacctgaggcaaaactgccatagtacctctgaaagctgaatcaagggggaagaggcagaagaacacactaatagagaaaattttccttgctacgggtgctctttcacacccacctagggtaagtcaaggcaacttgtgaaggtgctttgagctgttccttcaagcaaacacattttcattacataatggcttaacgcaagggtgcagggaaggaccaccaccaactttggtgacatatttgaatctgggtgttcatcctactctgatattcaaaaaagcatagaaaaaggtctgatttctgctcatcaccagcccaggatagggttcaggtgtgctctgaccactgccaattcaggaaggcggcaccatggccaaaagctcccagattatttggaaaccatgttttcttcctagtccatggtaacaagaaaaagccaatggaagcatcattccaaacaataatctccaaagatggtggcaaccaagtgtcaaatggggactgcaggcacagaagagaccaccccaaaccctgcctgggtggacgaagcaggtatgctagaatagtcctgtcctgcagaatagggaacggcagcttggtcgatctgtgccctggaaaaagaaaatgagttgcaatagaagtgactctaagacagacaatgaacctactcttaagagagacagggccaggcacggtggctcacgcctgtaatcccagcactttgggaggctgaggcgggggggcgggtatcacctgaggtcaggagttcaagaccagcctggccaacacggtgaacccgtctctactgaaaaagaaaattgaaaaattagccaggcgtggtggtgggtgccggtaatcccagctactcgggaggctgaggcagaagaatcgcttgaacccagtgggtggaggttgcagtgagctgagatcatgccactgcactccagactgggcaaaagagcaaaattccatctcaaaaaaaaaaaaaaaaaaaaaaaagagagagaaggctgaaaaagcctcctgcttagagtatacctcacacccagctgaggaaacatctgttatgtaaacgcctcctgcctgagataacaaagaagctctagctatctcataaactgtaccccagcttctctaaagaatcaggacaggtcagagctaccacacaatgtttaagtaaagttgaaagctagagagtttagaaaaggaaatggttaaaacaattcctagggtaacatttataacaagggcaaaatcattatgtaatggaattctctggggtcttcaaattaaaaaccacaaaaggaagataagaggaagaacaagaatcctgaggctcaagctgtctcatggtctatcttgagttgtgctctatggagcaagaccagatgtcaaagttgtgcacggcctgttccatatcccaagaaccttctgaaggctggaatccccttgagactagaaagggtccaagttcagtggggttttggagaaccattcatctggctgccctgggtgacagtgtcggtgctgtacaagctgtccaagaagactgaggacaattctgcaaccatattcctgtcaacagttgtctgggccatgccatagatggcaccctacaaatccaaagaaagagacattattagtgaggccaggtccaaaagcaagaataaaactgcagcaatgagccccttctccccgagtcctagcttcgcatgtgcactgccctaccccatttccacctaaggcatcccatcattctatcagaaaaacagctggcatagtcaatttttcacagggactttccagtctgcctttctgcataaagggactagcctaagaaaattccagaaaaaacatgtttactatctttcctgtgacaaaattttcttttcaaatggacactaccaccagctgcttttatacagaagtctctaacttacaaggtactttatagtgtatctcatttgagacttcagcaaccctaaggggtgggtgatgcagagatcatcagctccagtcaacaaataaaagatgtctgtggcaaaggggcagaggcaggaacagactccgggtcatatgattccttcaaactctccaccaacacctaaatttccaagagaagaaaaaaaactccaagtgtccctaccattcctgtggtcttcgctttaggattcttcatgatttgagtgacagattctcgaatgtcctttaggaattgtatagctactcgtttccgggcgtgtagtaatgtgatgcagaaatgaatactaggaaagaagagacagagagagatgaaccttgaagaaagaaaaaatgttctaaaatgatgcagccccaaatacgggaatttcctggttgccctttcacaatatttctgacaagtgtagtcatccaagttgttcctagtcctgggaatctcggctctctcatgcttggggtgtcaggcatgggctggcctcagagcttctcggcatgactgagaaccatgctaagaggatgaacagtgttggctgcttt

SEQ ID NO: 1670 - DNA, 16640 bp, Homo sapiens
ggagttcagtggtgcaacctcagctcactgcaacctccgcctcccaggttcaagcaattctgtctctgcctcccgagtagctagaattacaggcacgcaccaccacgcccagctgatttttgtatttttatttatttatttatttattttttagtagagacgggatttcacgatgttggccaggctggtctcaaactcctgacctcaggtgatccacccacctcggccttggcctcccaaagtgctgggattacaggcgtgagccaccacacctggccaaccttgactatttattataggtaattctgtgcagatgtctgacttatgttggccatctccaggatggacctgaactttcacacgtatgtccctatgactaaatccaggtgtcatttgcaaaaaacaactaatattattaagtagctaccagggctaggtatcactcaccatacatacacacatgcacacacacacatacacattcctacctcatccttacaacaatcttcattttacagatgaggaaacagaggcacagacaggtcgaataacttactcaaagtttcacagctagtacattcgaacccaggcttaaggacccatctttgtccagaccctgtatgcaagtgtctgtgacactggatgccaagactcacactagagatgttgaatttaggtctgaacaatatccaattctgtgtgtgtgtttgtgtgtgcatgtgtgtgtgtgttgtattcatgtcttaaccatccatattcatatacacatatgaacatctgtgctgtgattcttttttttttttttttttttttttgagatggagtttcactcttgtcacccaggctggagtgcaatggagcaacctccgctcactgcaatctccgcctcccgggttcaagcgattttcctgcctcagcctccagagtagctgggattacaggcacccgccaccatgcccagctaattttttgtatttttgttagagacagggtttccccatattggccaggctggtctcgaactcctgacctcaggtgatccacccgcctcggcctcccaaagtgctgggattacaggcatgagccaccgtgcccagcctgtgctgtgattcttgaagctgcaacccatgtgcatgcaagtgaatttcagcttccagtcctgtccatagctgtacctaagtgtggaagctggatgtgcatgtatgcatgtccatgaccttgtatagccacatctgggactcatactgcacactgaatttggctgacatgtccagactctggggccaaggctgggtcacacatactgagtggccacatgcgtttgacgtctgtgacaatttggtgaccgtgaatgactggtttcaagtgaccacctgtctgaacctgtatccagtgcccctgtctccacccccaaccacagaggacttcttgccctctggtctgttccccttcctctctctcccagagtcttatagcaaatggggtgggggctagagttctggagaaaacaggcagcggttgtaaataaacaacagggcaggcggagcatggtggctcacacctgtaatcccagcactttgggaggctgaggcgggcagagcatttgaagtcagaagtttgagactaccctggctaacatggtgagacctcgtctctactaaaaatacaaaaattagccaggtgtggtggcgggcacctcagctactcgggaggctgaggcaggaggatcacttgaacccaggaggcggaagttgcagtgagctgagatcatgccactgcactccagcctgggcaaaagagtgagactccgtctcaaaaacaacaacaacaacaaaacaaaaaacagggcagggtgtcttgagaagttaggggaaaggcataggcatatagtagttagggcagggtgcaaggaaggtgtaggaggcaatgtaaacgtccctgtcctcaggcatcctctaccccttctcttagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcmcactgccaaagccggtatgaaggcaggggctcagggtcctgagggagcctggttcggggggaagagctcctagatttgggggaagacggaggcagacgccagaactcctgggttctgaaagacgaggaggccggatgtcaagcccctgggttaggaaggagtgtgtgtttcaaagccttcgatctctgaaggaggaaggagaagactagttccagcttttgagcctcagttctagggatgtgagaatcctggattcggggacagaccaggagggggctgggagtagttggaggggatcgagttctaggagtgtgcctgacttcagactcgttggtccttgaggagcaggggctggaaccattggcttcagggtcttgggaaaaggtaatgggatgtcgagatttctaaagggtcgggagacctcgggttgcccactctttgatctttctgtcctctacttgcgggtaaccactggcccgcactccactggcgggaaaaccactcgcccgcacagcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctayccacgcgttgcccccacccgggggaggcctgtgtggtgtctggctggggcctggtgtcccacaacgagcctgggaccgctgggagcccccggtcacaaggtgcgtgaaaggatggagctggatgcgaggcctcaaggaatcctatgctccagggctcttgggcggaggggacaagggccggaatttatggatctgctccaagtccactgtcttccccagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgaggtcagagcctagaggggccatcaggcggaagaagagggatggggacaggtgtgggagtccggatggggttggattttctttgctttgggccagagaagatgctagggttaggcttggagatggagtaggaagagaagttagaataggggtgaggttggagttggggttataggtggggattgcgttgtttgaggtggataatgtgatagttagtttgagatggcatgggttggggttgagaatgggaatggtttggtttgattctgggtgggaaatacgtcagggttgaattgggatgaggtagattttgtttggaatgcagaagacatgaagattgagattggattttgagatgggcatgggtttgatttgattttgaatggtgaggatgtgggctgagttggatttaacttagtacagttgcactggagttgcatgggggtgagattggatataggttgggtgagttgtattgagctgtgttgaattggggttggggttggggttgggttggctctgtttgggataaactgggctgtattgagttgagttgggttggggttccctgggatggggatggattgggtttggggtgagattgcaaatggtgattaggatgaggatgaatccaggaggtttcactcaacctgagaccccctcttttccccacagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactgagtaaataccctctatctctggatcccagttaaaggacctaacagacactagattaccaagaatggctttttctttaaggtttagttctgggccgggcatggtggctcacacctgtaatcccagcactttgggaggccaaggcgggcggctcacttgaggtcaggagtgcaagaccagcctggccaacatggtgaaaccccatctctactaaaaatactaaaaaaatttagccgggcgtggtggcacacgactgtaatcctagctacttgggagggtgatgtgggaggatcgcttgaacttaggaggcaggagttgcagtgagccgagatcgcgccactgcactccagcctggtgacagagcaagactccatctcagaaaaaaaaaaaaaaaaaaaaagatttagttctgggcttcctggtagccatggcaaaaaggcaaatactgtcctttccttagccaggtccctgatatacagcagaggctggaactctgagctgctttgattttaccaaaaagccaagacaacctgttggaagcctatgggtttaccattgaggctgcaggaatctagttcctaattatcttcagagaccacaaaatgtgatgttcaaggtcgctgaatgttgaagtacatgaacctggctcgtgagacctaaatattgtactggtggtgggggggaagggtcattggaatctgtggttagcctgatcttgacctgggagggaaggttgtccagatctctgggactttggaggacaggacgttgagcacccataactgggagcaagaagtgggaggctcattgagaccccagcattgtttgggagggacactggattttgtaatgctaaagaacttaccctgggagacccctgaaacttcacattcctggatctggaggcactaggaatgtggtgatgtgtaccccaaaattttattatgaaaggaacagtagctttggggacctaggtcctgggtctgggagtgcaagaaccagggcattctgaaggccaaggcttatatttcagggggaactggcagctgagatgctagtatcttggctccgagtggtgcagggaatcagagccctaactgctggtgtttgagggcaccaggtctgggggtgcagggccttaattgagactgaggtatatggggctttgtaccaggggtcactgattcctccgtcttcctgtttctgcttcccctcagtccccccttgcctcactggctgctccccagagcaaagccccagagccacaggccctgccccacctggcttcaaccccaggaatgcgtccagcgtgatccagggcctgcagaacaggtgctggttctccctccccgtctacagctctggggatcggaggsgggggggcaattgtccagcccccaggcaacaggggaagggccttggccaacatctgggtgccagcagggcaggggtggggctctgaggggataagggcttttaaaagsctccccagggaggttccccagttcctccacctgctggcccctggacacctctgtcaccatgtggttcctggttctgtgcctcgccctgtccctgggggggactggtgagacagtggggggatgtgggagggggaacgggccctgattctcttgctggcctcacatccccccccgataagaccttcccctccaacaccccaccctcatccctctggcccacagtctatcctagtccggggtgccccggctcttatctatcttgcgcggscccaccctaaacttccacccccgctcctccatgttgtcatagtgctcactcccacaccagattcctgctcctcccaggaagcctcagtactttctcctcttccctagccaacgccctgtcccaccgctttaccaaaggggcagattctgggccatctctgtctctctctggaggaccccaaccctcccatgggcttcccccaccccacaggactctgatcatcccctcctgccccctagttccctgcggccacctatttggctcctgagtctacaaatcccaccacactccagtgactttttccatccagctgtccgctctcaactgtgtcctccagaccctgacatctggtctccccagtccttccagggtcccccaaatttcaccagaaaaccctgcttcccaaactggcatgtgggatcccccayctggtatgmgggggggtctgcaaatgtcccttcccacccagcacccccagctctcccaggaaaaacaccamaccctcccaccacatgctcctttccttggggaagttccatcccgccccaggccccagcccttctctgcctgaattgttcctacacagctctggttttctggaaccccacsccaaggatcctgaatgccttctcagccagcgcttctgccctggcctcccccaagtcagtatgtgattctacaacctcacrtcaagtgggtcctgcattgcattcccacagctgcttggcgcctgttctcaccacttctccaatcctcttcctaggattgcctccaagaggaccccatatccttccagtaccctcagaccatgaaccccatccccatgagaaacgaagatcccatccttcaccctgtccgagaaggactgccactcacgcctccctcctcctgagccccgtcccagtcctgaccgcaactgtgttctcagggccccaacctcccctcakattgccattcctggttcacaggaaggaccccaaaacctctcggaagcccacctctagccttaaccatagccctttcttttaccctttaaccaggaagccctgaaatctaactgtcccagccaagctggccccttccaaccccaatgtagggaccccaagtcacccccaaactcttcagtcsagatgctcttctttacctctcagacctggttccctaaagctgcatcctttcctgaacctcaaaagcccaacccaggtcctgtttccctagcctaggagccccttagccctccagattcttcctcagtgagcctctgatcctgtcccacccttggcgccttgatccctggtttccagaatccytttccactcccctaacccaccacctcccatcccccagccccagaccccaaatgacctgacgcccagatgcagtgtctgctccagacactgtctcctgtctcctaccctgatccctggaggctgctctactgtcagagcacaaaatctccccaccaggtccagccaccactccaaaagcccagggaacagtccagagtcccaccccttcccaacaccccttgcccatgtccccaacctccagccctggtcctctacccgcaatgtcccttcagacccacagcccagctccctctcctagccttgtccctggcctctcctgccaaccctgcccttcctgacccagcaccgcctctgcaggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgagtgagtaggggcctggggtctgggaggagggcatctatgctgccacaggattgacaggccagtggcattccccttggataacctcaggcaagactggggggctgagscagagaggaaggctctggcgcaggtcgcctggcagggcagagctgggctggacacccctctccaaggctgcctgggtctcttgggatctggttctgcttgtgtctctgtgtgactgtgttctggtctctgtcttcctctctctcctctgtctccttgtctctgcatctcccctgtctctgtctgtctctgagtctctctgcggcatctctgtcactgtgtctcaccctccatctctctacccatctctctctctctgggtctctacctcaccgctccctcatccctactaaacacacacccagatggacctaagggaggccccagagtaaaggaagggctttatccccaacttgtgtgcctgggagggggcgcctctccctctgtccagctccccgccccacaggatatccctccactctggagagacacagggaagggctggtttcagcgggagctgggtggggcaactgagggaggaggaaggaggaggcggggcgagaaacgcgcgggagggtgctgggaagggaagggggcctcgaccttggacttcaggccaggccacctgcccctggggagcccgcaccacagccccagctgcagctgagccgctctcaggcctcccctcctccctacctgcccccaccctccccacctgcccccaccctcccccagggcctccctcccttttctctcccacactcggtcactcctgcttcctctctgcctctgtttctagttctcactctgacgtcccgcgtcctttttcatttgtctgcttctcgctcccttccgtgttctgttccctcttcctccctcttccctgggcctgtttctcgctgtccctgtcttttatccttctcatctgcctcttttttgctcaccctgtttctcactgccctcccctccgcctttytcacccctctgtccttttgagctcttttttgctctgtctcttcatttgccttttgcactctcaaamtctttcatcttcccattcgctgtctgtatttctccataactatatctttcttcctctgtctccgcccacccacatttttctctttccctttctctctttggggaccctcccccatgctcccctgccccatccccttttccccttcccrtcttctcatccctccattcccatctttccccagcaattaccagctctggctgggtcrccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagaygctgtgaaggtcgtggagttgcccaccsaggaacccgaagtggggagcacctgtttggcttccggctggggcagcatcgaaccagagaattgtatgtgggggcagactgtgtagcccaaggcggggatggggactcctgygtccaagggagaaagggccagggaagcaggtgaggtcgggctgcagccctttttctcccgggttcgtagtctcatttccagatgatctccagtgtgtggacctcaaaatcctgcctaatgatgagtgcraaaaagcccacgtccagaaggwgacagacttcatgctgtgtgtcggacacctggaaggtggcaaagacacctgtgtggtgaggcagccctgcccccagggtctggaagggctgagggaggggactcagcctctgaactggcttctgagagctaaccaggcatctgcttcactgcttcccagctagctgtagccactcgccccatcagtgccccagctccccctccttcccccgcccatccagggacaactgcatctcaccccccacaccagagttcaccgttcctcgtggtaatgtgttgttaccgtcgagtcagagagtagtcctggagaggtggcctctgcgatgtgcccrcaggggcagcgtcctgcagatggtcctgcccctcctccccctracctgtctgcaggcactgtccwcctggaccctgccccatgtgcygmagctggaccctgaggtcccttcccccttggccaggactggagaccctgtcccctctgtgggaatccctgcccaccttcctctgggagtgggcactggaggccctgtctgcgagctggggctccccaggcagaacttgggccccgtagacctttctcactctcccctcccaccttgtgctcccagggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatccaatgtgtgtcacgttctgccatcacctatctttccagatgtggtgcacctggacccactcggctgaggctggggccaccccagctgtgtcaatctcatgcctggaagtctgaggtcaccagcaggtggggaaaggaaggggctgtgacaggtgcagacaaacaggcagggaaaggctcagatcccaaagggcgagtcagggacgccagaacagttcactcacactaggatggaccctgccctggtggggaggtggggggcaatggaaggtctgaggctgagaggttttattgtggcggggaagccagaaaaggtacagagggatgttattgcaagccatgccttcccagggaggggcccgttctgcagaagggtggagttgcaccaaatgctgggcggtgctgtgtccacctggggacaagggtggacatcggagctgaggccggaactccgggacaagggtggacatcggagcaccctggctgagcgggtggagagtggcttcagggtgtggcctgcgaaggctgggcaccaggggcagggccacacaaactagccacactgccgagctcagcgggacgctggacaagtgtctgcagaacgggaggggatgctgggcctctggggtggaggcactgtgaggacccagtgggcagggacaaagccgcaaagggcgggccctagagcgagggctggagtttgccaccggtcccctcggagggcgtggcctgatatcagggggtggggcctcaggggaggtcgaatatccagggcgtggccacgctgaaggggttggccgggcatctggccatggctaccggtcggtgtcctgaagacctcgggtgctattccttggaggtgcttgggtctcatcctcgagggtgtatgaaatgggaaggcccggggtgcgctcggagtcagcgtctgagttccgctgtttggatgtccgcctcgctgcgccctgctgcacggcccacccgcggtagctcagccgccgcgcattcaagggctgccctctgcttcacatgcccactgggcttaggtaggacacggctcctgggagatggctaggtgggccgctgtactccgagtcccaccctaggccccacccgcttcccgaggccccgccctcctcccgaggccccgccctcaccggagtgcagcatcaagtcgctggcgtcccagcacaggtaggaggtcaccaggtaggacaccaccggacttgggtgcaccgccttgccgttaactgaaaagagcgtcaggctgaagagaaatcaggagccctgcaatggggtggggccagagacagaaggctggacagtgagccctatgacccccagtaagaaaagagggactgagacatcctctcccaccctccgtgacaagcagacacacacacacacacacacacacacacacacacacgccctcacaacagacagaaagatacctggagagaggggacaaaaaaagaaagggaaacagagagtgggggagagagacatcccacagatagagtagaactgagtcagagctccccagagacatgctaagacagaggccccgaggggagcagcacggaagtctagatacacctccagaaagccagagagcagggctggggttagggagggcccccrccccccaagccaacacctaccaatgccgaggcagaggaaactgaagacaaagtcggccatgttcaggcggaggaccactggccaggaggagagggccatgggcgggaggaggactcagcacagggccacggccagtaacatgaagcccttgctcatatggatgagaactggggagagggggacaggggccccagagtcamccccagatacccctcttggtcaccctccaaagtcatctctgctgatacccacaagcagcccaacagacaaccccaaagtctggcacatcctcaaaatcacccctactcacctccccaaagtcacctcctagaaaccccaaagaaactccaatctcactcacaaggtcacccccagggacccctaaagtcatcccccagtcacacccttagagttgtcccaaatcacccctacttaacctaaaactcaattctcagacactctcataatcccacacaccccccaaggtcaccccacagaggaccccccaaaggtcatcccactcatcctcaaggttaccccacagaatcacctcaatcatttctttctttcttcttctttttttttttttttttttaagatggagtcttgctctgttgcccaggctggagtgcagtggtgtgatctcggctcactccaacctctgcctttgggctcaagcaattctcctgcctcagcctcccgattagctgatactacacgcagctgctgccacgccagcctaatttttgtatttttagtagagacatggtttcaccatgttggccaggctggtctcaaactcctgacctcaggtgatcggcttcccaaagtgctgggattacaagcgtsagccactgagcccagcctcgatcatttctagaaccacccccacagacacccctggtcaccctacttgaactcctaaaaggtgtctcataacaactcatgttagtatcctcagtttcactcccagacaccctcaacagcaccctcaaagttatccaagacaccacggtcaccccagtcctctccaaagtcaccctacttctgctctagtctctgctagtcaccccccaaggtcccctagtggccccattcacatgccgagaatctcctcagacatcctaatgtcatctcttgttcacacctgagagcccccacaaaacacatacagatttgcacacaagaaaaactttcaagtcaaatactctaaaaccaatgtgcccaaaagcttagttccagtttacagtggatatttatccaacttagacttccagcagaagagaggtttacctgtttccgagatgctacatctcctccttttagccctttttctactttgtctacttttcaacagtgcaaaattgttttagccaaataggccaagacctcatctgctttgtttctggcaaactgcacatctctaatacccaacaagaaagataaaggatcatcatatatacagaagagcaacagcactctgggaagtgggggaaatatcagaccccttggttttttgtttttgttttgttttgttcatagagatggggtctcactgttacccaggctggtctcagattactgagctcaagcaatcctccctccttggcctctcaaagtgctgggattacacgtgtgagccaccatgcccagccagttcccttagttctttctgctcattgaagagtcaagaagcagaggtcagggagaaggcaccaagccagaaaccaagaccttgaatggtgaatttggtctgcccagaacagcagcctgacatctcttggggacaccctccacccaactcacataaccctggatgagggattctcctggcatatgctggcctctgggccacagaggtaatcatgtgattctggctgagccaatcacagtacccyagctgcagaccctgcaattggcccaaagatggacacatgaccaaagcccaaccaatcaagctctgccccaagactttttattaggaagctgtcaaggaaaagcagtctctcctcaaggattacaagcctgaagctgcctaagccttggacctagcttcatggggagagtaaaactaagaaggaaaacagacaagcgaaagagcattgagctgacactgaagtccctggctctcgtcatcccagagagcagcccactctgtgatttggtcagaatgagtggatatttgcagcttacctccccaccatgcatttcacctcctgcccattccccattctcagccccagtcttaagccaatcagccaactgtactccactggccatataattggctcggggtgctcatgtgccccaagccacacaggattcttgcaagaactgttgataacttttttctaccggactcggcagttattaccaactctgccaagttgctaacaactctgccagttttttgtctgtctgctctcagatccatttcccgccctgtcctgttctgcactgcaaggaccacatttcccagcctcctttgctcaccatcttatcactgtgtttgactaatgggaggcactggcagaagactggttctgggaggagagggcaagccagggtatttattagcctctctatctctgcatgtggtgggtcttccgtagtagttgtatctattctctgattctagccacttctgagcaatccaaccatgaacctatgcgttccagagggctgcagtttctggactgtagtaataccacctcctccctttgtccttctggccaagtagcagcatcctgtagttcctaactcctggtttgcctcactatttcctattggcttctcagctcctctgttactcacgaacaaattccctgtatttacttccttctgaagaatctggaatgatttattttccttactggattctgacttgccactacacagagccttgagaatgaagccaatcccatagccaaaaaacagtaatatctgatactatcacttgggcccctggatccacccatgcctgaaggcattcctaccattaccatttttcactcaggtgatcccataaaggatcccctagctagttcaagttagttcactcaagctaatacaactagttcactcaagctagttcaagttagagtttgtgtcacttgtggctgggcacgatggctcacacctgtaatcccagcactttgggaggccgaggcaggtggatcacctgaggtcaggagtttgagaccagcctggccaacatggtgaaactccgtctctactaaaaagataaaagttagccgggcatggcagcgggcgcctgtaatcccagctactccggaggctgaggcaggagaatcgctcaaacccggggggtgaaggttgcagtgaaccaagatcacgccactgcactccagcctgggtgaaagagtgaaactccatctcaaatttaaaaaagtaaaaaataaaaaaaatttaaaaaaaaagagtttgtgtcacttgtgacccaaaaactcctgactaattcaagtcccttccttaggacagcagggagcacagaattcaatgttccctgcataccaactccaaaatcacaatcaaaacctaaaaataagtaatgagaatttaaaaaaacagaactgaatgttcatcaaaaatctggagggagaacctcccgaagccaagaagcaattaataaagtcacagagacaaaggtgaagaaattaaactacctaaaaattctaaggctgggcacagtggctcatgcctgtaatcccagctctttgggaggctggggtgggcagattgcttgagcttacaagttcgagaccagcctgggaaacatggcaaaactctacctctaccaaaaaatacaaaattatagctaggaatagtagcactcccctgtagtcccaactacgtgggaggcagaggtgagaggatggcttgaacctgggaggcggaggttgcagtgagccgagatctcatgccactgcactccagcctgggtgatagagccagactttgtctcagaaaaaaaaaaaaaaattctagatttctataccttaaaaaataataataagggccaggcgcagtggcttatgcctgtaatcccagaactttgggaggctgaggcaggtggatcacctgaggttaagagttcgagacccgcctgaccaacatggtgaaaccccatctgtgctaaaattacaaaaaaattagccaggcacggtggtgccaattacctacaattcccgggtcagtatccaagaccctccaccagccaggaacagtcacggggtcagtatccaacagcctccaccagccagcagcaatcgcctggtcagtatccaagaccccttgccaattattcacaatcaccaggtcagtatccaagaccctacaccag

SEQ ID NO: 1671 - DNA, 17809 bp, Homo sapiens
gctgcgggggtgtccttattgaccacaggtgggtcctcacagcggctcactgcagcggcaggtaagtcccttcctggggtgggcgaagggaggactatgggaaggcaagcgctgggggtaggatcacaagggagggtggtgcccactgggaagaagctgatcctgcaacaagagagtctgaggttagaccaggagtggaacttccttagcagtgggcctggggtggtgctgggcagggtgaggtatgttgggtggagggccggggagggtcctggaacctgccctcctgcctctcccattcctgcatgtaccctttctttcctatatgacatctgccactcaccccagccattccttgacccagtctgggcccggggcccaggtctcacccaagctctttttctttttcttttttttatttttttgagacagggtctcgctctgtcgcccaggctgctgtgcaatggcgtgatcacagctcactgctgtctctgcctcccaggttcaagtgattctcctgccccagcctcctgagtagctgggattacaggcacccgccaccatgcccagctaatttttgtattttttgtagagacagggttttgccatgttggccaggctggtctcgaactcctggcctcaaatgacctgcccgtcttggcctcccaaagtgctgggattacaggtgtgagccactgcacccggccaacatgacccaaactctttgtgcaacttcagaatctatgcctggcacctctctgggcctcagtagactgatgttctggaatttttttctttttctttctttttttttttttttggagacagagtcttgctctttctgtcatccaagctggagtgcagtgatgctatcttggctcactacagcctcaaccacctgggctcaagtgatcctcacacctcagcctcccaaggagctaagactacaggcctgcgccaccacacctggctaatttttaaattttttttgtagagacagggttttgctatgttacccaggctggtctcaaactcctcagctcaagcaatcttcctgccttgacctcccaaagtgctgggattacaggcatgagccactgtgcctggcctggaactttttttgtgaaaggggagatcagatgcaaagaaacagagactcagggagagagagggccagcagcaggatgcagagaggccattcatcaacccactcgttcaatcatgaacccactcgtccacgcatgagcatggagggcacatgctccgtgccaggcggtgggaataaggcagtgaacaaggtccactgatgtccctgccttcatgggcttcaccagccgagagaatcagaaagagaggcctggcgcggtggctcacacctgtaatcccagcactttgggaggccgaggcgggcggatcacttgaggtcaggagtttgagaccagcctgacacacatggtgaaaccttatctctactaaaaatacaaaaattagctgggcatggtggcatgcttctgtaatcccagctacttgggaggctgaggcaggtgaattgcttgaacctgggaggtggaggttgtagtgagccaagatggtgccactgcactccagcctgggcgacagagcgagactcggtcttgaaaaaaaaaaaaaaaaaaaaaaggagagagagagacacagatgcagggacatggtaggagaaacagggaacacccaagatggaaagagggtgatggaggttgggaataagagcctgtaagagagactcggagaatgagagttgcgggtgagaggacagacagtgaggggcagaacagtggggagcggcaggagcgcctgagtgtccgtggaggggtgcaaggtgggggactgcrtgcctgccacccgctcagccgtcgccaccggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggagtaaggggcccagggccaggggtcaggggtcaggatgggtacaagtctgggatgcagggcgagaggtcgaatcatgacacctcagaggaaggatgggtaaagggtcagggtgtgggatgggacatcaggatcatggtttggggtcagagattatggtggattggggtcttgggagccaaaggggttaaaggactgggtatgaagtcagggatcagaggtcagaggtcagagtgtgtcagaggtcatcacactggagcaaaaggcatatatatatatatatgtatgtataggatatgggcattgtgggtcatgggtctggggttagaggtcaccgtagaattaaggtcatgggatccagaggttgtacaatctggtcaaaatctgaggatggaaattgggattctatccaaaatcacatatctgagattggaggtcatagcgtttggggtgtggggcccgaagtttggggtcatggaggctggggcccaataaactaggatcaggggacactggcgttggaagcagtgaggtttggaagatgcagagctgaggttggaggttaaggtaaagacagggacatggggtcaggagacagaagatatgagatcaagctgggatcataaggtaataagacagaaggtcaaagatcacagtagctggcattgaagagggtcaggtctggattcgttgtctctgacgctggagagacaagaaagttcttgagttatgccactcaaagtcaaatgtcaaagatcaaagagaccgtcaatcatctggggtcatgattcatatgaaattaagtcataaatatgtaacttggaggtttcgggattgtagtacaggtcggtgaggggcaggggtattgacatggatgggccacatccagggaagagggacgtggcctcaaagtggggagatttaggggaccctgcagcacgcatgttctctctccagacccattcccggatctgctccagtgcctcaacctctccatcgtctcccatgccacctgccatggtgtgtatcccgggagaatcacgagcaacatggtgtgtgcaggcggcgtcccggggcaggatgcctgccaggtgagccagtgcaggcagcgtgcgtggtcaccaggacaggaagtgaaggggaggggctggaagcaggaggggaactgatggaggatgaatcagggaaaggggatgctgcagagagacggggtcaaaaaggaagggagaggctggttacggaggctcacacctgtaatcccagcactttgggaggccgaggcgggcggatcacttgaggtcaggagttcaagacaagcctggccaacacggtgagactctgaatctactaaaaataccagaattagccgggggtggtggtgcaagcctgtggccccagctacttggaaggctgaggcaggagaatcgcttgatcccgggaggcggaggttgcagtgagctgagatcacgccactgcactccagcctgggcgacagagccagactctgtctcaaaacaaaataattaataataataataataataataataataataatggaggagaggcccaggataagggagggagagagacagggagtaaaagggaggaccggggaatggaggagggggaggggcagggagagagagggaggaagggaacagagaaggaaagatggggcaggggttacagagagagacagcaaaacagacggagaggactgggagcccagacagggaaccagctgtttctggggctctaagtctttcccataccatcctccagttggtgctgtcccagactgagagagatttgaggatggcggtctctcccctcattggtcagggccccagccattgtccttgagagaactctgtgcttttgatggagtcctgcccaccttccctgggattggtcatttttgatggcactctctcccctcattggtcagaaccccaggcattgtccttgagagaacctctatcctttatggagtcccaccctcctcccctgggattggtcattgataatagtgttctctctcctcattggtcagggccccagccattgtccttgagagaatgctcgactctttatgttgtcttgacagcctcccctgagattggtcattaatgactgtgctctctctcctcattggtcagggccccagccattgtccttgagagaacctctgtcctttatggagttccacccttcttccctgggattggcccctagagacagtggttcttctcttttggttagccattgccattgtcctccgggaaagtgattatactcttttgtctaatgaccagacttggagccctccccaaggcccaggactgggttgaagggttggggaggaaaacagaaataagatgtctcccttgttcagacagtacttctcttcccttccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggccatgtctgtccatttgaagtcctcatgctggttgagactggaagaaggactcagcagtttccctatctcataggagtagaaacagagctcaaataaggccaggcacagtggctcacacctgtaatcccatcactttgggaagctgaggcaggtggatcacctgaggtcaggaactcgggaccagcctggtcaacatagtgaaaccccaactctactaaaaatgcaaaaattagccaggcatggtggcgcatgcctgtaatcccagctactcaggaggctgagacaggagaatagcatgaacccgtgaggcagaggctgcagcgagccgagattgaaccattacactccagcctgggcgacagagcgagactccatctcaaaaacaagcaaacaaaaaacccagtgctcaaataggatgagggtcttccctgagtagttactcagaaatggagtagaaaaagttacttttaataatataggctgggtgcagtggcccacgcctgtaatcccagcactttgggaggccgaggtgggaggatggcttgagctcagatttcgagatcagcctggcaacatggtgaaatcttgtcactacaaaaacacaaaaaattagctgggtgtggtggtgcgtgcctgtagtcccagctacttgggaagctgaggtgggaggatcacccgagccggggaggtggaggctgcaaagagccgagatcatgccactgcactccagcctgggcaataaagtgagaccttgtctcaaaaacaaaaacccagcaatataaataagacacatgtttcttcatctggcataatagaaatagtgcccagagcttataagcttttcaagagtccacaaaagacccgaaaaagaaaaagaaaattgttagctccaaaataccagatgaaagctgcaaagtcaacatttatgaccatttaatccaatgtccataaaacgtagcattctttccactagccaactgcagtttactttcttgtaatgaagcatacattgtatctttaatgtgggacgtggctttgttctaataagacgaagggtggagtgcaggcttggaaagcaggagagctcagcctacgtctttaatcctcctgcccaccccttggattctgtctccactgggactcaagaggtgaggagagaccatctccccaaatgcactgaagggaaactggaggagggagggagtgaggggtgatcataccagcggaggcacatttgctgagccccccygcagtctgctctttccaagtggaccctcctggaagcctgatcccaacctcccctgcaagcaggtctgtcacccccatctctcagatgaagaaactgagccttgcaggggtggagtcccttgtccccacgtcataagggtagtcatagtagtaggaagaggaagcacctaggtttgaggccagggctggctgctgtcagaacctaggccctcccctgccttgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccagtaagtgaacagctggactygggctgcctgggcggcagggagaagcgggcaggggaagggtcagcagaggagcgaggccccagaggagccctggggtggagcacagccaagggctctgttccctttcctggactcggcttccacaggccctgacctgcctcccccaccctccggtcctgcccctgtgcctggcagcagccccacctgtgtgacatcccagcacaccccccctctccttgcaaaggagaagggagcggcctaggggaggccaggggcccacctgggctggggctgtggagagggagtggctgggacgggaggaaaaagagagacggagattagatggaagaagagggatttcaagacaaattgccagagatgcagtcagagagactgactgagagacacaaagatagaaggaattagagaaagggccacacagagccagacagagagagaagagtggagrtggagacagggacgaggacagagaaaggcagacagacacatagggacagaaagagaaaaatcacacaaagtcagaattactgaatgacagggaatgacacatagaacgagacacagattcagagactcagggcagggaaaggaaggctgcagacagacagacagacagagggaggctgagacacagggagaagaggggcttggagaggtggcacaggcaggcagccagtgcctcagaggcctccggggagggccctcacacacaccccgccccggggcattaaggcagggcttggaggccagtcatcctgggcccgcccagggccgcccccctgccagcccgcctgcctggtgcctggcacctggcgctccaacccagcctacctgctgtagctgccgccactgccgtctccgccgccactgggcccccagagccccagccccagagcctgtgagtccaggaggaaagggaagctgcccctccccgtccaggtgtcagccctccccaaggacacctgtcccactcgggcacccatttctccctctgctctgtccttctctgcttgggtgggggttcctggcctctctctacacctctcacctccgatggctgtccgcagcctcagttacctctaatctccatggcttcagctgctgagctggccctctgctcccacccccgctggccagggcagcggagggcactggccctcccctcgaccagccccgcccagctttgcttggctgtccttcaaaagggcaggggtttggcggacagggcttcagcaagccgggtgatgggggtcccagacattgtctggggctgagccccctactcccctccagcagacctcaaaggctccatatcgctctgctgcgaagacaatgaaaaaggggtggctacggaacggtgtctggttccccttgtccttccaccccaagctgctggggcctggccagctctcaaggcaagaaggaaaacatcctctgacatgtgccggggaggtcccatggctgacttgaacagggccgaaccatggcttgacagctcaaagcccctcccaacgacttccacatggttcttggtatctcggaagcttctagctgtgaccaggccctctccaargccaccctagacacctaagatatattttaagtgtttggagatctgagtgctgtgagaaacaggggatttccccaaccttgtttctcccaagtggggagcgggagcaggtgagggagagaggagarggcatgagccagccccccyctcccgatttccccgtaaagtgatgcggccccatgtccctccttgttcccagaggaacctggggcccgctcctcccccctccagrccatgaggattctgcagttaatcctgcttgctctggcaacaggtacgcaggggatggrggcagggcaggatcctccctcttgaatctctgggatcccctaaccctctgtgtctggacagtgacagggctgattccaaattacagaacaacccataaggcacctgaactggagcagtggtcatgagggcctggatgcccttctagataatccctttaaatgccaaaggaggagaggtcaagggggtcgtaaagggtcccgtggaggggctgaggaagctggagttgggggagcagtcactcaaagcgcccaggacaggggctactgaccaaccagtatggaagtatttccttttttttttttcccagagacaaagtcttgctctattgtccaggctggagtgccgtggtgccaacacggctcactgcagtcttgacttcccgggcttaagtgatccttaagccatctcagcttccccggtagctgggaccacaggcacctgccaccaagccaggctaattgtttaattgtttgtagagatgggggaggaggtctcactatgtttgcctaggctgatctagaactcctgggctcaagtaatcctcccaccttagcctctcaaagtgctgggattacaggcatgagccactgcatttgaccttatggaagtattttcatcctttaatacccgaccccagcatccagggcaacccagagggacaccagaccagggcccagaccacccactctctttctctcctccccacccccatttctgggagtcctcctggtctaccacctctccttcctgagccccttcttttgctctcaccccctccagggcttgtagrgggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccgtgggtgcgggggctggggcggtgccggggtggggggctgggaatggggagatggatggagagaagctcagggataggggtgctggtaaggggattagagatggggatgggtagtgtcagcaaggttgatgggctcgagttggtattgaaggtggggggatgaatggggttgggatggggctatggctgggaagggggcttcggtgggagacgtggaagaggttggaagcagagcgatgtttcttcatcctcaaaggtgtcactcacctctcccacccatgtctcccccgacctttcctcctccaactactgtctctcccacctcagccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcaygctgtgtcactgctggcaccagctgcctcatttccggctggggcagcacgtccagcccccagtgtaggagcaccagaggggaacctggcagggggtggtgaggagggagtggtcaggattgtggaagggttcagggcatcagagatssggttcacagtgacgatgtgggataagttgagaggatgtgtggaaaacgtcaggataggggggtggggacaaaagttggggccttggagtcagacggacgggatatgcaatcatacatccataacctcctggttgtaagaccttaggcaagcagcttcacctctctgaatcttgattttcttctctataaaatgagaatgattatacccacctgtcaggattggattagagataatgtatatcaagcaactgacataaatcatttattggatagcaggctgggcaccgtggctcacgcctgtaatcccagcactttgggaggccgaggtgggaagatcacctgaggtcaggactttgataccagcctggccaacgtggtgaaatcccatctctactaaaaatgtgaaaattagttgggcgtggttgtgtgcgcctgtaatcccagctactcgggaggttgaggcaggagaatcgcttaaacttgggagacggaggttgcagtgagccaagatcacgccactgcactccagcctgggcaacagagcaagactctgtctcgaaaaaaaaaaaaaaaaagctggatagcattgctgttgctattgttacaagaagagaggtgagttggctgcgtctaaggacagggattcccccaggggcgggatcacagcaagcactgcattaggggaggtggcagggggctcattcccacagcccctcacgctgtttccacagtacgcctgcctcacaccttgcgatgcgccaacatcrccatcattgagcaccagaagtgtgagaacgcctaccccggcaacatcacagacaccatggtgtgtgccagcgtgcaggaagggggcaaggactcctgccaggtcagtgtggtctccaaccacagccccatccccatccccagcttcaatgacatctttaccgacatccacaatttcatccccaacctcaacccgccgacccctgcaactcccaatccatctcttcccctgttcccrtttctgacctcagcacaaacttcagctccatccccgtttccacaccatttccagctccaaccatccccaaactcgtttttgagcctaaccccatcctttatcccacccataatcccagctttatygctaaacctatcacctttcccagtgcctacccatcctgtctcggccccactcctaagcaccgtccccacctcctccctggctaacaccatgctcaacgctttctctgaccgacattctctctcccygtgcccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctrcgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaatctactgagtgcttactatgtgctagaccctgatccaatggcttttattttattttattttttgacagagtctcgctctgtcacccaggctggagtacagtggtgctatctctgctcactgcaacctccacctcctgggttcaagcaattctcctgcctcagcctcctgaatagctgggattacaggtgcctaccaccacatccggctaatttttgtattttttagtagagatggggcttcaccatgttggccaggctggtctcgaactcctgacctcagatgatctgccctccttggcctcccaaactcctgggattacagacgtgagccaccgcgcccgcccggctttcatttattaattaaaagaaattaaattaattaatctatttaggagacagtcttgctctgttgcccaggctggagtgcagtaacaatcacagctcacggcaatctcaatttcctggggtcaagtgattgtcctccctcagcctccagagtagctgggactacaggcacatgccacgaagcccagctaatttttgtatttttcgtagagacagaggtctcagtatgttgccccggctagtctcaaactcctgggctcaagcagtctgtcctcctcagcctccaaaagtggtgagattacaggcatgagtcgctgtgcctggcctccaagcactttcaaatgtatcaacttaatcctcacaaaaccctgtgaggtcggtactgttttcatacctattttatagttgaagaaacagacacagagaagcaaagtcacttgctcacagtcacgtggctaggagagcaaggatctgaagcaaggcgatctcttaattaccaagtgatgttcctggagtaaggctctgtttgtttcctttcctgtaaaatgctgcatgcaaaagtataacacagtaagtaaagaagtcagttagcctgcacatactaagacctaaccaaaggagcttattgtttttctccaacttccatgataggtaattagatagtggagacctctgctggccaatatggtagccactaaccgcagctggctcttccaattaaaattacataaagccagaaatgtaactcctctgtctcacttgttatatctccaaggctggatagccacatgtgactggtggtggctggattagctagtgcatataaaacatcactgcagaaagttcagctgagcagcactgagttagatggcctctgaagaggatgtcccacggagagaatccagaactcaggatctttttttttttttttctttgcgacagagtcttgctctgtcacccaggctggagtgcagtggcgtgatctcggctcactgcaacttctgcctcccaggttcaagcaattctcctgcctcagcctccctagtagctgggactacaggcctgtgccaacatccccagctaatttttgtgtctttttagtagagatggggtttcactatgttggccaggctggtctcgaactcctgacctcgtgatccgcccccccttggcctcccaaagtgctgggattacaggcgtgagccaccgcgcccggccagctcaggatcttttgggatggtctgttcacctcgcagaagtggctggcatgagcaataggagcccagagtggaaccagggccttctggttgtcaagtggacttgctgtgtgacctcctgtgagtctctgccctctctgagcctctcactcctcacctgagatgagggagttggctgaggtgatgccgatgcccctcacagctttgacctcctatgattcaggggcctgtgtgtcacctggtggcacacagatggcagggagggtgtgagatggccacacatgggtatgaggcagagccacagccccccccaacacgcacatgggctagtcactgggacacacacagagctcactcacggccacagagtgggcgtgggtttccctttttccttgtttctgtttctcttagcctcggcgcctccctccctccctctctctctctctctctctctctctctctctctctctggctcttttagccttggtttgttacaatctcccttttcaagccagcctctgtccctcctactcaacctgctttatctctaggccttcctccttcctcttccacagtctggcttctcacattgtcactctaggtatgcacttcccattgatttcctcttgctcagtggcctctcatcctgccacccctagccttgctggggacgtgaaccctctccccgcgcctgggaagccttcttggcaccgggacccggrgaatccccacggaagccagttccaaaagggatgaaaagggggcgtttcgggcactgggagaagcctgtattccagggcccctcccagagcaggaatctgggacccaggagtgccagcctcacccacggtacaattagacagagggaaagggagggagcccgggggtgggggtaggggagggtggagaagcttccggactccttggggttaaaagggaaggtcccgccaggggtccctgggcagaggataccagcggcagaccacaggcagggcagaggcacgtctgggtcccctccctccttcctatcggcgactcccaggtgaagctacctgcaccccacccgggttggggtggattgcgagaggatgggtggggacccccgggccacaggcaggagccggcttagagcctcggtttctccacctgcgggacgcggaagtccccccgctgtgaggttgagaaagaggctcccactggctccgagcctcggatccccaccccgcgcgtgaaggagggggaaacctcgggcgcggcgtggctgcagccagggtagctggggcgcggagagcgctccactcgggcacagggaggacgggaagatgccgcgaggggcgtcattagggtaattgtgcccattaccgctgttccagcccgaatctcccgtctgccagcccctggggttatcggctgcaggtcaaaagggtgcttgcgggctggggtggcccaggctgggcggatgagcgcggcgaggtgggggtctctaacggagcatctgttttaacccgcccctgcacacaccccagcagatcctggccatgagagctccgcacctccacctctccgccgcctctggcgcccgggctctggcgaagctgctgccgctgctgatggcgcaactctggggtaaggtcgggggcagggggcggggagaggcgccggtgggaggcacgggcgggaggagaatgtgttcccgtcaccaagccccgcgcacctctcctcccccgagaccccagcacccacccagcgctccggagcacggcccgcccccaagtcagctgggcccttcttctggctcggcccctgggtgacccgccccactcaggccctgtccgatttctgccacccggatcctcgctcttccgtggactcttcgccgcgttctttctcctcctcttacgccgccccatcccggccccgctccattttacactaccgtgttttgttttgtttgtttgtttgtttgagacggagtctcgctctgtcgcccaggctggagtgcagtggcgcgatctcggctcactgcaagctccgcctcccgggttcacaccattctcctgcctcagcctcccgagtagctgggactacaggcgcccgccaccaagcccggctagttttttgtatttttagtagagatgggatttcaccgtggtctcgatctcctggcctcgtgatccgcctgcctcggcctcccaaagtgctgggattacaagcgtgagccaccgctcccggccacaccaccgtgttttatcctgagtcttgccttaccgctttttgccctctcccctcactttttttcttcctctttccctttctctctcttttttctttttctttctttcttttctttctttcgttcttcttttccttccttcctttccttccttcctttcgtttgtttcttctttcttgttttactttctytcttattttttcttctttctttcttgtttttttctttctctctcttrttctttccttcttttttttttttttttttttttgagacagggcagtgctctgtctccgtggctggagtacagtggcccaatcagagctcactgcagcctcgacctcctgggctcaagcgatactcagcctccagagtagctggtaccacaggcatgcaccaccacatccggctttttttttttttttttttttttttttttgagacagggtctcactctgtcgcccagactggagtgcagtggcccaatctcggctcattgcaacctccacctcctgggctcaagcgatcctcccacctcagcctcccaggtagctgtgactacaggcgcatgcctccgcgactacttttttgttgttgttgttgttgtttgtttgtttttgtagagactgggtcttgctgtgttgcccgggctggtcttgaattcccgagctcaagcggtccaaccgcctcggcttcccaaagtgctgggattacaggcgtaaaccactgcgccccacccctctcctggttttcaatcccgttttgttattcacaccccttcctctccccgatccccgagttctatccccgcacccttacctccccgccgcgttcaatccccgcccctctatcgaccagcgacgttctagccagctctccaggcgcgctgcgttcagtccctgccctccagacccaccctattctgtctcattactccacgctaccctatcccagcttccttccactttcacgcgcttcttctcctcccattcccttcggtgcacgcgaaacccccaatatttccctaccaccctcgcgttctggctgcgtcccccgtccccgaacgcagtccagtgccacagcccagctccaaccccaaacccagaccctgccctccgtgctttgattccgtcccctttctttctccagccgcagaggcggcgctgctcccccaaaacgacacgcgcttggaccccgaagcctatggckccccgtgcgcgcgcggctcgcagccctggcaggtctcgctcttcaacggcctctcgttccactgcgcgggtgtcctggtggaccagagttgggtgctgacggccgcgcactgcggaaacaagtaggaggagatccatccccgaggacgccacggggggctgtggaggcggcctccagggaggagcgggcagggcggggtctctcggaactcccacagctggaggtgcggtccccggtgtccttccagcaggaggagagaccgggcttgcgctgtggccgccaggggrcggtgtggtccttttccgcatttctgggcccgtcactcctctcccgctgattctccttgagctctaggaggaggtggttgcctgcaacggatagaagccagggtccggtgtggtcaggaatttagaactaaaggaaaaggttcacttcgtgagtccccgttgaaggaggaagggttgggtattaccacagagaaaatgtggagttgggctgggctcggtggctcacgcctgtaatcccagcactttgggaggccaaggcgggtggatcacctgaggtcaggagttcaagaccagcctggccaacatggtgaaaccacttctcaactaaaaataaaataaaataaaaaataaaaaattttaaaaaaattaaaaaaaaaaaaaggctgggtgtggtggtgggtgcctgtaatcccagctactcaggaaggaggctgaggcaggagaactgcttgaacctgggaggtggaggttgcagtgagccgagattgcgccattgcattctagcctgggtgacaagagcgaaactctgtttcaacaaagaaaagaaaaagagaaaagaaaatgtggaaggcttacctaggtgtccaggcccccagccctcctcaattcctgcagatcctcagagctcaaacaactgattcctcctccccatgtccactgaggtccccttctcccacaaggccctcttccctcagactcttcctatct

SEQ ID NO: 1672 - DNA, 44978 bp, Homo sapiens
ttcagtttcgattcgataaaatttgactaactaaacttaagataagcatagttacgcattagagtattaactctcaaacttttaaaaaagaattcttcctttgcttgttaattttctttctttcttttttttttttttgagatagggtcttgctgtcgtccaggccgaagtgcagtgacgtcatcatagttcactgcagcctctacctccccggctcaagtaatcctcctgcctcagccttctgagtatctgggactacaggcatgagccaccatgcccagccttttcttttcttttctttcttttctttctctctctgtctctctttctttcttttttcctccctttcttctttttttttgatggagtcttgcactatcgccaggctggaatgcagtggtgcgatcttggctcactgcaacctccgcctccgggttcaagcaattctcctgcctcagcctcctgagtagctgagactacaggtgtgtgccaccacgccagctaatttttttatttttctagagacggggttttaccatgttggccaggatggtcttgatctcctgacctcattctccacctgcctaggcctcccgaagtgctgggattacaggcatgagccaccgtacctggccctttctttctttttatcaagacaacaacatgtctttatagtgctcccaaggctaaagtataccttacgtctatgtaaacactcaacctgagctttgcaatggcccatgttggcagtagtgcaaacaaaaacaattatgaaacccattttcctttgacaaagagaaataagtggcaagaattggttctttctcttagtatgggtctctgaaaagaaccagatcagtcaaaaggggaatatttttctgaagggataggtttggcctagtggcttctacctcttttagatgactgctgtttctcgttttaatgttaaatagacactaataggagaaatcacattaattcagtcaacaaacatttactgagcacttcctgtagtcaggccctctgttaacttctgggaatacaatgacaactctgacaatcccaacccaaggagccaacaagtccgggaatagagacagacaagaaaacagacaattacaactctaccgttagaataaaggtacattgagaacttgcaacaaatattcctcatcccttatcttaattattcataacatgtttaccaccaataagaatagcaataacaataaatgcccaactcagacagcaatgtccatttaccctgtgtttacacagcataatacaagcaagctgtggacagagattctcttgtttagtcctcacaactctgcaaggtgggttttattactctccatttctagataaaggatctcacctaatattacatgggccagtggtcttccagttggggtatgcacaaccctaggggtaggagaggaccctgcctggggtcttcaggtggggaccatcaacctccatttgtactcttttctgaacattggtctgagacagaaagtccctgcaattaaggcattaagctggctctttttctatttctcatttcataattgcccttctcctgctttaccaaaatctttcaccccccatcatatatatatatccccatacatattctatatatacataccctacatatgcatgcacacacatcatatatatgtatgcatatatgatatatacatatatgctatgtaaacatatatagtgtgtatatacatgtgtgtatgtgtatatgtgtgtatatgtgtatatatacacgtgtgtgtgtacatatatacatcatatatgtgtgtctatatatgtatatatgggtgtgtctatatatgtgtatatgtacgcaaatacgtatatgtgatgtatatatataagatgtgtgtgtgtatatatatgtgtttgcatgtgtgtgtgtatatatatatagtatatacatattttttgagacagcatctcactctgtcgcccaggctgaagttcggtggctgatgacagctcactgcagcctcccggctcaagtgattcttccacctcagcttcctgaatggctgggactagaggcgtgtgtcaccacacccagttagttattttatttttcgtagagatggtggtctcactgtattgcccaggctggtctcgaactcctgggctcaagcgcttttccacctcggcttcccaaattgctgggattacaggtgtgagccactgcaccggcccatcctttattttaatattatgcagtgccctgagacatataaaaaacccaccttcccaagtaaaggaaattcaagctgatgcctgcagagccttctttaacaaaggctctgaaataccctctctcattaaaatgatactttccaataaaattttgtttaacaatgatttacaaaatgataaaatttatttattttgattgtgtatggatcatggtaacaataaaaagacttgtaaaaataactaaattgaaagaatcttgaacatttagagccttaagactgtaggaattgaagaccacagaattattaatttatattaatatttttgttgcagagacataatgaatgatcaacgaaaggcttttaagcgttaaaaatatattacactagataaaattatttgcgggaatgggatggaaatacattttcaagagagaaaggagcaatgtaaaatgaagatgtaaaatccttctgctggttgtccttggggttttcttttaaagaaaagcttggcagtgtttttctttttttccattggatgatggtgaatatcaaatcactttggtgctaatatttcatttaatacattaattttaaaattttctgtagaggtgggatctcactatgttgtccaggctggtttcaaactcctggcctcaagcaatctccctgcctcagcctcccacagtgctgggattacaggtgtgagccactgcatccggccccatttaatacatttaaaagagtggtgtaacaatttttatttaaaatgtcatatttacaatattctagaatgtatatcttttcaactcattaaacctaaacatccttgtaaaaagtgtgaaaagttatatagtttttcaaaattcgattagcagttacataagcataaatgtttaaagtatgtatggtacagccaggcttcagttccctgtcttaaacacaaagatccatatcaattccagatactgcaatggtttgctgtttttcctgcttcccccatctccaaataaactaaagcatcaacatgcctcacctcacataaccctaagttttcagcagttggcagttacacctggaaaccatttttctaaaataaacaacaactgtttgcttacggatcaaaatgcaaaggaccataacatttagcctcaccttcctactacagatcgagtttaaaagtgccatggtatagctaaattatgaagaaagatatgaatataactgcaaaagtggaaggagatttgggataattcttgcccattttgttaggccaaatgcatctttgtgcaaattagaaaaaggtggtcttcatcccttcactcctatccttttgggggtggaggggcagtggctaaagtacagactaggtttcagctaccacatcctccttcagttagctgccctcggcgtgacagaaacatgtgcaaacagccctgtgcctttgtcttatgttccagccagccaagaaaaatagttgtaaaagagcagctgctgtttggggtaatgaccttggaccctccccaatttgttccaagcctgtttttgtattcatttttcccacatttatgttcctggatggaagcttccatatctgctcttggccctatttgaaattccccagatttccttcctggctcctggcctttggtttttcatgtggctcctgatcccacacgctccctgaatttggattctcctgtcatttcaggtgcgaggtttcccactacagcctcttgggcctcacctccaatacctctttcccatcagaacagcccggaccttcccctatggtagagcagagacagaatttaaatgaattctcaagaagtgcttggactcatatctagcaaaattacatggcatttaacctttgacacaaaaaatgcagcttctaggaatctatctaaagatacactgtggcaaatatacaaaaagaagcattatttatcaagcactatttcctaataaaataattcttaggtcaggcgcaatggctcaggcctgtaatcccagcaccctgggaggctgaggaaggcagatggcttgagctctggagttcaggaccagcgtgggtaacatgacaaaaccccatctctaacaaaaatacaaaaattagccgggcatggtggcatgcacctgtagtcccagctactcgagaggctgaggtgggaggatcgcttgagcctgggaggcacaggttgcagtgagccaagatcgcaccactgcactccagcctgggtgacagagtgagaccctgtcaaagaaagagagagagagagagaaaggaaagaaaggaagaaaggaagaaagagaaagagaaagaaagagaaaaagaaagaaagaaggaaagaaagaaagaaaaaagaaagaaaaagaaagagaaaggagaaaaagaattcttactaataaatgcaggagaaatgatagaattgaaatatcaccattttcaattcctaatgaaataacgtatctaggcaatgaccatcaatagctagatgctaaaatcatctgatcaaacactgatgggaacttcgtaacagatggatcaggctaacaacatctgaaaccactaactggttttgatgtcataaaaagaaaaacaaccagatattttctgtctcctgatgagttgcaattggagctacatatcacctgtaaagtcttctggccaaaaaattaagcccagccggaccttattaaacctttaaatctaacaattagttttgaagcttttacagattaaatgaagtctgagatttgcttcaaaatgaaccagtggtggggaggaagtgggtgaggtgtaggtgaaacaagattggccasgtcgataattgctggagctgggcgatgaaagcacaggtatttatcacaccatctctctacttttgtgtgtttttttgtttgtttttggttttggttttaaggagcagagagtctaataggcaagaaagaaaagagaaggctgaaggaagacgctcccccgtacagagacagagggagggggctccaaagccgaaagaggaggtcctcttgtgtatgttttaaaatactcccagataaaatatttttggaagagtacttggttggattcaacagcttttttttaatttaaaaaaatcacctcaatttttttgcttgctctaacgtgccatagaaattcctgaggttttacttgttgctttacaatgaactgtgtaaacacaagctggaagagatcagctatgcgctggaagggttggttaaatattgagactgccttgctgagggaagccttttaatgaatctcagtaattttgcaagagaaaagataacaatgaacactacattaaacatcattcttttgcactttgctaaatatgtgtatgtaaattactgtctgactgttactggatatatacagcatatacatatgcactttttttactgttttttttttttttttttttttttttttttacagagcttgctctgtcacctaggctggagggcagtggcgcagtctcagctcactgcaatctccgcctcccaggttcaagcgattctcctgtctcagcctccaaagtagctgggactacaggcgcctgccaccgctcctggctaatttttgtatttttagtagagacagggtttcactatgttgtccaggctggtctcgaactcctgacctcgtgatccatctgcctcggcctcccaaagtgctgggattacaggcataagccaccgcgcccggcccatgtatactatttatacatttttagtatcattttgbctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggaggtaagcctggtgaatcagatcatagggggtctggagggtgaaaaaaaagagtttggtgctcatggatggggctagtattggggtgtaggggagattaggtcaaagcaagaggattcaaaggagaaatgaattccyttagattggggaagataatcggaagaggtaraagacaccgtccatgacacttcctggggaagcagatgtatgtataaggatgtgagtattgtggttttgtaaagaatgcattcctgaagatgttgcataatttaaaacctacatattttgattaattttctcatgagaatagcagggtatgtgttctcggcgctcacaaatgtataatccattgtggcaaatttttgctttcacatatttttttttatcattattgtcacaggttctgtgrcggagttctggtttctaaattcacagcataccaaggcagttctttaaagttcttgatactcttttatcatatctaacttgtattccaaaattattgagttggagcacattttcccagcacttagcaccgctatttcatggatggttggagagggggtccaaaaattttacaatyatgttaacaaaagtracacagcaacaaaacaataagcaaaatcactgccagagtattccttagcttgaaacaatacggttcacgtcgatagaatatggcatctatttctgtttaatcagttaaccctgctaagtagcaagagcttacaattcatgtctaaaatcatgatttttttactagttttttaaaaaatgtgggctctatatatataatttaacattttgcttgtaagacttaattttgcctgggtatggtggctcatgcctgtaatcctagcacttcaggaggttgaggcaggaggactgcttgarcccaggagttcaagaccagcctgggcaacacagtgggaccccatcactaccaaaaaaaaaaaaaattagtcaggcatggtggtgtgcacttgtagtcccagctacttgggaggctgaggtgggaggatcacttgagcccaggaggtcactgctgcagtgagccattattgtaccacaacactccagcctgggtaatagagtgagactctgtctcaaaaaaaaaaaaagactatttctaaatgtgtggctatattataccatataaatgtggcttcttgggcaaggaaagaggacaatatagatgaaaaagaaattgatcctaccagaagtgatccttttatctgcataactctcaggcagttgtggcaaataattgscartatctattgttctgaaactggttttcgcaacttttattgggaacaccatcccctctcctgcatgatcagtttctcctctccacggatcattcacatgagtaaagtcagtagcgtgctggtaaatgtttaagatcttgttctttgggggaaaaagttcctaagttctagcagttgccctggataacttcaaggtatcaacatggaagttatgtacaaaaatggctgtcacaagccagtatgagctaacaccaacatactacccagtgttcttcaaacttcagctcacagcccattagtggggcttgcaaacattttagtggactataagcagcatttttttaaaatgaaaaagtagattgttttacacataacaggagtattgttttgtacaatttttttttttttttttttttttttttagacacagtttcactctgttgcccaggctggagtacagtggtacaatctcagctcactgcaacctcggccttctgggttcaagcgattctcatgcctcagcctcccgagtagctgaaattacaggcatgcgccacaaggcccagctaattattgtatttttagtagaaacagggtttcaccatattggccaggctggtctcaaactcctgacctcaagtgatccacctgcctcggcttcccaaagtgctsggattacaggagtgagccaacgtgcctggtcaaaatttttgttttcgtaattttaagtatgtgtgtagtaagtctcaatggaaatgtaattcttatggcaggtcacttgaaaaaaaagaagtctaaaagtcaccaatgtagtatcttctctttaaaaaaaaaaaaaaacaacaggagaaaacctgaatctgccctttgctccactccttcctcagctataatgctgcttctccattcctcctcacagcaaacctttctgaaatctttatagtcatggtttccaccagttcttcacctcccatttctcaacacacttcagagtcagagtcagcaatgacatccatgttcctaagcccattgcttacttccgtcctccttggcctctcagcacacttggcacacaggctgtttctctttctttggcatctgtgacaccactctcagcaaattcccctggttgtcccttctcagtctcatttattggcgttgtcttatctccccagggctgtccgaggtgattttctcccactrctctcctaggtggtgccatccaatctcatgatgtcatatcattcttccctcatgcttcagccatactggttggtggcctttgtttcctgaacacatttaatgcattctcaagaccctcagggactttgcagcagctgctcgctaaggctggaatgctcttccccaccatcttcatatggctgtttcctttctttcactcaccagcagcttaaactttgactcctctgagagactttccttgtcacccaactaaggttgccactcaggtgctcccaatttaatcttctctaaaacacatcactgtatgtgtcctcaactagagtataagcttcctcgaaacaagaacaatcaaaactccttgccctcatggagtttatagtcttatgatgggtgaagtaacataaaataaaaaggcaccttatatagtatattagcatgacaaatgttagccagaaataaagcaaggaagagttgctagggagtgtgtatgagtgtgttttgggagagtgtttgcaattttaaatattggtggtcaggaagggccccactgagaactgacatttgagtagacttgaaaagggaaaaggaaatattgagtaaagattttaggatgggagtgtgacaggcctgctaggagaatagcaaagtcgctgtggctgctgcagaaaaagtgagaaggaaagtagtaggagatgaaatcacagtgtgtgaggattcgggcagatcaggaagtgctcgtgtaagaactggatctttactcaaagaatgagcaaaaattagtagacggttggccggatgcagtggctcacacctgcaatcccaggttacaggaggccgaggcgggcggatcacttgaggtcaggagttcaagactagcctgggcaacatggtgaaacctcatctctactaaaaatacaaaacttagctgggcatggtggcgcgcacctgtagtcccagctactcaggaggctgaggcacatgaatcacttgaacacggtaggcagaggctgcagtgagctgagaatgtaacactgtactccactccaacctgggcaacagagtgagactgcctcaaaaaaaaaaaaaagtaggttttagtaagggattaacatgatctgaattatgttttgtcatgacttctctggctgttgtgttgagactacattgcagaggggcaagggcaaatatagggagaccgattaggatactgcagtaataatgtaagagatgtgggactctatctagaagggcccatgaggtcctttgcatgctagtattctttactgctgtgcctggccatgataggcattcagtgaatatttgcttatttaaaataacacactgggctaattgaacaacagtgccaaatgagggagatatttctaggaataagttcttaggatttatgaacattttaatccagattttctttgttaactctgctctctggccctttcactcagccccgtttgcacctaaatatgacttacaaaagaaacacagcatttatgtgtacttatttcaacttaytttagctttgtaaagaagtrcaaggttgactcagggcccagcttggtgtctcatgcctgtaatttcagcattgtgggaggccaaggcaggaagatattgtgagcccaggagtttgagaccagccygggcaacacagtggaccctgtctctacaaaaaaaaawttttaaattagctgggcatagtggtgtgcgtctatagtcccagctactcctggggctgaggtgggaggatcacttgagggaaaccctgtctcaaagtggcggggctggggggagactcaggcagaattgtgaagatattcaattgctcctgactttatcaataatctaacatttcaacctaacattgatatctattttatgcaaagcattacactatgcactggagactgtataagacaagttccttttctcaaactacagtcgagttggatagataaaacacacaacacataccaaaagacarctataaatccaaggcagtgtatgtcaagggtaaattcacctattcagattggatcttgagaagtgcatcagrcttggaaaatgggtaaggaggagagaaaagcaacagtgaatcagaacatgagttcccagttatgggacttgtaatgaattcctcaattaaaacaaaaaataatgaaaacaaaagccagggaggagaaagcccacgttaatgacactaaaatatatctttccaaacaaatgtggataaaagccaagtagagaagatgagaactttgaggtccctaacasaaaataaacagtaagcagccagccattccaagtggctgacatgactttgtttaactttatttgtatttctggctggtgtgtttacagccaataggtcaaactatcagtcagtgtagggccctgagaagtcgggtatttaagagcatctaataggcacagaattgtgctccatactgcttaaactgttccctaagtgtccaatttggagaaaacacccacacgcaggataacyggcgagtgacgcggagtggctgcgagtccaagttatcactaacggatggggagcttgggctgggcacagtccagcgtactgaacccttcccccaccgtttcacctgcatacagaggtgtgtactgtcaaaaagcagcgcctccaagtctcttctggcactgtctggacttggatccgaggcagacgaggaagctgagaaaaccctggcgttgaccccgtggacctgggcgccccgggaaggccrgcgcttggtccaggcaggcggggcctgtgcggtgaccaccctggtcctgaaaagtcccagccccgagcgccctccctcctagacctggaggcctggaacagccaggtggacgtcggcccacctttcttttctttccttcccattttcctaccacctcccaccccactccgccttccgggcaaaggcagccagatccacccaggacacattctttgtccttatccctctgtgctcgtcccacagcaagccagtcgcggtccaaggctccagaggctgtgcaggaggccgagctgggtggcgatcagcggcgggtccctgtccaaaayccagcagagccgccagggacgccccagacacagaaggcggggcgcggggagggtggggagaccacagcagtgaggcgcgcgagcygggaagtgaacgaggactgactcctgtcgcttcccgtagccgcccacggacgccagagccgggaaccctgacggcacttagctgctgacaaacaacctgctccgtggagcgcctgaaacaccagtctttgggtgagtcgcgcgacccccggcctcgggtggcggggcagtcgctagaggcgtggctgctctgagggtctcgccagtggaggatggcattcggatgtcacggctcctaaatcaccatttgatgggtgggacagtgtccagtccaccccgacccgccggtcctcaccgcggcagagccggggctgggtggcggggacgctgcctctgcaggcgaggcrctccggggcataagggattatcaggagtcgcggcctttcttggacatccctggctggggtcaggctgtttgccctggggtgtctcctcgctgcaaacccaccccacctgggctgctttctcacctgttccctcctagcctgaggccgagcgccacctccaagtggaggaatctggggaagtttccttcccggaatttgtagtgacrgtggagtgacctccattgcgttccctgcctctaacacgctctttaggatgccgagtcatttgactgcagtgttaaacattgcaaagcgcaagtcatgtgacttcctttgaccgtacgtgaaacttaagtgatggctgcttgtgatgcatacgaagtgttcatgctggcgggacctgtccctggggatacttcgggggttgcgtgatttaatgcaagcagatggcttaaattgggtcactggcttgttattatacatgtgtatggcaactcggcatccattctttttgctcttgttcttacttcctgaattgagtcacggagccagagttttgaggttttgactaacgaattaagttaatgacatggggctatatttaggtggtaaaccaagaggkatacagttttttttcttaataaagaaaaagtgatagatttgatcggtgtgtattgttggtgtgcagtataatgacagaattgctggaagtaaaatacaggaagctctggtttcatttcccctttagttctgcttaaagtcgagtttttcctggagctattaaatgtagtgtagtgtccatgagtgcttttatcttaaaaaatgtggctgatgctttccaacactcccctgccctgtgattattatttttttaagcaacagagaaaacygtatcttaatagtattaaaagtattggatttttccctactttgatttgtttaaattggaggaggaagagcaattctttctattcacaataataatagctaacatagcgcttactctttcgctgttttattaactcaatcctcagaacaaaccaatgatgtgaatactgtaattctcattttatggaaatgaaaatytaaatgaatacctctgrtaattgtacgggactgtttgattagtatttaccattaattaattaaattttttttttttttgagatggagtctcgttctgttgcccaggctggagtgcagtggcacaatctcggctcacttcaacctccgtctcccaggttcaagcaattstcctgtctcagcctcctgagtagctgggactacaggtgcatgccactacgtctggctaatttttgtatttttagtagggatgggatttcaccatattgstcaggctggtctcyaactcctgaacctcaggtgatccacccgccttggcctcccaaagtgctgggattacaggtgtgrgccaccatgcctggcctattttagtatttttaataataaattccatgttagaaattttctactgatgtattttttaagtcaatatttcctacactcacaatccaaaattatttagtatatgagcacactggtaagaatgggaggcagatcgttgattgtaataatattctattatttggtaaatatcagtaacataatayataatttaaattttaaaataggatatgaagaaaaatgctacatgcttacttttcttttcctctatttttactttacacagggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaactgatttctataagataactttttacctatgccaggacagatccaatagaatattaattatccattgggagacagggcaagaataaaagccagtgaacatatttaaagcacctactatgtaatagagatggtggtgggtgctgattacraaacagctcttgtcctctagtggaggaagaagtcacaatgataatatgacgtgatgaaacagtgttatgaacagggaacgtctgggtagagtggagggaatgccaacttttggtgatgggaggaggctcagctaatcataaattgtagtttttaaaggaaaatggatttcttactctacaagtttttcattttcttttttaattagagctgtccatgagaagttaatgtctcgatctttccctcagcctttcaaatactgcttggcccttgagcagggaaaatgtcaaaagccaatggggagatggagagtgtgaagtagtaagggtctcgtgcagttcaggcaggtcctagaatccctgaatgactgtaattgctggaaattgccctgtaatcctgagcagtaaagagcttgttttagttttatgtggtggtgagaatctttaggaatgtctagtttccacgtatctgaagctgaatcctgaatcgaggtctgaaaaaggacagccacttttttagtaaaccgcctagaagattcttgggcaaaaggaagggtgagaatccttaaaatgaggccctaaaccagttttgttagtgtgtgtgggttcaagtttttgtcatttactttatagctgtatttcctttttccctaagttttaatgtcattgtgtaagaatgaggtatcgctgctgtatcaagcaaagtcagttttaggagaaatagcctttcagtggtagtaagtttaaaaaagatgacttcctgaagcggaagcttgtgagacatttaagatgactttgcgcatgttagagttaaaaacatcccaaggttgtaaactgatttcctgcaaagatcttaacaacaacaacaacaacaaactaggctgcctgccacgggtgtctgaagtatcatcttggctcaagctgggagaatggataaaggttacactgttcatttctgcccttcacacagaaaagaagataattttataggtaaaattcgtgcatatcttgattctagcatactgctgattcctgtagtttctggggtcagtactctcaactattgaggtggaacaaaaataagtagacttcatttcttgaggaaggggatctggagaagtagttctgcgctagagcagaaaatgccttcagtcttgtggcatgggctggatgctgttctgaggataatgcatttccaagggagatatttttggcaaatagcttttttttctttcttttcaaaattctctgttttattatcagttctcacaaaagagtcggaaaggttagaggtagactgaactgaatggcaaaaacattttgcgctctctttacgtttcactgctgtaaaatatttatagtataaagggcctgtattgcactgaatttctctcatttgtagctagttgccctttcaatgttccaaaaaaaaaggctgtaaataacttattttatttattcaattaatttttttttttwaattttttgagatatagtttccctctggtcacccaggctggagtgaaatgatgcaatctcggcttactgcaatttctgcctcccgggttcaagcaattctagtgcctcagcctcctgagtagctgggactgcaggcacgtgctaccatgcccggctaatttttgtgtttttagtagatatggggtttcacagtgttggccagcctagtctcaaactcctgacctcaggtgatgtgcccaccttgacctccaaaagtgctgggattacaggcgtgaggcaccatgcctggccaacttagttatttaaagataatcaattagtatattttataagctagacttaggaaaackgttttcagctgggcatggtggctcacacctgtaatcccagcactttgggaggccgaggcaggtggatcacgaggtcaggagttcaagaccagcctggccaagatggcgaaactccgtctctacttaaaaatacaaaaattagccaggcgtgatggcagcctcctgtaatcccagctactcgggaggctgaggcaagagaatcacttgaacctgggaggcggaggttgcagtgagccgagatggtgccactgcactccagcctgggtgacagagcgagactccatctcaaaaaaaaaaamcccccccacacacaaaacctgttttcttgaatcatggttgttttgttactgataggttcaataagtaaatatatttattgtctgttgtattctttattaggcattataaacacaccgccactttttaatttttatttcattaatgtttccaattttttttttttttttttttaagacagaggctcgctctgtcayccaggctggagtggagtggtgcagtcttaccccactgcaacctccacctcctgggctcagccttgtaaatagctgggactacaggcatgcaccaccatgcctggctaatttttgtattttttttggtaaagacagagttttgccatgtttctcagtctggtcaagcactcctcccgcctcggcctcccaaagtgttgggattacaggcatgagccaccatgcctggcctatttctaatattttggtccacattggtgttagaccaactgtccacattaagttttcttggaaaagatgaagtaaatattgcaactggcctatgtatttttttccctatttagtatatttctttgactagttcaactgatagaattccaagacttaaaaaagtcaggctctaaggctgggtccagaggctcatgcctgtaattccagcactgtgggaggccaaggctagtggatcacttgagcccaggagttcaagaccagcttgagcaacatagtgagaccttgtctctctataaaaatacaaaaattaactggggattgtggcgcatgtctgtagtcccagctatgaggaagagtgaggtgggaggattgcttgagcccaggaggttgaggctgcagtgagctgtgagtttgacactgtgcttcattctgggtgacagagcaagaaccatgttcaaaaataaaaataaaaagtcagagtccgggtgctgcggctcatgcctgtaatcccagcactttgggaagccgaggcgagaggatcacttgaggtcaggagttcgagaccagcctgactaacacagtgaaaccccgtctctactaaaaatacaaaaattagccgggcatggtggcggtggcctgtaatcccagctacatgggaggttgaggcaggagaatcacttgaacccgggaggtggaggttgtaatgagccaagattgcacaactgcactgcatcctgggcgacagagtgatacttcatctcaaaaaaaaaaaaagaaaaaaaaagttaggcttccttttctgtttttttttttttttctttcttctctttttttttttttttttaagagatggaggcttgctctattgcccatgctggagtgcagtggtgcaatctcggctcactgccacctttgcctcctgggttctagcaattctcctgcctcagcctcccgagtagctgggactacaggcgcacaccgccacgccccgctaattgttcttttgtattttagtagagacggggtttcaccatgttggccagcctggtctcgaactcctgagctcaggcaatccgcccgcctcggcctcccaaagtgctaggattataggcgtgaaccaccgtggctggccacttacttttctttctattgaatttgaatgaataatttggaagacagtatctttacttcataccaggaatgctgccagtgaaatttcttgtttggcagttcattatctacctatatatttaattttgctattgtttatagagttcttaagatatgattaaatgctagctggttaagaaatcatttagaaatgaaacagaattggttgttactccaagttaataagttgcttgtcaacataaatcctacctggtacccagttttcttaggaaccttgcttccatgtttatccttttctgcttagtattctaagtactccttttttaccttacaatttagtcttaaaacacaacacagtcaagtctttcttttgtaacytgtgagrtaccttctagcctttgtgctgtttttcttctytttttgctgcctgccttcctgactgagagtggatttcctcactaaggctctgccctctgatttttcactctcttttcttttttggttttactagtgaaattttgtctttaatgtctctttcttttatgtctttaccgatcactcataratttttttttccatatgtatccagttccaacctttcacctaatgtgaacccccaactctcagttgctcagccagcccttcaagactaggagttcaaaaccaaacttgcatcttccttcccaaaccagctttcctcttgcagttttctgcagcaggatccttctgctgtttaacttttgcctcctcccttgtttcctagcacccaatagttggaagatagtctgtcttcaaaattttaaactacatttatgtccaaaccagtggcttttccttttaaaaaaatttaaagataatatgtgcaaatcatttttttaaaattcaaacagtatttaagagtttcagtgaaacatgmattttccttctaccctggtacttagttttactccccaagggcaatcactttttactggtttttaraaatatatccttcctgagatacttatgaatatccaaaagtgtgtgtgttgtgtatatcaccttttatatatcctgtctctttacgtgcatgcattttaccgtataaactgttttctaccctgctttttctatttgacctattttggaaatgtcattttatttagaacttcctcatttattttaacagctgcataattagcagtaaaacttatgtaagcagtcccttgtgaagggctgtgtctttttgcgattatatcyggtgctatagtgtacatccttgtgtgtgcatcttggtgtgcctgtgctacgtatttctgtaggataaatctgtaaaagtggaatcactaggtcagagggtatgrtccattttctttacttatttattttatttatttattcatttatttttgagacagagtcttgctctgtcgcccaggctggagtgcagtggcatgatcttggcttactgcaagctccgcctcccgggttcacaccattctcctgcctcagcctccggagtagctgggactacaggcgcccgccacccacgcctggctaatttttttgtatttttagtagagacggggtttcaccatgttagccaggatggtctcgatctcctgacctygtgatccacccatctcagcctcccaaagtgctgggattacaggygtgagccaccgcgcccggccccattttattayctttatttgcttggatccttcttagcttcttcaatgttaaagatattgacagttttcctcttactgaaatttataaatccattgactcccttgatattattgccctggcctgactgattcttctctctcctttctcttctcaccccatgttgaggtccccaaggtcacacccagttttgatgactcaccagcatagagttgtacttgtgcctatgatttattgcggtgaaaggatatagagcaaaattgcaaacggaaaggcacctggggtgaattccaggggaaatccagtgcaagttccaaggtcgcctcccagtggagtcacataggatgtgcttacatcctccagcaaggagttgtgacaacacttgtgaaatgtggactgccagggaagctcatcagagcctcagtgcctagggtttttactggaggctggtcacataagcaccctcacacatatcaaaaaattctggtcccccagaaggaaagcaggtgtttagcataaccatattatttgcatgaacagttcaggtacaggaaatccccgttaccagttaggttggtgggtgcccttcycaaatcccaagttcccagacaccagccaggggcctgcctcgtaaggaggcctttccaggacagcagtcaggcctgccaatgttaattcttttctgcatacctcctaattttagaaaccaccgagcctttgctgcctgacctgtcctgcttttcgatttctttatctactttgatatctttacaaatgatctttaccctgacttttaaatgtgtgctctggccattcacctagcgtgtggttctgagtctccaagtcttagcagatttgctctcagatgctctgccaacgcttcacaccaagtattacaaactaaactcgtcatcttcctcctgaaacctgtctcccaggccaggcgcggtggctcacacytgtaatcccagtactttgggaggccgaggtgggtggatcacctgaggtcaggagttcgagaccagcctggccaacttggtaaaaccccatctctacgaaaaatacaaaaaaattagccaggcgtggtggcaggcacctgtaatcccagctattcaggaggctgaggcaggagaatcgcttgaacccgggaggcggagattgcagtaagccgagatcacgccattgcactccagcctgggcaacaaaagtgaaactccatctcaagaaaaacaaaaaacaaaaaacctgttttctccccagctttgtcatgtatttagtggccttatgtagacagtttcctttgaaacatctcttggacttctctgctcttccagggccattgccacygacctggaatgtgtccttatcgtttcacgccaggcttatggcagcagtcagtcacccagatgacctcctgacctctggcttatttcacccccactggactgttgttcctaaacacttctttcgtatgtcactctaaaatctgaccctggctgtacctttctttaactactccctgactgcgtgctgagagaagatgggtcttgtcttttcctgcctctctgcttttgtaaactgccatttctacctgaagtggcaactgaaatcatatcttcttcataaactgtctttggctacctcagttagaattccttatcccattttcctgaagcatttctttgactcttctttactgctcccccacccttttttttttttctttgagactgaattttgcttgttgcccaggctggagtgcaatkgcccgatctcggctcattgcaacctccgcctcctgggttcaagtgattctcctgcctcagcctcctgagtagctgggattacagtcatgtgccaccatgcccrgctaattttgtatttttagtagagayggggtttctccacgttggtcaggctggtcttcaactcccaacctcaagtgatctgcccaccttcgcctcccaaaatgctgggattacaggtgttagccactgcgccygacccccattttttttttttaaagatgttgaattggtcagggtttgtagttacaagcaacagaagccaactctttaagcagaaaaggaatttgctaaatgatagtgcagagttctcagaatctctagcaggatgaagaaccaggcttggagaataggtagccacagatacacaagcatactgtaggacggttcccatgaagaggcatctgttgtcaccactggacacagatggtactgtgtctctgctactctaccaatgccactgctgtctctgaccccagatgyagctccctctgaccctggatgcagctccctctgaccctcgatatagctgcccctgaccccggatgtagctgccyytgaccccagatgtagctttctccaaacccagatatagcggctgcccccttgccagagtgaatactgcgtcattgtggcttcttcttgtcactggttcttacttaaaagctgagctggaagttctaatgggcagttttgtcacctgctcttaccttgttgcagtctagatgaggtctaatgttcataagctaggggattttcagatatggaaagggataccaattttcarcagccamatagagtatcacattttcactcyatgtttcctgggtgtctgttatgtttcctgggtgtctgactcttaggcttctttcaagctgcagtctgcctaatagagagccttgcatttaatcatcaaaaaggcaaagcaatatkaatcagcaagggtgttttggsaaataacagcaaacctgactgtggcgtaagcttgtggtattgtctccagtgtgatcagatctgtattttaattttttaaatgtaaattaataatgatctgtgaatcaccaaagtagcttggagtagcctagaaaacaatgtatgtcctccgttttcacagaagccacatagtcgtgggttaaatgagtcagcggcagggcactgtgtctcatagttaaaaaaaaaaaaaagtattactgaagyaatgcaggatcttttctgaagtagaaggcatgatgaacccagaaaactaaagcagcaagtggccaccgttcttagcatagttgtttctcaaactggaacaacctataaacagttgtgaacaaggtattagaagtgatgggggccgggtgcggtagcttctcccaaagctcattacctcccaaagcaaccccagtactttgggaggatcactttgagcccaggagttccagaccagcccggccaacatggcaaaaccccatctctctaaaastacaaaaaattagctgggcatggtggcacatgcctgtagtcccagctacttggatggctgaggcaggagaatcgcttgaacccgggaggcagaggttgcagtgagctgagatcacgccactgcactctagcctgggggacagagtgagactctgtctcaaaaaaaaaaaaaaaaaaaaaaaagtgatgggaatagattgttttgtctcaaaaagctctttccaacactaaaatgaaacatataattaaaaatatttttctggctataraaatatcgatgcttattatagacatctgcaaagtatgaaaatatatgaagaaaaaaattaaaatsccatcatcccccatgaaaactattgttatcatttttgtctgatttctttagtgtttctctttttctttttttaatttttaatttttttgagtatgtagtakgtatatctatttatggggtatatggcatattttgatacaggatacagtgtgtattagcaaggttttctttttaatgtttatatttatttagttgagatcatactatatatggctctatagattactttctcacttatattactaacwtgtgttattaaatattctgcataaagataattttaagatgaaatttgatgttataaaaacttctcattttattaagagattaacgctatgaaacctgctgctatatattcttggaaccagctgtgacccaaaagatcaatgtagggatgtaggtccttccccattctctacacacaaaatcagatactctgatgtgcagctgtagccccagtctacactgtctgttgtattttttgttttctggtgtcaygtgcctcccaccctgctcctagcaattgccatgacaacaaatagataattggcttccgtaatttctcatcttattgcctaaggcaacagagagcttgtgggctcagcttgcggttcagcagctgctttgttgcctctcctctgtatgtgtgaggcctgccagagcccactttccagacaggtgagagttcattcattcaccatgcagttaccgatcgtctcttgacctgtgtcctggggaggtaaaggtgaygagccagttctgccccatgcagctcacagtctaggcaaagctacatgcaaacaaacagaatccaaagtgctatcatgaaccctctgagaggggctgactcagcagcccagggagcttgaagaaggctccacagaggaggctgtgcctsaaggcgatttcggtttaggagccaccaatttataaccacttttstgtggcccgtcttattttatttcttatttcttgacaatcagaagtaccttgggtaggttttaccatgcacatcgtaatttgagtgagcttagtgtgaggcttaacggtgtgtgggctgtacatcctggtcagatgctcyagatggaggcagatggttgtgatgcaggagaggcagccacatagcacaggtccccagccagtggactgggaagacagtgtagtcatctctggggaaggggaatgacaagatctggcagtgtggcaggtcccasaaaaaaagggctgggttctgggcagtgagggtgcaggttgagacctgaatactgggtggagccagctgtcagagtccacgcctgcagactggactggtccacggcaggtggatgccatgtcttgaagacccacaggcacccactcatcctcatgatcatgcagttctctggtttctaacagtgcagtctgggttgcagtctgggagtccagcagagaagagcaggccctggaatcccaggtgtgggggcgtggcttaacgtggagtttccttcagaggcagtgagtgcttgtcattgtctccgtcagcattggctttgggcctagtgtggcctcgaaccttctgttgggatcagcagtggaacagtaggaaaaggaatgagtagacatggcattgcaacaagtctttttttttttttcygktagaattatcatattaagcagaagttttgcttcacaaactctcagccaaatacaaaatactatgaatagtatttaccttgtgtctctttccaaagaactcatagtggtttgcagctattgcagatatcctggccatgmggtatgcrgttcctttttttttttttgagacggagccttgctctgtcgcccaggctggagcatagtggcgcgatctcggctcactgcaagctccgcctcccgggttcgtgccattctcctgcctcagcctcccgagtagctgggactacaggcgcccaccaccacacccggctaatttttgtatttttagtagagacggggtttcaccgtgttagccaggatggtctcgatctsctgacctcgtgatcctccrgcctcggcctcccaaagtgctgggattacaggcgtgagccaccgcgcccggccgcagttcctttttmtagctgtttgaataggaaagatgacttggaaaatgctggattctgagatttatgtgcagccttaaaaagtgtagtttttctctatcaataatgagtgtgggttgtaattgcttagtaagtaattttgtttatgtaaacrtacatttgttaaattttttttcttaggtaatcccgtwtgttggcaccattccygatcagctggatcctggaactttgattgtgataygtgggcatgttcctagtgacgcagacaggtaaaatcactgtgctaaaggaaggagcatgaataggctgtctttttgtgattgtggaatgataacagagtaaggcgggagagaccatttgatactytgaggcccaattagctttcatcagcagccctggccaaggtgctgaggagattggaatgaatgactaaataaaggttattgggatttatttcattgctgtaagtctgatttcagtataaaaaattagaactatcagctggatgtggtgacttamacatacttttccagcactttgggaggccaaggcrggaggattgtttgaggccaggagttygagaccagcctgggcaacatagtgagaccccccatctgtaaaaaaaaaaaaaawttaaaaattaactggcttggtggtgtgcgcctgtagttgtagctactcagggggctgaggtaggaggattccttgagcccaggagtttgaggttgcagtgagctgtgatsgagccactgcactatagcctgggtgacaaaaaaaaaaaagaaaaagaaaaagaattaggtatgtcattaaagaaaggaattgtggtcagatgacagggacagtctagttttagtctgacattcccacagcattacagatctagttcagatggttttactgaatacctgctttggatacaagctgtggtatcattagtgttgggctcagctctgtgtacctaacacctgaagagcagtggtttaagatgtgaaaattaagtctcaaggagacagcccaggccttttcagttaactccttcaagtcgttagagaagtagactccttcgagctcaccactctgttatcttgagggtgaggtaaggtcccctttcccgttttccttggcagccagatttccagccctcacttctgtgctttgggtagctggatgggtgcatgtggtgtttgcggggaaacagagctggacaaaaggcaagtgcttgctgacttytaaggcagtttcyagtagccttccctgagcacttcacttccatcttaycagcagagctttagctgcacaggcaggcctagctgcgagggaggctgggaaaggtaggtttttattctgggcagattcagacccagttcaaactcaggggctattttactgaggaagacagaaaagattagacagtcagctctttaggcctcatagtgaatgaatgaggagggattggtcagtcccttgtcactgggcctggagtgtagtgcctgctggkcctttactggtggctttcctttctgagcactcatgrggcccctgtgtcttccctcatatagattccaggtggatctgcagaatggcagcagyrtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctraaggacaaattccaggtaggttttggagagggacaggttgagtcctcattagtgagcaggagtgcacaggggkgcytttcacatttgtgagcccagccttrtatttcctacacctgagatatagtttgtttggctttgtagtytttctccataaaaggaccaggaaggcacctaaatgtgaggtatggcaccactactctccagccagttgttgccatgcagaaatatggtccactgtgaccagatctttttattagatcctatttctcctagcagggctgagttccgaattgacacagtattatgttcatgatgggagggtaagttataatataaccgccaccacccgaagagctaacaagggcaatcccagcgaagaaatcagaagggttttgtaaattcaagtcttgccacaagacagttccgtaggatcatgagattttagacccagaggagatcctagaaatccttgatgtcagttccatctctggcttcatggagtgtcttgtacctagcgtgtatgtgtacggttgaatttggtcccagaagcttacacctgctggccctctggcctgtggagcttgcccacagtagaggtatgtaccaacgcgagagaagactcgaatgcctctggcrcagatcctttctgatcttcgggatactgctcctgcccgaaagtctttctgaatctcccaaactccattcacctctcccttctctggccttttgagcccgtgtctgtatcattyttyttcacagtttttaacagttgtgctttggctttaygtgtttattttgcctccacaatgggatttwaagctccytgagtcagagactatattgtatgctgctcgcgttttctgcctataacctaacgtggtacctggcatttgagagggagggaggaggagcctcgtagcgtgccgaggacctgcagaagctactttctcgtcatcttactgtagtctgttgaggtagagaytgttcctacttcagaataagaaaaccgaattcaaatatgttgggtaacttgtccatattaatttatttagcaaatacaacagattttgagtgtctgccacatgggtggtctccagggacagtgttgtggggagctcgcaggcagatctttaacctgggttcacaatctccagggcacctgtgcctgggcttccaggcgaccttcgaacccagatgtctcacatgtatgcagaggcgcacacaagcacacgcacatatacttatgactgcctgtttgtctggggagagacagttcctggtgcttaatcaaatcaggaactcaaaagaagttyggaagcactgctrgtgttttgggtgctttcggttaccatttggtcaygtgtgtggagacctgtgggaacaggtataaaaytggacgcaaggaaacatttaaatttggataataagttaatttattaactgtttttttttggtggcggggggggctctgtcttctgtatctctctaggtggctgtaaatggaaaacatactctgctctatggccacaggatcggcccagagaaaatagacactctgggcatttatggcaaagtgaatattcactcaattggttttagcttcagctcggtgagtgaccttccacagcttggggtcttttatgaggatggtttctgatgagatggtagaaaaaatcttcaaataacacttctattgacataaaaaggacgtatctccctgactgtagtattaattttttggaagtgaactgttcacactagcagaaggctgtttatcagccagggcttcattgtctgtaggatctcaaacctagtgtggttttaataaaacacacacagtttttagctgggtagcagctatttcctttgcatgggcataaaatggagtatttctgtaagacaggttcctaggctgggagtgyctgagtcaaagagcacagtcatgtgttgcataaggacagttcagtcaaagatgaaccrcatatacaaccgtggtcccataagattgtcatatactgtatttttaccataccttttctatgtttaggtaagtttatatgcacaaatacttaccatcctgctctggttgcctacagtatttggtacagtgcctgctgtacagattcactggccaggagctataggccacaccctacagcctaggtgtgtagttggcagtaccatctaaggttgttaagtaatattctgtgatgtttgcacgatgacaaaagtcatgtaaggacacatttctcagaacatacccccttcgttaagcaacacatgactgtctttgcattgaaaattttgatagatactaactcgcccttcacaagggtaaaaacagtttgcactctcaacagccatgctcccaccttcttgytgacattacatcttattctctgtaatgtttgccaatctgatggggggcggaaaggaccmcagtgtcaagtrtatttttggatcatagttttcaagcatatttttagtaccatttataatttttttatatgtcaatataaaatatwtagaaaatattttctactggatgttacaaattaatctttattatcttttctcaggacttacaaagtacccaagcatctagtctggaactgacagagataagtagagaaaatgtaaatattaaatcttttaatgagccactggtttaaaaatgttgttttagctgccatgttaatgaaatggcaagaaggctgggtttttgaaaattatgcttttagaacgcaagtaatcacttgaaaattgagatacatacttgtggtgccaggcacgcagtaagtttttgctgatgattcacctgtcagtttctgtaactgccactcactgttcttatgtaaaaagcactctctcactcttaactgctgaatagtactgttctggggtatttccaaatattgaacatcagccagtgcactggcaaatgaacttccatgtgtatcttcaacccctgggagaataactgcaatttaaaaatgcgctgttattaatggagaaagtgaggtcttaccgactggcacgttcacacctcacagacagaayagaatcttagcattctgggggcaccctggaaaggacaactaagacacgtttgaagttcatgtagtgctgggtgaaggtggtggctcaggcctgtagtcccagcgctttggctgaggtggggggattgcttgagcctaggagtttgagatcagcctgggccacatagggagaaccccatctctacaaaaaattaaaaaattatctgggcatggtggcgcatggctgtgatcccagctttgggtggctgaagtaggcggatgacttgagcccaggaggttgaggctgcagtgagccatgattgagccactgcatcccagtgtggatgacagagtaagaccctgtctcttaaaaaaatttcatatagttctatgaaaaattattaatttatggtggaggataaaggactcagatgaacagggatatcagactctcttctcaacccgtgtagcccttcacaacaccataccattccgtcataaagcaccagctgcctggaggtcacaccagagtggagcaggaacatcccaggctccggccaggctcagctcagcacaaccaagacttcagattataaactataattcttccccttctaacattgttgtgttttgtttcttttccaataggttccaaagtctggcacgccccagcttgtgagtatttttgcctgggttatttcatgtggaatattttataaagttgcatagaaaatgaacagtttaaaccgtggagggcagcttcattcattccattccttactgtagaactgtttccctacagcctagtaatagaggaggagrcatttctaaaatcgcacccagaactgtctacaccaagagcaaakattcractgtcaatcacacttwgacttgcaccaaaataccacctatgaactatgtgtcaaaggtttgaagagcmccaaattttcttaactctrtataaaaattaagttgtaatgagctgttacgagtaacctgtatccacaatagargcccaaagcagccccctctgcatttgtgtgccgtccctggayggattcgagagtcaaccaggcctgcctctgagccattcctgtgtatttcctcagcacctccctgcttggctgcttccccttcaggcagaacacagtactgcctcagaccccaggcacagggggcctwcctggcgtgtttcactcatacagagggcatcgggtcccaccctgtcactcatttcatcgtctaaaatgtaatcatgwgtgtttgcttcgagccagggacagtgctgctgcaggggacccagctgggaccaaggcagactgtctctcccctcstgggatttacagggtcatggctctgaaacattcygkagtgttstttggacacgagttttccctggagatcgctttctgcaggcctcttggtcctgactgtgscttcttttcagagsctgccattcgctgcaaggttgaacacccccatgggccctggacgaactgtcgtcgttaaaggagaagtgaatgcaaatgccaaaaggtcagtatccttcggtaccagtcacagtgcagatacttccgtgcctgttaccgccttcyacccgtgaacggtcctgtgagctggaagwagggctagygtcagaatcttcatttccaaagtgagatgattcaagcaggaggwggttagattgtgaacagccagtgggcagcagagccgactaaggccgtgttctgacctcggctttttctggccagacaagagagtagcatttttgtccacgaggcctatccttgccttgtagaactccagagcagccccgtaagatcaggcaacatcttttcttttttttttttgagatggagcctcactgtgtcacccaggctggagtgcagtgtcacaatcccagcacaccacaacctccgcttcctgggtgttcaagccattctcctacctcagcctctggagtagctgggattacaggcgcaccaccacgcccagctactttttgaatttttgtatttttagtagagacaggggttcaccatgttggccaggctggtctggaactcctgacctcaagtgatccgcccacttcgccctcccagtgctgggattacaggtgtgagtcrccacgcccagcccaggcaacattttttagggcccctcttgtcatgtgatttagaaaatttctgctttaacaactttttccacagacgtccagccttctgaaagcttgaaattagagctatttcctagaaagtggcatactttcaagaaggaaggaacacgggtagatgatgaaaagagaatacctgcttgagaggatcccaggctcctgcagcctgaagtagtcattcagtttagcgttaaaccttccatttctgtccaaccacatctcagcctcaaygctgattttaaagggttttttttttcgtatttttattttgcaagtaacgaattagtggaatgctgactgggtttaaaatttcaacttcacctgcattcccatgtccatgtggatacgtgtgtttcatagagttagaatcatagttcaagtctggtcactaacattgctgaaattgccactactctgtcctacttggttaattaaggtttttttttttcttyctttctcaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgaggtgaggttmcagtttttgaaaatgggacagcaataagaatcctgggagcaggggtgggataagtggtccatttaaatcaagtcctaactcagtatgtggargytgtgtatgttttttgtttacttggagattgtaatttgcccctttttataacgtgggcaatcagtataaatggcaaagccagtagagtgtcaaattatgcacattggaattgacatttgtcatcatattaaaattcctgtgtagccccatattgataggaatttaaccaggaagcttgtctcaggactggagtcacacatttaatcatataagcagacttgaggacgtggagaccctaaaactgcttgcttgcactggccatcatctcccatcagggtagacggtttcaggtggcagtcctttctcctaaggagttagtcttgtttrtatgtattcaaggaaaaatacatcagtcccttggaactaaaaggcatgcagtcctgagtccccagataggtgaatattgtaacacatacctttcccgaaatatgtttctgggatgctgagcagagaatagtctccttgtgatgyggatgccgggtgtttggccagcctcaatcaccagctcaggtgccactgcctcacacagtcacttagggtcattggtttaggttatcattctacagcattttaaactgacacattgtctggaccatgtgggttcttgaggactcatcaaaacycgttactaaaagcatgaatatcaggcgraatagatagcaatgtgacattcrtatttatccctaagttccagtctaatgcagtgccctggtatgtggagtgtagacagatgtgggctaatcatggaaggttccctgaagttgtggatattggtttsgaattcagaaagctgggaaggatgtggaaggctgaaggttggcttttctagatttagggcatgatttgaacaagtccttagaggtgggaagggcagcacagggttgttrgcttggcaagagtcaaggygcaaagggtgacttggggttcactggagggaaacagagrtgagtgctctagaaggaagttgagccttgtggtgggtgacaggaaaccaatgatgtaacttgtttttgacctatctgggccccaagtttggatctgctatattaatataaaaaaggataataatgatacattcaaataatgctgaaaaatactaagatgaaaatacctccaacttcrtaattcaaaccataccattaggattaggtgaaccacattccaggcrtttttttgcagagacagtgaaarggatggctggctgaaggaatgaatagatgaatgttatatgcttttgaacaatcgtcttttccatttaattttctaattcaggagcagtaattrtccttgtgttgatcactgctgacgattttctatactgataggtcctttccgggggcttccatctcttgccttttaaatatgcttgcattgagattatctcaggtctttccattatgccattactttcattttaaatcttcttgctctttcaaatacactttagttgtatctacagtkttttaaaaacaatctcattcagtgttgtaatttcatctgtgggctcttcctctggatgaaatccgtgttccagctgttcggcagcatcagatggttgtgagggattctgttgttctgttttcttctaggcaaaggatgtgccttcttttcatttgcagtagtctgctcacccggaagcatgtcatttctttgccacttgcttgtaattcrctggctttgcacttgctctgatacagtacaggtaactaattgactccctctgctgccaacttggttttccttctgagctatagcatcaggctgtgtgttttgtgttttcttgagattttgttaartatatctggggtcccttctacctggttggaactgggattcccaccattcttgtggggatagaatctcaggttacacctatttccccaatcctctgtagccacagaagcttcatcttggccagctgttatcagagtgcaggacttgggctgaaatttcctccccttcctgattttccttgacagtcctttccactgctccthtcaaaagaatgraaaccctcaacttgctgctttgcagattcaggttttgtgcttcwttctggcctctcgggktggggccgggtkagcagcaaggctgagctgcccctctttcttctgaagccttcatgggggcgaggagcacagggagagctcagtgcagggcctcccagtggccttctcagagtgggtggaaacccagcctggcactggcagcgtggcaccagaagtatgaagtgtaggtgtaaaggtgatgtaaaaggctagtaggttttttggtttttcrttgtttgagttttgggcatagatgactgtgaagggcgaacactgccgatggatcdatgaatttgtagtatgtgcaccacttccracttacgggatacccagctttgacggctttggacaaacacactgaggccaagatgtgctgagcttatcaggatcaggatcaccaagcagctgtaaaaaccctagcaagtgccttaagctgctgaaatttcatattaattgtctggtttgttcatggtcctagagtttgaggcagaaaagtcagtcaggatccaagtcccttggttccaggctacagctggaaacagcatctcggtgaactaaagcaaccatattaggagtgagttttcctgctttaggagagtccccagcatcggcgaggaggggcagcactctggctttccaggagcaaggggcaggatgcggccgagggagaggggctgtgttgaggaaaggagggccgcaggccctggggatggtgtgaggctccaaacatgtccgagtcacttccctgggtgggatgaggcagacagtgccaccaccagggacactttagttagattagggtcttggaagtcagaaggaagtcagcagcagcaggctggaacttttctatgtatwatcaaatggtttactctgacaccgttagcatgtaacaaacacaaaattttaaactaaggggaaccactaatggcatgtwtcctttcctttcagatgataatttaytgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattagrtcctgctgggtgttctcagtccttgccatgamgtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgargagctaggatatatacttggtgaaacaaaccagtatgttccctgttctcttgagcttcgactcttctgtgckctaytgctgcgcactgctttttctacaggcattacatcaactcctaaggggtcctctgggattagttawgcagmtattaaatcacccgaagacactaayttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatytgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatygctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaawctcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtrtgagctgttttagaagcagcgtgttgccttcatctctcccgtttcccaaaagaacaaaggataaaggtgacagtcacactcctgggttaaaaaaagcattcmagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatrtaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaamgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatctaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagactctatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctactgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacatgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccgcatgcaaactcaagtgtgtcaccagattttacttcattggcgctcgccagcccgccaggctggcaataaagtgcctccagccacctctggcaggtctcctcacccacagcccctgactggtcaccactataattgtatgaggggccaggacagtcgcttgggataaactcccatctcagcactgaataaaaaacattctgtgtcacaatatcctagttttggggctttaaaaacgtctaggtgttcctcacatgccttgtctataataaggaaagcaagcagtagttgggtattgttagcttttgaaacaaaagccctactggtcttctaattttggatattttaattaaagaatatctggacagtacaaagtgaattattaaaaaaccatttgtaactacctagattcaatcaggatttccttgatttgtgcaaagtaaaatattacaataaatttgatactgctacttgtataaaaacctatggtttaaaatgtgggggttcatcataatagtctcattgttagcatatcctaataaagaatttgaactaataaatcctattaataaaattctgctttggtctgttatagccagtaaagttctaatacaatcattagtttgagaaatggtgactcattgctaaaacagtttgaaattcgtaacacttgggtgtcaaattttgacttccactcaacctacccatgttttatttccactgccaccacttactcaacaagatcataagcctagtatctataaacaacagaatgtattgctctaactcaaaagactatagtgtggataaattcaatgcatttctctctggagcacaatgacatttcaatggcacttaaaaaagaaggaattacttcaaatctttgttatttaaaagtatttagaaagtattttagtacttctgcccaacgcaccattggggtggggatagggcattgctattctttacaaatagcctgtaagtaaaaaacaaaattttcttaggcacaaatttctgcctaatacaaaagaccggacctctagtactggatgacaaatagcaatgttcttccctgccagtttactagggggcctacatctgtgaccacctgcaggctgtttaggctatgcagtgaaaagatgcagtttcagtacttgtcacgcagttcctaaccttaggcgaggagtctctcgtctttagcagaatctggtagttcagtggtttccaaagagagtcatccgccatggccaccgaaaactgtgcgatgcatggtatcaggtgctttgtcacccgttcctggaatttctcttctcccccaagcctgttttccagctaggaagagtaagacaaagactttgaacaacaagtctcatttctttcttctgtttgaaaaaatatccaacatacaaatattttactatctttcatgatattagcaggttcaaaaaccaggcattattctaatactctctagggcaaatgtattgccttctagaactcaaatggaatctcataccctttatcatcgcccctttctctccagcagaacatctcagaggagctctttgctccagaggacagccatgctctgacgcgttctcagtgaggcccagttaaaacaaatgaatacattaaccatgacagcttatatcatgtctgtcttttgagcagtttaaaaaataaaaaataaaaaataactcagggccaggcatggtggctcacgcctgtaatcccagcagtttgggaggccaaggtgggtggatcacttgaggtcaggagttcgagaccagcctggccaacatggcaaaacctcatccctactaaaaatacaaaaattagccaggtgtggaggcgggcgcctgtgatcccagctattcgggaggctgaggcacaagaattgcttgaaaccgggaggtggaggttgcagcgagccgagattgcaccactgcactccagcctgggtgacagagcaagaccctgtctcaaaacaacaaaacaaaactcaaattccacaatgaagttatatctttgaaaaaacaattttcaaataaaacatttcattaaaaagaccagaaaaaacaaccttacaaagaaaaatcctagcaagctgtcatttgagcagatctaaaacctgccaagctcgaacagtgatggcttcctcagcaacgaaagatgattctgtttggttacctgatccaccagaggcatcatcaaggcttctgctctctctttacttataaaatgctgggtatcaaaaaggaagattttgtataaacagttcaaaataaactgcaacagcaagcagcacttttcagggtcattttcagagtcaaaaaatgcttcatctgtagacgtgggaagagtaaaaatgaaaaaacactgaacttaaccatttaatctccaatgtttacattgaaatcactattaaaataactaaatcagaagagtctaaaatgatctagaaatcataatcaggacgaaggcagaacacaatggatggtctctcgaagaatgattccttcttttagagttaagattctaacactcactctggcaagttaaattccctcaactgtcaagtgggtcacgtattagcattagagaataaactaatcttaatttttgcgttttaaagttacttccagtaactgacagtaacggccatttactttattctttctcccaagtgaggtgacttataacattcgctcatgatgctaaaacaacacttcactgtctgacaacaatgaagtaaaaaattcaccctccttagcttaggacttaagaacctctaaaatcttgcttccaagcactaggttgtgtcttactggtaccttgtataaggcacacagggcaagggtgacagctgaactgaagcgaccacccacctgttttggagatgttcacctggttcaaggtgtcagcaaaaggcttcactaagtggccggcaaacagagtaaaaagccctttcagcttttcagcaatgcaatctgccaagttgtaaaatgtcaacaacctgtcctttggggcatcttctgttttagcccaatcaaacagctgaaaggataagacagtattagtttcttcgacatcttgtcacttaaatctgagcacaaaagagaggaagaggaagaaagcgtcaccttgaagaacaggggcctgaatgtgacctcggaaagtttgacaaccatggctactagacagtcaatgatacaattttccgtttttccaacttcctccagatcgttctgaaaacagaagagcccatttattagagtgctgatacctgactgtaaattattttggcaagtaccactgttacacggctagattgttctcggactcttcaataggtggataacagctttaggatttggaggagtgaacctgagcttacctcagagtgctgggctcggaagtccagggcttccaggaaaaaggcggttagctgagactgatgggaggtgagctcttccttcttcatcaccccaatatgctcttgcaagatgctcataaacggacccatgtgattctaccaataacacaggaaagagatgtgccattttcaaatgattcctagagttcagcggtgtgtatttttaaaaactaaatcttcttctttaagtcaaagtttacacattgcagtaccacctctcccttctccaaagtcttaatacccaataagatctaaccttccagttcttctcaatctgcttgtaagtttttttgatggcgggcaacaggactcggggtgcaagtgtggtagccagtgtctttttaagagatgtgagacggatattagcctgtgacgcagaacccatttcactagtgattttctccagatgaatcacctacaggaatataaaaaaagtgatcagggccactgcagatcttcgctgacaaacacacacttacagagaggcttcatgatgaggtactagtgtttggaaaatgcttagcactttttaactacacacagaattccttttaaagtcagccctaaacgtcagtggataaaactgggcagacacctcttgcccaacttgcgatcagggacgaaggccgatggtagacgcagacgcacacacagcacccagacagatgattttcttagaggacaggaatgcaagggaccacggcaagagtcaagttgctaaaaaactgagaaagctcctcagagcacaggcccctttctctgagaaggctacttttaaaccctggctgtggtgtaagtgaagcggtttaatcatttgccccatggtaatgaaggctcctaaccttgtaaatggcaaatgatcaacacaatggaacagccaggtctcaacattcttgagcatcttcaatcataaataccactggcccctagcgtgttgacaggaaaccgctgacgtgcaatacaaaaattctgctttgcaagatgccttaggattatacctctcacagtagaaacagggcccatcaatttccacaagtaataaaaggcggctctaccagcccaactccaaagatctcacagaagaaaaaaaagccagaatacattccgcacaattaaagaagagaagcatctcgctaaaaagtgaccccca

SEQ ID NO: 1673 - DNA, 165156 bp, Homo sapiens
gacaattagtactttctttaatttgatatttagtctcagaattttatagctggaagaaacctgatagaatatcctgtgtagcccagcatactttctgtaaaatgagaaatcctcttcccaatttgtgtgtgtgtgtgtgtgtgtgtgtgtgtgtgtgttaatggcagaataaagccaggctatggacaaaggagaagggagtgatgaggatcaggtgtggcatttgcctttccaaaaaagagattgagtgacttactctaaagtaagttccccttcaaatctaaagcaattgcactatgtcaaactataaaattgcaacaatcaaatttataaatatgatagttttcatcttgatttcttcctcctggatttacagataataaatcttcctcctgagatttattaatccttcctggggaggacttaccattaaaatgtatggtcttttgcattttcaggctgctgttgcttttaccctggtggaagataatcactaaaaagtagtctctgtggattatctaatcaatatctcttcgatttcagataaaattttatactcacttgggccttaattattgtgctaatatctctaggcttcccaaatccaggagaactgtgtctgtggatctttagaaatacttggactgactagttttatgctggttctacccttagaatccagaaacaggccagaagcatatcctgttaacttgtatctatgttaagaaaacattgaaaatgtaattattcactatctgatttagaaactgatgttacaattagcatctctgtattggtagtggtaacaacaatgacaacaaattgtacccatagaatttccacagccataactaaaaccagatggcaaatactgtttttataactcccacctttaaaaaaaaaaaccaaaggaaccgtttcttgtttaatttcattctttgatagttgtaatagtaattgacaccgaggaaaaaacaatctactctaaatattctacacagtaaggattaaatttcattttctatggttttactatttagtgggcattgtgatacattctaatctacacattgcccctctacccatgccttgtcttttgtcctcagaatatcttattaatcagaactttcataaacatacacaattctttgactgtttcaagagtcaggctatattttcagctcttgtcttgtttctgtgaatatggtggcagaaatcatggatttgagggtcaactggactggtgtcaagcagtcccctaccgtttattagctgaatgagcttaggaaatcatttgtttaacctttaagtctcaattgtctcatctgtaaaatgaagaggatattatccatctcaggggattcattgttagaatcaaattaaataattgaaattaagtgtgtaacactacgcttcgacacaggtagtaaatgtacgataaatattaactaatattcacacattatctttctcttaaatgaaggaataatacatacttcccttcccttgtgtaagattttttgaagtaacttaacattacaaagcatgtctaatgaatattttaaataatggaactttcaaatatatattatgaacattttttaaaccttaacctagggtaaggtttccattcacctttcactggtttcgaagagttgatatcagttttactatcaacagtaattgaggtttatcactccccaagaggagggtcagttttttttttttttttttttttcagggtttagagctattttctggcaataacaatttctaacttctaattaccctttttccggcttgaaaatctaaagttggattgaagaagagaaatgacaacatctcccttttacttatccaagctgtgaatttaaaatacctttcgtttttgtttgtttgtgcctatcaactttgacccatagctcccagaataattttgatattttctgaataaattgacactagactttatacatcactcatgtctttatttagggtaggccactgtcctctaattccatactgattcttctgggtactctggtgagccactcaaaaaacaatttctgccaaacctttgggaaagtatcagtggtttggtggccaaattcctcatcaaatagtgcaaactggtttcctccaagctgtgacttctgcagagacagaaatgtccttgttaagtaacactgtcctcaaattttctatgtgtatcatagcctacttcctcctgaatactacctttctccaaatcaagactcaaaataatatgttttctttttaatttctatcctaaatcccatatagaaggaaggatgcaagacgtggtctccatgggagacagagtataatcaccaactaggtccaaaagaaaagcaaagtcgtgtcctgggttcctttttccaagttccgagttgtgggaagatgggttgtggcagctccgggagcagacacataggatttcctccttcctcagctctcaggagggccgctggatccaaggcaggggtcaggtatttccgagatgaagtgaactgaatagggcggctacccgaaaggcagtcctcagcattattccaggaaacatcagggcagaacctgaaagaggaaaagaagtacacagctgaaagttagggtgtgtttaacgtagtgagtggaacctcaccgcccacgtgtcatcccctccaggaaatgccatttcctcttccaggaaacaaaggtgtggagaacttctgagagcagccacgtttatataactaagagacagtgtctaatagaaaacagaaacaccccatggcctgggaaaggagatggcgggtctacaggatgctggcatcaagaatatctagaggtgtccactacacctaatggataccaagaacagatgtgaattttttgttttagatgaaattttacgataaaaaaatcccaattttgtagatatatgatggatgttgttttaaaagatctgatcttcaggttaacgggtttcctgttgtaggactatacgattataggacaattgagtagccaagagtcctcaaagatcagttgtccaaaagagaaagaaagagaaaactgagtgtacgatgtaagaatggagaattggctgggcgcagtggcttatgcctgtaatcccagcactttcggaggctgaggtgggcggatcacctgatgtcaggagttcgagaccaccctggccaacatggtgaaacccgtctctactaacaatacaaaaattaactgagcatggtggcaggcacatgcctgtaatcccagctactcaggaggctgaggcaggaagaatcacttgaatccagaaggcagaggttgcagtgagccaagattgtgccactgcactccagcctgggtgacagaacaagactccatctcaaaaaaaaaaaaaaaaaaggagaattaattattcagcagctcttgagatggtggctccagcctgacctgggtttgaatcttggttctggtactttagtaattgtgggatcttgagcgaggtacataacctttctaagccttgttagtctcttctgttaaagagagatgataatgatgatgatacatatcacatcagattatgaatattatatgagtagtgcgtctaaagtcatcacaggctgggcatggtggctcaccccgataatcccagcattttgggaagctgaggtaggagcatcacttgagcccaggagttttaaaccagcctgggcaacatagtgagaccccgtctctacaaaaaaatctttttaaatattagcttggtcatggtgatgtgtgcctgtagtcccagctatttgggaggctgaggtgagaggataacttgagtcctgggggatcaaaactgcagtgagctatgatcacgccgctgcactccatcctgggcaacacagcaagactctgtctcaaaaagaaaaaaaaaagtccttatcatacctggtgtatatatgaaactttttctaaagccactaactactgattaaattaacaggacatatgagcttcctttcagtgcctaattgtcaatgagaaacccagatatggagcgtgaggaatctaccatcttctaggcacagtagctgttatccgtttgccatttcttctttgcactgtaacaggatccgctgaaaaacaattggagaaagagccagatggatggcagtctgaactagggaagcttctgttttgtagtttgcagaaagaatctgcatggggatcactgcttaagctttgcctctttgtttccagacacagacgcactttcctgcctaatttccatagcaaatacccaatgagcgcctactgtatgccaggttctgatgatgtcagagtgagccagcacttccgaggtactggccactctcaaacctcctggctaggatcttccaagagctacagcctctggcctgagggtcagtccaatgctgttagatattgacaaatgcggggctaattttaatggaatatagttttatccttaaaaggtgtgtgtgttttggctttatttgggttcatatagattaggggcatcatcataactcgcttcctagtgcagacctgagtgatttaatcaagtcttgaaacacttcggggcctcagtttttcatctgccttcccaacctctgaggttctttttagttgacatcctacattcccatgatcagaaggctgctaattcaacttttggcttttgttaaaccttttttttttttttttttttttgaggcagagttttgctgtcacccagactgcagtgcagtggtgagatctcagctcactgcaacctcctcctcccaggttcaaacgattctcctgcctcagccttctgagtagctgggattactggcacgtgccacaacacccagctaatttttgtatttttaggagagacacgattttgccatgttggccaggctggtctcaaactcccagcctcaagcgatccacccgcctcagcctcccaaagtgctggcattacaggcatgagccaccgcacctggcctgttttgttttgttttaatcgtttttaatgtctctctcaaaacaagaaaagaaaaaaggacaaaaaattactattttacttctcagattaatctgatcttagtacactacagcaacaaaagtcttaatcaagtacgttttaattatttggtgtcatcattgcaaggaaaccattcagtaagaatattagtaaccagacatataattttctaacctgaatgagaaattagttacatggagtatagaaaaagaaaccaccccgtttatcctccctgtgaccatcattagtattacccgcaaggcataaaaagtcctaaaatgacacgcacggcggcaacattacctttgcagcttcaagcacagtaaagttgaaagcagtcccaccttggcaattgtgtataaaacgacaatgtgcagatacaggaaaagtcccaggtccgaagccacctaggaacgatgaccccaggacagaagtgtgcccaaacaaatgcctggggtaggtcattttaaaaggaacaatgtttacaagccctttctagcgtgaaaaacagagaaaagagacccagctctttccacccaatctgctggagcgccgtttcgttttcagttgggcgagagggagacatgtggcctctcgccccttttcctgactctgagaatgtggccggagccggggcgctcctgctccgcctcgccgccctcccggggctgtcctgggccctccggccgccgcctcccgctccagttcgcagctgggcgacaagtggctggtaaggaggccaggggcgggagcctgggcgcgggaccgggggcgcacggcgggggaccgagcgcgcgtccctggctagaggtgccgggtcccgggaggccgggctggcggggaggctggcgagcgccccctggcgggcaccgccttctaggcgcacccgcagtgcgccgggcccgccagccccgccagccccgccagccccgaccgccagtccccgcgcagtccccgcgcagtccccgcgcagtcccagcgccaccgggcagcagcggcgccgtgctcgctccaggtagggccccgcgccccgcgccgccgccgggagggagcgggctggaggggccgagacccgtggcgagaagggctacccaggcccctcggagagcctccgggaaggggtgagggctgccgggtgagcaggcggagtaggaaatggaaccaagcgggcgcaagagcgcaccgggaagaatttccccgctgggtttctgggacgcaggtcgcacgggatgcgggatgctggcgaccttagccgggtgggggccgccggcctgggggcgcttcctcctttcttctcccttttccttctcacctgaacgaaagggggcctgcggggagggaagaaggtggaaagtttttgtattcttggtaaaaaaaaaaaaaaaaatgcgtgaggaaacatgttttctggagrtggtatcctgtccacaggggagcataaccccttttctgggaatgtattggagcacggacgggggtgccattgctcaggcttctaaacaagccaagtttctggtcaagggcctgggggagggggaggcaggtctttgaaagataccaaaaaaaaaaaaaaagaaaaatctgcgtgctcattcctgtagcctcaagtgaggttattccccagctttgagggccaggttaaccaagcaaagtttgtgcaataaagtatctttgtggtattggattttcgagagccaccgttatcaatgggagagtgactgttgaatgctacaggcgtgtgcactcycccgtgggcatgaagagaggtccacgggctggctggattgggagactccggtcatttctgcaaggagagcgccacaggactgccttgttccctgggctgtcctgcccctgtgcgggctggaygtggtgctataaaagatgattcaggagtggcacaggctgagggggactaggctggagaaggtggagggaagagggagcactccgtgccctcttcytgtccatgggaaatgaaccatctgtgcctggtgtccaagtccttgacgttccagttgccctttgagagcacacctyaagcctgctgaattcttttaagaaccacctacaagatctgagaagtccgcccatgctttctgtcaactccggcctctttgaccttttcttttgccaaagaaaattctaaaccactgggattcgtgaggctccgtgagagaggcaagaagcctggagggtccactccgttgctcttttcccttggtttgctccctagaagccatggtccccactgggcccttcttgcccgaggctgtgtgatagacaagccctattcctaaggtcctgggtcccccaccccaccccacaccccgaccttgtgaatcatcatcttcatattttccctaacttatctttggtaacccttgtaaaatggcaggcttactgcggatgcttaatctcttttaaaagtgctgtgtctagcgggaagaagagtgacatttactaatatggttgcaaattactkttgaagtttatgcacagctgtttaaaatccctctgagatcagtgccattgtttgatgcaggtgcttaccgcagaaggctcttgttagtcccttcctcctgctgattgaacatacatatatttaaagacgtggcgtagggagagcttctaaaacctgcaaagccaaagctgcacagctcctgcaagttagcgatccactctaagtttttcwgttgttgtttctgtcttcttgcctctcatgaacttctgtttctgatttcaagagtaacctgctgggcaccatcagcctttgtttcagtgacctgcgattttcttctacactttaaaaatgtcaatatccaggcaagactcttgtcacccaccatccgcgttgtcatgttcatttccgctactgtcttgtgctgtggtgcctcgggatggcaactgttacttgaggagctaacttctacctctgttctcctacagacatgtcctcattgcgtcttcgctcaccatacacggtgcagctcctggaaatttgatttgttttgctgtctcacttctccttcaggcaacaaggggatggtgttcgattattcacacctcagctccttctgtaatctcaaagatccctttcaacaataatactctctgtctcttgttaacgccaggcatcagaagcccccttacatagccggcttgtcactggtcatttctataaagtattctcattctaacacatgctgtctcttccgtggaaaagactaaattcttctctgcaatgaattagatgttttaaccaaaattccatgtggactgggtccagaattttctttcaagagtatgggcttgtggtacaagtatgtaacttcggggattcagaagtagacctacacagacaaatctccttataacgtgttatttaattatggtatatttgcctttctggaaattaggaattagagttagtacttcctgtttttaatgcatttgattgatgtcttagagttgctgattatgttgttgcccctaaaaatgttgctaatgtgctggtttgttaacaaggttatatttgatttcaggtgatttcctttttatggagttcagtctttaatttttttcaataatttgcctcaaatcatttaaaatgatatattgttatataatgaaaatcccagcaatatagacgtgattccgtgtgtgtgtgtatgtgtgtgtgtaatctgtaatttaaaatagagaaattagtattgtgacggcatacatagcattaaactcatgcttgctgtttctgttgttttaacactttaagcagctcatttctaagcagctatgtgttcagctcagctttttcatacctattccaattgttaaggaagaagtcatgagaaactatagaaaaatgtgatgttgaaccagagagatggattaaaagctgtttccttacaatggtgaaaatatctttcattattttaacatgccaagcatttatacatgtcaaattctgattgctctgtcatctaaacacattcttggggacaaaatgagcatcagagttttaaaattaggaaagctcactcaagcccagaatcatagatttttgctcctggattaaattagcaagtatttggcaggacatctttctgcaggttgctgtaggttgatgttagcttttgaattaagctaatagtattaattataataataataatcagcatcaacaaaaccaatgaaatatggttttgagtctttattatttagaatttatgtgctgtatatcatactcagaattttatttatatgtaagaggcattactgcttcatttaacctccaaaagcctttataaattagatattattattattccagtttttcagatgaggaaactgaggctcaaggrgtagagccccttgtccaggtcttataaccagtcagtggtagagtcaggttagttggaccatccagattagtctaaccatcaagcatttgctttaaaccgcagtcccaggtgacctaccagttaacttttttattgtggttaaaatacacataacttaaaatttaacttcttaactattttctagcgtacagttcagtgacattaagtatattcacattgttttgcaaccattgccatcatccatccacaggattcttctcatctcctaaaactgaaactctgtcctcgtggaacattcgttcctcatccgtctttcctctcagcccctggcagccacccttctacttcctgtctctaagattctgactgctctagggacctcacagaagcagaatacagtatccatccttttgtaactgtcttatttcacttagcatagtgttctcaagctgtatccatgtgacagcattggacaggacttccttcctttttaagtctgaatactattccatttatggatataccacattttgcttatccttgtatctgttgatggttgcttctatcttttgattattgtgaataatgctgccgtgaagaggaacacgcagatatctgtttgaggtcctgctttcaattctttggggtatgtacccagcagtagaattgtggggtcgtagggtaattctatgtttaattttttgaggaamtgccatattgttttccacagtggctggaccgttttacattcccaccagtggtagaaagggtcccaattattccacattctcagcaacgctgtcttttgttttgtgttttttgagatggagtctcgctgtgtcgccaggctggagtgcagtggcatgatctcagctcactgcaacctctacctcccaggttcaagcaattctcctgcctcagcctcctgagtagctgggactataggcacgcgctgccacacccagctaacttttgtatttttagtagagatggggtttcaccatgttggccaagatggtctcratctcttgacctcatgatccacccaccttggcctcccaaagtgctgagattacaggcgtgagccaccgcacctgggcttttttaaaaatcttctttatagtagcctttctaattggtgtaaggtgctgatagttaactttttacccaatcattgaatgcccaatggcagggatctctgggctgatgctactcctgagttcattgtttatttcctatcccagcttgagcatatacacctttttctagtgtagaattaatggaggaaatacaactcacacagcacctgagggactagggaagccatggaaaggacagtccctaaaacataaacagaatgtcccggtaggtagggttatctccacctccatgaggaaccttatgattcagaaatgagtagttgttgagaataaagtgaacatggcatcagtgttaataaccctgaatgtgtgggacagatgctttttagaagattagttacagatataattatcttttgtatgttatcagagcaggacaagttcccaggacaatggagagaatggaaagggaaactgctattgaattcaccaggcctttgttgcaagcctcagatcacacaccgtgctgcaaaacccacagggagatgtggtcaggcaaataggaaattataatgaattgtgatgaattcatgagatatttgtactattttgtatcagtttataatgtcatgcaactctgttttatatttgctagtttcctttctgtctcttttttcctctagcatgaaactccatgagggctggcattttgtccctacatgtgtccccagccactctaacagggcctgacacataccaagttgtgaacaaatatgtgcagaatgattgtgtwagtgtttcagtaggggacacacttggtattatgtgcacagctagatttggggtgtcgcagagctgtcagtgacggctcaactgagacctgaaggggaagtggcagtgagccagatgggggttctgggaggtaggaacagtgtttgtagaatgtccctgcagcatgtgagtctggaatcccagtgcagtccagtctaagccttgcagatgagtggaaatgagcagagtaagcatcacagcttccatttaaacctctgctccccatcctaatttgccatatgaccttaaccagtgaacttcttggagtgtcattctctccatttgcaaagtgaagaaaattgtgatctctgatagcagtgatgctgcgagaaaggagcatgtgccagtgtgtgggstattgctgrgtggagctggaggagtcagctgtgccagatcacataggacctgtaagcaggtgaaccatatacgttatcctccagatggggactgtttatagagtgaaagagcacgttattaatcactaagcttgggtaacaggtacaaacccagattgtcctgggcagactgtccygtagagttgtcctgcgttaagtcataygaaggagtttgatccttttctaagaacaggaggaaccctttaaatgctttatctaccaatgtatacaagtgccattcaggttctctccagcgtttcagagagttttacctgcccatgaactcacagcactcggcttgcactgcaaactcacctatacgttggcagctgtctcctcactgggcacttaattcatgaacaactaggagggaaagacarcaagacagccaggggtctgctctttggctctttgcatttttttttacggggtcttgctctgtcgcccaggctggagtgcagtggcacgatctcagctcacagcagcctccgcctctgaggctcaagggatcctccggcctcagcctcctgagtagctgggactacagttgcatgccaccatggcctggctagtttgtgcactttgtagagatggtgttttgtcatgttgcccaggctagtctctaactcctgggctcaagtgatctgcccgccttggcctcccagagtgctgagattaaagacatgagccaccacacctggcctagctcttttcgcctttaactggagtgttagctgatatcaagaacacatcttttgggtttttctttttttaaccttgtaacacctaaaggactgcggctaagtgttaaaagaaaaaaatttctatctggtggtttaaatatctgcagaagcagaatccttgtcatcctgaaattttttccctgtgggcaagaattcctaataagcgtacaatctattggaaaaatcaaaaagtaaacaaactatggcaatatattctaacatgtattgacttgtcactatcggccgtttgctgtgctaagcactatatgtagatgattgcttgggtgctttgagaacatgtaraagggaaccaagtcctgattcggaggttcaggaaaggctttcagaggacaaggtatcgcgggtgggratggaagatgtatgggaattagccaaaaggacaggggttcagaggtgagccaagtctgtcctgaaagtaagcagaaatgttgttgttcttgtcgttttgagagaagttcatctcagctgtgttcagcatttttagggcataagcttcaacattttccgttctgttttcactgatatgttttagctatacaaaagcaggccttctacacagtttttcaaactccaagacacagtctactagtgggcaatgacattaattttgggggtgataacaagcatgaaatagaataaaacagaaaatattaagatgcatttcatgtaggaagggtaattatttcatgaaactgtatcatttggtttgggacacattaaatctgttcgtacctaaaagaagacattcatgcagccaacaaacatggaaaaaaaaccctcaatatcactgatcattagagaaatgcaaatcaaaaccacaatcagttaccatctcctgcaagtcagaatggtgattattaaaaaatcaagaaacaacaggtgctggcaaagttgcagagaaataggaacgcttttacactcttggtggtgggaatgtaaattagtccaaccattgtggaagatggtgtggcaattcctcaaagatctagaaccagaaataccgtttgactcagcactcctgttactgggcatatatccaaaggaatataaaccattctgttataaagatacatgcacacctatgttcattacagcactattcacaatagcaaagacatggcatcaacccaaatgcccaccaatggtagtctggattaagaaaatgtacatacacaccatagaatactatgtagccataaaaaggaatgagatccctgtcctttgcagggacatggatagagctggaagccatcatcctcagcaaactaacacaggakcagaaaactggacaccttatgttctcacttataagtgggagctgaataatgagaacatgtggacacagggaggggaacaacacacactggggcctgtcgggaggtgggattggagggagggagagcrttaggaaaagtagctaatgcatgtggggcttaatacctaggtgatgggatgatrggtgcagcaaaccaccatggcacatgtttacccatgtaacaaacctgcacgtcctgcacctgtatcccagaacttaaaataaaaataaaaattaaagaaaattacatacctatggcatttagttttctataccattcctttaagtcatagaatcagatgagctyaggggctagaaggaagagggagcgatgggaaggcagtcgttggtcatgccctgggcctrgatcgcgggaatcagtcattcagaaagccccatatgttgggtgggtctcacagcttacagagaagccagctgaggtgtgcaggttaagaaacttgatctagggtcacagattaaattactagcgctgacccctgatctcttggcttctgatgtggtggtattctttccatacctccagggactgtgttcccaaagtttgttagttaggtggctgtttagggaaggaccacacctggttcctgtttgtttgtttcttggtttgtttgttggtttgttwgtttgtttgtttttgaggcagggtcttgttctgttgctcaggttggagtgctgtgactcartctcggctcactgcaacatctgcctcccargctcaagcaattattgtgtcagcctcgagagtagctaggactacaggcatgcaccaccacacctggttaatttttatgtttttagtagagacagggtttcaccatgttggccaggctagacttgaaatcctggcctcaagtgatcctcctgccttggcctcccaaagtgctgggattacaggtgtgagccaccccacctatcaagggaagatattttcttaaggggagtatgtaataacaaccatgtccctggtttgttargaaggttataaactttgaaatatacccatcagtttcataaagagcaagacaggttaggaagaaatagtgttcattatacagactagagagctttcagcttgacattgacaaatataaacttggccactgtccctccactaaagcgtttcccttgctgctggggaaggaccgcctggtgatgttgtgtgagatgatgcactttctttgccccctctgtggtcactgggatcacagctaaatccaactgtctgctttttccagtgtctacacataggctgatgagttctcccggaaaacacgccgctctgcaaattcaggatgccgtagctctgtgacttcccactccatctaggatctctgtcttccccagctcccagacgtttccctggccaatgatcttccttcccacggcagcttctccacagctgctcctgcctccgccgtcccctcgcactcagcagctgtcttgcctcctgcttccctgagaaagtacaagtttcccgattcagaactgcccccacctggggatcacagggctgcacgcctcactttatctgaatccatcctctcatccttcttttctttcacaacgaaagaaacccctcagttccagccaggcacagtggctcacatctgtaatccaagcactttgggaggccaaggtgggtgaatcacttgaggccaggagttttagaccatcctggccaacacggtgaaaccccgtctctactaaaaatacaaaaattagccaggcgtgctggcgcatacctgtaatcccagctactcgggaggctgaggcaggagaatcgcttgaacccaggagacagaggttgcagtgagccgagattgccccattgcactccagcctgggtgacagagcaagagtctgtcttagaaaaaaaaaaaaaaaaagaagcccctyagttcctgtctgaggctcacctcccctggggccctggaatccatttctttcttgttcttgggaatctcaatctcttatcttccctgtcacctgcattttccttctctccctcatttctggccccattctctctgtattaagtgcgcttaaatcccttccttctgtgaaaaaaagaatatatatccttttataccttcctccagctacttccttgtcttgcttctcttcacaatcaaactcctcaaattgttgtctacacttgctgcctttgcttcctcaccccacatgtcttgaacgacagatgcctggccttgcctcttgcacccctcagaaatgatcacccgcactctcctcatggccgattcccgtggagttctacccgcctcttacctgacttcctgcaaccagatgtgccgtgagcacacatgcatcctgggacattgtccctctgtgtctcccatgacccccctgcccatgtttccttccttccttcctctcttctcctttgcaagctcctcttcttttatcaacctggatgactgatgttcctcaattttcccgccctgtgagcatcctcttccctcatcagcctccatacctatctcctcgctgactgtgacccagtcatgactgccccagatccttgccattcttccccagaaagttcctgggcacgtctaatgcctcatgccccaaactggatgcaccaccttcccctttctctttcaacacgttttctcctcctgctcttttctgcaactggcatagacatcacctgctgcacgacctgaaatctgtgtgtctttccttgattctgtctcccctatctccatagcttgccccaaaccaattttattcactcaccccaattcctctgtgttccctccagcctgtcacactcccaccacctctgctctaattacaggcagcaccgtttctcttctgggttggtgtggaacctcctccctagccgtggttaccatgggctgccttctggaacccagtgtgccactccctgctcttaagttctccaaaggctacccagtgcccccgggataaagcccagcctccctgatgtggattcgaaggttctactcctttcctctccagccctcacatcgggttcctccaagtctgagcctctttaagctcctaggaggtcccagcatcccctcatctygtggacgtctgctcaatctctgagctacttcctgtacatcttcagctcccaagatgtctcttgtcctctggaaagctcttcctgatcctccacatcaggacttggctttcttccacattgtacactccctgaggactggatccacactctctcttactctttttgttgcacttctagcagtcagcattgtgtctgacacgtagtaggtgctcagtaaatattagtgggataaataaatgagtcatatattttagaatctgtaatgcccaaggtactgtgtgctaagtgttagaggaaaagaatcccaatctagtgacttaaatgtctgcacaacagaattactattgtcttggaagattttgcctgtggacctctggagttatctagataaattctaccagaaatcagagctgaagggggtgggaaatgtttagaattccgggaggtgacttgctgcaaagactccatctccccttgtctatggtgtgatttttccccttatcatccccttggcatcctgctttgtggaccactgtaatgtcaataattaaaaaaaagattaaactggccgggcgcggtggctcacgcctgttatctcagcactttgggaggccgaggtgggcggatcacgaggtcaggagattgagaccatcctggctaatgcagtgaaaccccgtctctactaaaaatacaaaaaaattagccaggaatggtgatgtgtgcctgtagtcccaactactcgggaggctgaggcaggagaactgcgtgaacctgggaggtggagcttgcagtgaaccaagatcacgccactgcagtccagcctgggagacagagcaaggctccatctcaaaaaaaaaaaaaaaggttaagctaagagtgatcaggaaataaaagataatattaaaatattcaaaaatattctataagcaaaagaatgaggcaacaggtaaacataaaatgtagacatagcaaaaattcataagtgattttaataaagaaaaaatagtaaaggataaaagataaaattttgtttaaattaaatgaaaagatattttaagtcttcttcaaaacaaaatcataattttttttgttagttttggggggatttttgtttttgtttttgttttgttttgtttttttcttttttggagacaagagtctcgctctgtcacccaggctggaatgcagtggcgtggtcacagctcactgcaacctccgcccttcgcctcacctgagtagctgagactacaggctcacagcaccatgcctggataacttttgtatttttagcagagacatgttttcatcatgttggccaggctggtctccaactcctgacctcaaatgatctcccaaccccctgcgccaccaccaaagtgctgggattacaggcgagagccaccacgcccagcctataatcacttttaaatgtactaaaatagatacgagtaagaaaggtaaaagactaaattcaagaattaggatgatagaggtatgcccaaaacaaaataaatgaaagcattcacaaaaaaaagaatgtttatcttaaaaggaaagagtagtaaactatttaagggactcacttaaaagtagaataaaccaacattatgaaaccaaagaaaaacataatctttcaaagaagattagaaataaatcccagcagcaataaaataaaatgggcactcacatgtatgggtttctaacaacagctaaaccccagctaaaacaatgttaaagccagtgctgaggtttccagcttgtaccccagaaggccttggtgacctcagggatgtcatagagggaaaacactgggacatttccctcctgaggaatgtaagcacagggtcagataagggtagagaagagagctacactcatctttgtctgcagaattcgggtgacgcgtcttactgtgcaagacttggcaccttgtgcattctggccccaaattgcatctccatccgtgtgttctgctatcctttcagaaatgggaagatatggtgggccctttagggccaagcatatccctgtctttgttcatggaggcctcttctcaaacagaatccctatgtcctgttcatgaaacactatttgcccctactatataattggcatttttttaagtgtcctattgtgttagagcttttccaagtcgcctctgatgtgtggactgactttctgcttcctgtgtctctgggagcttgaggcttctatccttctcattagtggagctccctaatgacattttaatgcaattattgtctcttgagtaagcctgagagcatgtaccgagtcttctctttctctttctctctttaactctcagcacagagctcagacggaaccttggattgaggaggttcatgaggcctcctgtagccagggaatatattttatttccctccagttaccaatatgaaggtttccaaacgttcatatcatattttaggccctaatcattaatattgagagccctaagcactccgatttgggtccatatctaaaggtgagttttaggggatctgactgagaagtgttccgggccagctccctagaaacccttgggtgcactgacttcttcctggccagtgtygtctgcttggtcatcagtgtgttcctcccctcctgagttctctccatctttctgttcttctgttttcttgcagtaatcgaggacaggtggtcgctggcacacaaggatattaggaacccatgaggttgtcccttgtaggagaaaagactggagagaggccactgaatctcgttgtgtcattcaccctacctagtcctgctctgccagggtcatgctcaccttccagacccmcccaacagtgaagtcggactgaaaaatcccagaagtgggaattgggagacaaggttgagtgcattagggggatgtctaggattccccctgattcgaatattttgtagctgttttgaggggtccttttcgcatccagaccaggatttcacctggacagctggagtgggaaagaagtggatacatttcaarctcctagggctgtagttaatgtgtcctgtcataaccactgcagaacagtgtaggtcagagaatgcaaccactggtggcatgtataacccttcaccaataaaccgaagtgcagtcccacaaacatgggagtcattcagctacaattagctttgctatggacaggaggaattaaaatttaataccgtagcaacagcaaaacatgattcgttctacagtgttagtggggatggtaacacaaggaaggttatgataaccaagtttctctgaaaaggtcaagtggatttcctcagtgggctatgtttctggaatataaggtaatggtgaataatagaggaaatctccctctaagaatgggaactctttaattcatctgcattagtcattcaataaaaataaattagcatacattttactggggacctatttagaggggtactatgaacagtagccataaataactcttgcataggaagaacgtgaattactctactttgtaaatattagtttgcaaaagtaattgtggttttgcaattacttttgaggaacgtaattcagtgggaagtaacttgcataattccaagttctgaagcagaggcagctgaaatatttgccattgcaatgaaaaggactttcctcccgggattcttccctagttcctggacaaggagatttgttaatatttgtagtacacttgagatctgcgactaaaagtgctttaggagagaaaagcatcacaagaagaaagggctttttgtttctttttaaaataaaataaatgcaatttctttcaccaaaaaaaaggcgaacattgctaagcataaatgagcacttccttttagaaatgaataaagtaaaactcaaccattakcaacttcccatagctagagctcgcagaggaaaatgttaacacatagcatcatgtttgaattttattattttcatagagaagaaaaccagcaagcaaaccccttctcttgagagaacagccttgaagtactcagaacagagagcatatgtatctattgaaataaaataaagtcacttttctccaggaaaatactatagatattttctcatggaaaaaatagactagacctatgggtctaaatatgtaaacataaagagagatcacactatttattcaagtactgtgctatctcaagacacccagccatgctgctaagaaggcgcattataaagaagcatcaaacattctgcagtttcaaaaagtgaaacgtatatttgcttgartgttcatctaaacactacccataggaaaattcaaacgaaactccagggaattttaatccacatgccacattttcttagtcttttgcaagatagagtcagaggattacattttctgaaaaccgctttttaaaaagcttaagccctaatcagttaagtgtgacaaaggcttgaaatgggatttggtagcaagtaattaaggatgaagtacaagtgggtatatattgacagtggacccatgctattgtcctgaaattgtcagcggggagtttattctttatttgacattgtttatttgacccagagcattgctttgaagatatcaattgctatggaacaaactgctcccaaacttagtggcttaaaaaaacagcaccattgtatttgttcttgattctgtgggctagggatttgggtcagccttggcttggcggttttggtcttcagagcatccctagggccctctcataaggttgcagtcagacctgagatgaggtcactcccttatatggcccctggrtggatgcagctaggaggttgagattcccccaccccgtcttcctccatatgtggccccaaagtaggaagttcctgctgctttggtctttgggtgaaaaacaggtcaygggccaggcaagatcaaggaggggcagcagagggcacttctgggcgagcagtacagtggcatcgcagaaggacaggtgggagggraagggataggctgcakcagctgcctttgaaaacgccatcgagcaatagtattgcagccatttayaccataatatttcctacagaggacctcgtttagtttccgagattgagcctctagtctcgctcttcacaccgctgaagatgtgcggtagaggatcttgctgaaacgaaaatgattgctgcactcccctgcaaagctctttggttactccatatcacctgcaaaatagaatcccgaatctttgcggggcccgtgagttcttcccagcctgtgccctgcctgccagactcaggtttcccttgggtccttgagcacctcgtagctccccagaagcctcttgcattttacagctctgcacctgatcccaggcctgagtgcacttcctcacgctcacatcgttactttgctaacccctgagacctcacctcctctgcaaaggcccccacgggctgtgtcaaggtgtccctcctctgcgtgccctggcatgctgtgcacatggacagctcagcagcactaacacacccttcctccctccccaactgcactgtgagctcccaagggcaggctctgcatctctttgtctgtctagcccctagccctcggcttgagcagagagtcccacacatagcaagtgctcagtaaattttggtggaatgtcagctcagtataggtaaatgacagagtggaggagtgtcggagggaaaagaccagaaaaccctgtacaggaagaaggcggtgtgatcccatggagagttggagcctggggaggcaggaagaggaggaacaaagcggtgggcttagactgcaattggaggctgagagcactctaggtagtcaagagacgcgaacaagcatagaaagtaaagcagaaaatctgattcgatgtaagagaaatcgaggcatgtgtcatggtgaggggcttatagggaagaggcagtgacaaggtaggagagatggcccaacatcaggacgggccatggagacctgtccccatggggagagccctgacctggactcagaaggcagggcacccagaatcccacccacgcacctccagacatgcagtagagctcagtcatagtaggcatgcagtagacctccctgtcaccgagaagaggaggagaggcactgggcaaagtgaggttgctgcttccgggactcttggaactgtgagacttacgctctgaaatcctagctgtcacttacttcactttcgactgaatatcttcactcttgagccaaagtgattgcatgcctttaaagtgaaactgtgcgctgggatctagttgacaagggacaggggctattgttttgttgggggaggggaggtggcagctgagagccaaccaaggaagcccaccttgaaagaatccatagccttttttcaacaaaaaaactaaaaagtaatcactacagaaaatattttagtgctaaatcttggaagaaaacatgatgagtgttcttttgactctgagtatataataattatagctaacatagactgagctttttctgtctactagtaactgttctaatcactttgcatccattaacccatttaatcctattatgatcctcatttttcagataagaaaagtgaggttaaatagcttgtttaaagccacagagctaccatacagcagaactggaatttgaactcaagcagtttgatgccatgatctgtgttcttaatactccatgtagcaaagcctgattttgggactataccttatctactgacttatgtttaaaaatactacctgacattggagttaattctgagaagtgggttttgagacttccttctccctttatatctcaattactgtttggggctatttccttgttttgctgtccaatgtattacttatgttagtaatggagagaacactcactctggttgagcataatcatcaagccgggagctctgctaagatccagtcggcttggctgggttcttctccaggcattctctgctgggccctgaagcgtgcgtctctctgctgaagcatgtgaacattcctcctggtgtttagagagatttggaaaaggctgaaaaaccgcatggaactccggaagttgttgtcttttcagggaaaacttgtgagggagacaggagatggccacagtggttttctttggggtccagcactgaccggggcatttatgaggctgccctgcaggagaaccacacagatgagttcatagacaagcctgagtgggcttctccttcgttcttccttacccacgagcgtccacctcaatccctctctctttcctttccggtatctccagatgccaggtccgtggctcaatgtatttccttcctaccagcattattttgaactgacaatgttgtaaattttaaactatattttaagtaaaccttaaaagcttattttagaatcctaatctgctttttcagacttttgttcacctcagatctccaactccctttactttttgcttgaactctcctcccttcttcctgctttcctcaactctttcatgctgtgtttaataacatgctaaacacattaaaaacagcaagttctatcatatcaacatacatgcccacacccacacacatacgtactgacgactgtcacttgcaaagagctgttaagaagaaagtttgtttaattaaaaaccagcgagaatggtggccagattaacattcttgagtcataacttggaggtttgaacttcaactttatggagccgttctgagaatttaaaaaagtaatctattctgtcatactgtgagatctacataaattattttttggcataggcctttgtaactttttaattgacttttgagtcagtgtgtttctgtgtatgtaaatcaattgtaggttcacgtcaaatttctgattgtctcagatatgtattgtttagtaatatttgacagggtcctgaagcacaagattccaaaaagttcaaaaagatacccttattcaaggaaacatttctttttttcttgtttctttttttttttttttttttttttttttgagacagggtctcactctggttgtccaggctggagtacagcacaatctcagctcaatgtaggctgcacctcccaggctcaggtgatcctcccacctcagcctcctgagtagctaggattacaggtgcacaccaccacacccagctaactttttgtatttttagtagagacacagtttcgctgtgttgcccaggctagcctcaaacccttggactcaagcaatctgcctgtcttggcctcccagagtgctgggattacaggtatgagcacccagcctcaaggaagaattttttagtcagcaatttgaaaagaataaattttttttttttttttgaaatggagtctccctctgtcgcccaggctggagtgcagtggtgcaatctcggctcactgcaaactccacctcccaggcttatgccgttctcctgcctcagcctcctgagtagctgggtctacaggtgcccaccaccacgcctggctaattttttgtatttttagtgaagatggggtttcactgtgttagccaggatggtcttgatgtcctgacctcgtgatccacccgcctcggcctcccaaagcgctgtgattacagacatgagacaccgcgcctggcctcaaaagaataatttttaaaatttcaagaaacctatactttgttttggcttggtttctaaaatagaaaataaaatggattatttatatttgaccaaatagacacattttcagaggctgaacaattcactgagtatgtaagcattaggcctgaaaatgaatacggagaaaaattagaatagccacgaagtgcagcatatccgtgaaacactatctcaggggcggagacaaagtcgccacactttctacgggttcattttgtcctgatggttccatgatgcgctgcctcccagccagtgtttgcagaaggtttttagattcagtcatggaggggaagaagaagctgtgaaaaccaaaaacagcacagaggggtttctttctccttccagtaggcttcccagcaaatcaaggatgactgcctgtagcacgccgctcctcacctagtctcaaaatastccagaaagttctccctacaccttattctatccagcacctgaaatgctgycagctaggatcttaggggacacagatcctcttaaaaatgcaagcactgctgagattcccttcacccattagggtggcttaggcagtaacaaagagaaaatggatattttcaaggagaaggggaaagctgggttttattcagtcactaaatgttgactgatcaaacacctaacatgtcagggctttttctgggcgtttaaaatacaggggagaagagaaggagaaaggtactgaccctcgtcaagcctatgcctacttttttttggagtmgaaagacaatagctaagtaaataacacacaaataaggtaaagtcaggcacctcaaatacagtgacttgaccactacacattctgtgtacgtaacraaataccacatgtgccccataaatatgcaaaatatgatgtatcaataaaaacaaamacacacaaaactcaaagaacaataaaacaaagacggtgaagaggtaaagagaatttctagaacctggcctgtttttagattattaaatgtttccttttttgatggagagtgaagaaaaatatctgatattgtacttgctgccacaaaatcatggttaacagaaaaagatacaggccaggcacggtggctcacacctgtaatctcagcactttgggaggccgaggcaggcagatcacctgaggtcaggagttcgagaccatcctggccaacttggcgaaatcccatctctactaaaaatataaaaattagctgggtgtggtggtggatgcctgtagtcccagctactcaggaggctgaggcaggagaatctcttgaacccaggaggtggaaattgcagtgagccgaaactgccactgcactccagcctgggtggcagagcgagactatctcaaaagaaaaaaaattacaaaggagtcactagatgatctagaaaaaggcatgtccctccttccctggcccaaacaatgcacagctcttatctgccccagtcctcaagggctgggaccagggctcttttattacccagaagttcctttgccagttcttttcctggcacctagttggtgactaatgaatatttcttcctagtgagcgtagtataaggtatctgactgtggtcatttatgttcctaatgaggatacgtaacttttctttttaaaccttaactttttattgcctattgctgaaatgttagcagataggccaatgagtagaaagaaccccaagaattgcctgattaattcccactcatgcagcccaggcccaagctctcaccttctgccctgcttttaacggcagcacatgtcaccgctgacgggacgtgcctctctgcgcgtgaccatgcacttgggactctctaaatgtctcaccggagaatcaatagccctagttcagctctaaatgaagtttctcgtcgcccccttctcttacaccctaaggataaagactgtctctgagaattttccccaaatcttcctaacatagagataaaaatagtaaaataagaaattagacccctcaacttcaactttaaaatcttatttctcttcctgcatcacggtgaccacctcctcacaagtgcaagaatagatgacgatattccagcatgytgtgattctcctaaaaacctgctgctcctagggactctgtggagtgagtttcctggaccgaagtcacttctcagatcttcatgttacacccatgatgtttgcttgctaaaccatcagcttaagttatttatcctgtatcttttatctcagttttctggttgcattttatctgtgtcatctttactttagtcaagctaacgctgtggttttgcaaattaaatcagctgtgggtttcagtatgtaactcctctttgtgtttactaagccttttttaaaaaaaacaaaatagtactgtatgtctgtttacatctttagtagtgtgtaagggaagattgttttctttagagttcttttraacaatttcaaggctattcagaaggatccattttaagaaaccaaaacatctttttaaaatgccttgtttaatatatatctttagccataatggaatccccttaaaattttgaagttgatctgtaataaagaggttgtgtgggtcatgagtctggactttatagttcagacaaagagaatctgcttcatgtttcaaagcaaggaagagatttttttaaaagacagctcacatggcccgtgtaggggtggaaaaggcagcgtgaaagagcaaggggataagtaattaaacatctattggaatcatgaaattattaagagaaaatgtctgaagttccagagctaaaagactgaagagcagtgatgaaatgcaacaaaaataaccagaaaaatccatgggacttgttgcgtagatggttggaggagatgaagatgaaggagaactcagctggttccaatatttctagcttggaagactcagtaagtggtaattccattgatcaagacaggacagagaggagaggtacagacactggaaaaagtagaattcatgtttgtttcagttgtgtttgaggggctggtggaacatcacctggaaaggtccaatatggagttgaatacaggggaccgaagaaagtgaatgtatagttcaagaaagatattctttttgaggctactactaggtagagggtcataggagccatcaaaatagatgagattgaccagaaatgttggtttaaaaaaaagggggaggaaagtcaaaatgtattccaaaatagttaggtaaagaagtgaaaccaacagaataagctgaagagtgagctgagagggaaggagagcaggagagaagaagggagtcgacagtgtcctgtgcagtgtcaaggaggaagaccaagaaattgaattaaaatacaattgatagtacagagttacatttggtatagagaaaggtctctggaacaaaaggaagaaggtctctggttgaggaggaagaccatttccagccgcagggtctggaaatgaccaagtcatcagcgctcttgcagggagcaagatagatccacagagtgctggctggaggaatccatatggcagagggcagagaagcgaatggaaggggaggaagcaaagatggttcaggaagctggttggygaaggaagggaggtaaggccatarcagcgggagaagccacggcagaagttgttagaggttgcaaaaccggagggtgtttataagcgggagtgggagacaggcagaaatcacaagaatggcaaggggttaaagaaaagaacaattccaagagtgtgtacagggttaggatcatgtatgcatgaggcattcagggaagaactagatggagactgggataagttgaaccagagcgaaggaagttgagccatttatgtcttgcggcttccagtttttccttaaaattaacaagctcatctgccgaggtggagaaggcagagtcatggttttggagacataaggggaacaagtgtgggacagcccgtttaggaaattggaaaataaacaggccaggaataagatcaaaaataaagccaagattgttggcaaattcagcaataaatcaaatgcttacataattcattgttttttattgtagtgaaaataaacaacataaaatttacaattttaaccactttaagtgtaaagtgcagtggcattaattagattcatgactgtttccagaaygttttcatgacccaagcagaagctctgtacccagtaagcagtaactctccatttccctctcctttcagtcccaggccacccccttctactctttgtctctatgaatttgcctcttccaggtagctcatattaagtgttgctttttttttttttttttttttccaagacagggtcttgctttgttgctcaggctggagtgcagtggtgcaattacagctcactgtagcctctaactcctgggctcaaacattcctcccaccttaccctcttgagtagctaggactacaagcgtatgccactgcacccagctggtttcttaaattttttgtagagatgtgagttttgctatgttgcccaggctggtctctaacccctggcctcaagtgatcctcctatctcagcctcccaaagtgctgggattacaggcatgagccctcatgctaacctatttgttgcttttaaagcattaatcatggrataagaaaaaggaataagttattcttctgctgtataacactctgtaaatgaagaggtcattcctaaaccatatcctggttttgttgttgttgttgtttgttggttttttgaggcagagtctcgctctgttacccaggcttcagtgcagtggcacgatctcagctcactgcaacctctgcctcccggtttcaagcgattctcctgcatcagcttccccagtagttgagattacaggcatccaccaccaccccagctaatttttgtttttttagtagagacgtggttttgccatgttagttaggctagacttgaactcctgatctcaagtgatctgcccacctttgcctcccaaagttctgggattacagatgtgagctaccgtgcccacctggcccataccctgtttttttttaaatccaccatgtggtatccatttataaaaccttattattaatacaatgctatgaaattgatataatgctttacccttaaagtgattcaaatcagctgaagctttgaacctctctaaatcctactttgaattaaatattttctttatcatacgcatacacaacaatgaatgtcttttttcccccatccaaatgatagcacagaattgtgaatctgtttctgtttagtgttctcttccagaggattgcattattcactgaatgtctgttgtctgaaatagaagttcccacagtagtttgtrtacgcatcatttaggaagataagtggtttttcctgttatgtatacaaataaccagtctgtgttaatgtctattatgggtgacatgaacagatccttctcgaggaggtttacatgtgtcactatagcattagatcttttttttttttaacttttattttagatacagggagtatattacatgatactgaggtttagggtgcgattgatcccatcacccaggaactgagcatagtacccaatagttagtttttcaaccctagacccccyccctcccacctttacttgtccccggtatctatcgttgccatctttatgtccatgagtacccaatatttagctcccacttctaagtgagaatatgcattatttgattatctgttcctgcattcaccacttaggatcatagcctctagctgcaatcatgttgctgcaaaggacatgattccattcttttttgtggctgtatagtgttccatggtgtctatgtactacattttccttatgagcatctaggttgactccatgtctttgctgttgttaatggtgttgccacgaacatagatatgcgtgtgtctttttggtagggtgatttattttcttttggatatatacccagtgatggaattgcaggttcaaatggtagttctgttttagattctttgtagacttagtaatttttaatggaaatgaattatcttcccaatgaaagtaaattctaataaaagacttattgaaagaaatgtctgatattgggatcattttcctaacacaatttccattttcattttctgtaaagcccccacaagagttgacagagttcctgaggtggsgatgagtgagccgtgcctctttctacagtggatgtagtggatgtggcttacagatgccttttacatttccagctgtagacagaaaatgccagaggccacagcatttccccaggccctgaaactaagctaacaccctctaaatattgccaaatcaaagtaatagaaaggaaaactgttctcatattgtctcacttccccaaacatatctcccctaattcagttccaaccacactttaattcccagtttggacccccatttttctcctgaaactactgctggagagttctctctcttyggagttgcagttccttctgcaacgttgcatggactttggtaccaactggccttggttgctttgtatatgagtcctgtatcccaaggagactataatcttcctgacggtcgtgggtttcaattcctagaatcacgaaatagcagcactttacagatgagaacattagacccagagaggtaaagtaacttgcctaaggtcacacagctgaattcagcaaacaggtgaattagtctttcttccctacttgaactactacttgaatgagtgctccgagacttgatgtctgcgacactctgtttttttttttactgtttccactgcacttttttgttctagagacctttctccataccaaatataattctgtactatcaattatattttaatgtataaaattatagtcacatttcaggtcctgcctcccagggataaccttgactaaagttttaggtgctcagaaataatttagtgacacatttatagattttaaagtttggtaagaaatttggaagtaactgccaaagttgaagatatgtgcataccgcaactttgtaggtctattgctttgcatgtattctatcgaaactctcaaatatgttcccaaggaggtatctacaaggatgttcacagcagcatgagttataagaaagtggaggagaaggaggaggaaggaagaagaaggaaaaaaaggaaaagatgaaacatcaatagaagaaaagatggatagcatatttctttcttcttcttcttcttttgtttgtttttttttattttttttttttatttttttattttttgagacagggtcttgctctgtcacccaggctggagtgcagtggcactatctcggctctctgcaacctccacctccagggctcaggtgatcctcccacctcagcctcctgagtacctggggccacaggaacacactaccatgcccagctaatttttgtatttttagtagaggcaggattttgctatgttgcccaggctggtctcaaagtcctgagctcaagcgatctgcctgcctcgtatgtctattccgatggaatctgcagcagtggttctcaaagtgtggtccaggagatcattaaaaccttttcagggagtttgcaaagtcaaaactgatttcacagtattactgaggtctatttttccttttcactctcattctgtaccttgaagttttccagagactgcatgttctgatagccacaggctaaacgcagaaactgtcttctattaaaccagacattaaagagatcacaaaagtgtcaaacagtgccactttttttcaatgttttttgctttgaaaaacataattatttatcataaaatatgttgtcttcacgtattacatgataggttttcattatttttaattaaaaaaaatattttaatttttctccttcttattttctgatgtggtaaatattgacagatataatccctataaaccaaagctctttgtttttctcacaatttttaagagaataaaataattcttagagtaaaaagtttggttgggtgcagcgactcacacctgtgatcccagcactttgggaggccaaggcaggaggatcacttgaggtcaggartttgagactggcctgagcaacctagtgagaccctgtgtctacaaaaaataaaaaagaaactagctgggtgtggtggtgcatgcctgcagtgtaactagttgggacactgaaggggaggatcacttgaacccaagaggtggaggccgcagtgagctgtgattacaccactgcactccagcctgggcaacagagcaagactctgtctagaaagacaaaaaaaaaaaaaaaagactaacaggtttgagccctgctgttgcagacagtgagaatgaatgaatggagactgcacgcactgagcctgaatcttggaggcacgatcactggagttgcaggagaatataaacagtgatttatattgtgttttataactagtaaaacatgctgtatgcagaatacatgtttttaggaatatacaggtatataaaacatgtataaaaagttatttttatatttgtgtatatctgaaacactttataatacacttgaaaaactataaatagctatataagctcaacaaccacaaaaaaaattagaaaatgaacaaaagacttgagtagacatttcctcaaagaagatatacagatagccaacaagcatatgaaaaaaagttcactatcagtgatcattagagaaatgcaaatcaaaaccacaatgagatacagtctcacaccagtccgaatggctattactgaaaagccaaagaataacagatgctggcaaggttgtggagaaaatggaatgcttatacactgttggtaggagtgtaaaccagttcaaccattgtggaaagcagtatggtgattcctcaaagagctaaaaacagagctaccattcgacccaggaatcccattactgggtacataaccgaaggaatagaaatcgttctatcataaagacacacgcacgtgtgtgttcactgcagcactatttgcaatagcaaagacatggaatcaacctaaatgtccatcagtggtagatagataaagaaaatgtgggctgggcgtggtggctcacacctgtaatcccagcactttgggaggccgaggcaggcggatcacaaggtcaggagatcgagaccatcctggttaacatggtgaaaccccgtctctactaaaaatacaaaatattagccgggtgtggtggcaggcacctgtagtcccagctactcaggaggctgaggcaggagaatggcatgaacccaggaggcggagcttgcagtgagctgagatggtgcactccaggcactccagcctgggtgacagagtgagactccatctcaaaaaaaaaaaaagaaaaaaaaaagaaaatgtggtacatatgcaccatggaatactatgcagacacaaaaatgcatgagaccaggacttttgcagaaacgtggatggagctggaggccattatccttagcaaactaacacagaaacagaaaaccaaatgtggcatgttctcacttataagtgggagctaaattatgagaacacatggacacaaagaggggaacaacacacactggggcctgtcagagggtggagggtgacagtagagagaagatcagaaaaaaataactattaggtaccaggcttagtacctgggtgatgaaataatctgtacaacaaacccccgtggcacaagtttacctgtataacaaacctgcaggcgtacccctgaacctaaaataaacatttaaaaaaaagagaagatgctcaacattacttaccattagcaaatacaaattataatcccattagagaagtgcaaatcaaaggagatattgccttgaacccattaggatggctagatcaaaaaacaaaaaataacaagtgttggtgaagacgtggagagttggagcctttttgcacttttgctgggaatgtaaaatggtatagctgctatgggaatcagtacggtggttcctcaaaaacttagaatgactgcatgatccagcaattctaccctgagtatatattcaaaggaattgaaagcagggtcttgaagagatatttacacacccacatcgattagcagcaggattctcaatagccaagaggtggagacgacccacatatccatcaacagatgaatggatgaacaaaatatgctacaaacatgcaatggaggctgggcacagtggttcatgcccataatcccagcactttgggaggctgaggcaggctgatcacttgaggccaggagtttgagaccagcctggccaacatggcaaaatcccatctttactaaacatataaaaattagccgggcatggtggcatgtgcctgtaatcccagctactcaggtggcggaggcatgagaatagtttgaatctgggaggtggaggctgcagtgagccaaggtcataccgctgcactccaggctgggcggcagagtgagactccatctcagaaaaaaaagtgcaatgggatattagactattagccttaaaaaggaaataaattccttcacatgctgtcatgtggatgaactttgaggaaattatgttaggtgaaataagccagatacaaaagaacagatattgcccgttctacctatgagaagtatctcaagtagtcaaattcacagaaacgggaagtagaacggagattgcagggcttgtggaaagggagaatggggagttattgtttaatgggtgcagaatttcagacttgcaagatgtaaaagttctggagatgaatgcccaacaatrtgaatatacagaacactgctgaactatacattgaaaatgattaagatggtgaatttcagccgggcgcrgtggctcacgcctgtaatcccagcactttgggaggccgaggtggccagattaccagaggtcaggagtttgagaccagcctggccaacatggggagagcgctgtctctactaaaaatacaaaaattagccgggcatggtggcaaacacctgtaatctcagctactcgggaggctgaggcgggagaatttcttgagcctgggaggtggagattgcagtgagccaagatcatgccattgcactccagcctagcctggcagacagagtgagactctgtctcaaaaaaaaaaaaaaaaaaagatgaattttatgttatgtgctttttaccatgataagaaaagctacataattgcagtttttgtcattacttttaatggcaaaaattgcaattacttttgtaccaacctagtaatcgctatgacaaacctttgtatgatgggggaattttctgattccctgccctcactccagttatcataaaaataagtcgactgtttctgaatttcccaagtgagtatcttgcccagacttcttgctttagtccagtctttgatgttggctcatatgaagcattctgcccttccagaatatcccgtacttcctccctatctacataaattctacccaagggaactctaatgaatcccattgcagcatgcccaactccatactgctttctccatgatacagtcagaagccaacccagggcacttggattcctcttgccttaaggacccaggacacttattttgtgtacaactagatgttcattacttatatggccccatgtactgcttcttaagttttcagagctgttccatcgctcccattagaatgtaagcccttggaaaacagaggtcctaataacacaacatggcttatacgtgcctgcctcagagctttggcatatggctgtcacacaataagactggtgaatgaatggataaatggatcatggatggatcaatgtggtctttcactgtagctgagctggatgcattaagaattaagtataacatcttctttttttattttattattattatactttaagttttagggtacatgtgcaccatgtgcagtttgttacatatgtatacgtgtgccatgttggtgtgctgcacccattaactggtcatttagcattagttatatctcctaaagctatccctcccccctccccccaccccacaacagtccccagagtgtgatgttccccttcctatgtccatgtgttctcattgttcaattcccacctatgagtgagaacatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttatagtcctttgggtatatacccagtaatgggatggctgggtcaaatggtatttctagttctagatccctgagaaatygccacactgacttccacaatggttgaactagttgacagtcccaccaacagtgtaaaagtgttcctatttctccacatcctctccagcacctgttgtttcctgaccttttaatgattgccattctaactggtgtgagatggtatctcattgtggttttgatttgcatttctctgatggccagtgatgatgagcattttttcatgtgtcttttggctgcataaatgtcttcttttgagaagtgtctgctcatatccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggyaatgcctaggttttcttctagggtttttatggttttaggtctaacgttgaagtctttaatccatcttgaattaatttttgtataaggtgtaaggaagggatccagtttcagctttctacatatggctagccagttttcccagcaccatttattaaatagggaatcctttcctcattgcttgtttttctcaggtttgtcaaagatcagatagttgtagatatgcggccttatttctgagggctctgttctgttccattgatctatatctctgttttggtaccagtaccatgctgttttggttactgtagcctgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcgtccatttgtttgtatcctcttttatttcattgagcagtggtttgtagtcctccttgaagaggtccttcacgtcccttgtaagttggattcccacaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcgtataaacagaaccaaagacaaaaaccacatgattatctcaatagattcagaaaaggcctttgacaaaattcaacaacgcttcatgctaaaaactctcaataaattaggtattgatgggacgtatctcaaaataataagagctatctatgacagacccacagccaatatcatacagaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtyaaattgtccctgtttgcagacgacatgactgtatatctagaaaactccatcgtctcagcccaaaatctccttaagctggtaagcaacttcagcaaagtctcaggatacgaaatcaatgtacaaaaatcacaagcattcttatacaccaataccagacagagagccaaatcatgagtgaactcccattcacaattgcttcaaagagagtaaaatacctaagtataacaccttctttgaactaatgtagcttccacatggctaagctttgtgtatattccttgcaccacgctgaaatttcctttcctctgcaacctcatcttgctctaccccaaggggcacttctactgtaaacctggatggtgtgtggagtgaggcagtcctgactcccctaccctaatcccactggcaccccattttactgccctttttgttttaagacgcttactattaattgatacacaaaaacaggaggcaggtaacaaaaataataaacatcagggcctgtacaccatcatgagtaacacctaacatttgcagttagatatctctgagctcagttccccaccatcccacttactagctgtaggtcctcggacaattcacttgaactctttcttttgttgttgtgctagaacacgcgtaacacaaaatttaccatgtgaaccttttttttttctcgttttcctgagatggagttttgctatgtcccccaggctggagtgcagtggcacaatctcagctcactgcaacctccacctcctgggttcaagcgattctccccgcctcagcctcccgaatagctgggattacaggcacacaccaccacacctggctaatttttgtatttttagtagtttcaccatgtttgccaggctggtctcgaactcctcaccttgtgatctgcctgcctcagcctcccaaagtgctgggattgcaggcatgagccaccgtgcctggcctgaaccaatttgaagtgtacagttcagggacatgagaacattcacagtattatgcaaccatcgccaccacgcatctccagaaccttttcatcatcccaaactgagactctgtccccatcaagcatgaattccccatttccccccttccaagttcccgggagccacaattctaccctcagtgtctgtgaatgtgactcctctagggactcatttcagtggaactgtttaacatttgtcccttggtgtctggcttctttcaccgagcataatgtccccaagtttcctccatgttgtagcaggtgtcaccacgtccttcctttttcagcctcaagaatattccagtttaacctttgaaagcctccattgcctcttctgtaaaatcggatcagtaggccatttttcaaaggttgttgtgaggatttaataaaatcaggtaaagcaacagacagcgcccagcgcagtgctttgagccatgataaaaattaatttagcctccttctcttccctttctaaatgataagttacatgaagaccaggtgcaagaaaaatgcctttctcatgtccgtggttcctgaagtcacacatttgtgagtgctcagtaattaatattatttttaactgaattggataatcttcttatttagcaagttagagattaactcccagagtcccagtattgtaaaaataaaaatgttacattcacattttcccgctatttttcccctatagattaaaaaaaaaaaaacagaaaggaaataatagcagactttgtcactcaggaaaagaaagagttgacttaagacaatgtgggtctgggcgcagtggctcacgcctgtaatcccagcactttgggaggccgaggcaggcggatcatgaggtcaggagttcgagagcagcctggccaatatggtgaaacactgtctctactaaaaatataaaaatttagccaggtgcggtggtacgtgcctgttgtcccagttacttgggaggctgaggcaggagaatctcttaaacccaggaggtggaggttgcagtgagcctggatcatgccactgcactccagcctatgcgatagaaagagactcctcaaaaaaaaaaaaaaagagtgtggggtaggatctccaactgcttaggcgagagaggaggttaaacagtcatcacacaaattcagattctaagggcaggtgaatgaatagaaccaataagtgaagacccagtttccagttatctccatttatcaatgtccttggcctaagtcaattagagttaatcactgtggagttaattacagtgtctctccttgccgttaacaatatattctgtggtcatcgcattattagaatgggcaaattggttcttcagttgacagtgtgaccaggtcattaaacagacaaatctccccgatgaaaaaccttgagcgatgttgattttggtggaaacataaagccatccacaaaccatcctttccaggatggatgtcaggtagtgggaattaagctcaaaactgtgactcacaaacagtttaacttccttcaggttgattttccccgttggtaaaattcccatgaatattctacataaccctttgattcttccaacatcgtttttcccaaacatctttcctgagagctcttcaaaagatggtaaaggtaccatagtaagatacatgatgtaatgaacttgacctcgctgaggggaaaatggccatggtagcctgcttggaagaaatatgcaaaccatctgagaaagagacagctctctcagtgtcgtggggttggaggtcatgtctttccttttcacaacaggaagggctggcaccttctgctctttcggtcctgacaactgtctgctcagagcatcagccaaacaaggccytgtcatcccagccaggaaggatgcgcggtgcatgggagtggcaggacatttgtggaaggagtacagccgaccccccagtttcctccagtccttgtccccaggctggggttccttccagcacttgcagttcagccctgctcagcgtgtttctctggaaaacagaaccgtgggccttgtcagcaacctgctgtgtgagttgggttgtgtgtttgatcatcgaggacagtgtttcagcatctggaggtgtgtgtttgctttccttaggtaaccacaaagtagtggttagcgtctctctaattgataagggtgacagaagctgctgctggctttagaatgatgcctgaactcttcttctgaaaatgaatgtggttaatttagtcatgacagacacatttctgacttcttcctccctccttttttccccaacgccacctttccccatggtgttgtgtttttgcttttgtttttgtttttgttttcctctgtctggagactgaaagagaccagactgcgctcagctgaaagctaagggaagcctgtgctgctccgccagggctgagtattttgttttcagctccgcgaactccacctgtgtgactttttcttcctttctttttaaaagtaaacatggcaggatgtgtgctcaccaattactgagcgcacagaaatacaggaactgctgggctaacgaacacgacttcaaaggacagtggtgaggagcccttgcctccctgccaggcttgaaagggctgagctctccagggagggcagggcccaccctcagggctccaccaaaatagtgacttcccagcctgtgactttcttagagccctgaggaaggactcaacgcagggaaaggacgtgatggcagtggggattccctcttgctttgagcccttctgaatgcaagcagaaaaagaaacccttttatattactttttaattgamtataataacagaaacaatgaaaagaatgtgaccttgactttgcaactctatttcccaggcatattcctaacaacacctaagaaagctaggatgtaggtagcttttatcaccttcgttctttttaggtaatgagttagaagcacaaagcaggcaagagacctcgtaacgtcaaatttaatattaagctgatcttctgatggcccaggacatacccctgggtgctagaatctaacacggagacatggatggtgacgggtacctagtgatccagctgttgaactacacacaattctgctgttgtccccgagggagaactgttcactctgaagctgcagatgctgtgttatagggtgttaaagtctctacagtttctatcaatgctgttgcattcatgttttattgcttctgccaaaatacragtatttcaaggatgaagttcatgttctcccaccagctcttgtctaaaatccatgctcaatgagtatttactgtatgcaggttattactgaagagaggacttatgtgttcttcccatgacatcagaatgcaaggatatttctccaagagagcaggcttctatctgcaaatgcattcacctgaggatagtggtgagacagccactgagcctggcaagtcagcaccactccaggttgttgggctgaaaatagactagagagagtaatctctaggccctcattttataggcaaagaagctgaaacccacagagggtaagcagtttccccatgtttactctgtccttcattgagctttgtattggcttcgttgctcttagtgaaaacacaaggactggccacagttagagccggggtccatgtgtgcatcccaggcttctgcctctgacagagttgaggaacgtgttgagaaggtgtggttgctttccttgaccttaaacttaaatagcgcagaattgctttgggctcagcgttttaatcatgtcacataaaaatcagatgctatccacagagaagaaaaaaaatcatttgaaatgtgcatatgaatatttattagagaaagagtaaagagtagatattacttcatatggaaacgaggaggcttggaggtggctttaatatgcagcatcagtaagaatcaatgcaaagagaatgctatctagcaattttaaatgttcactcaaagagaaatgggcttgaattatagcaggaggattcctgtttagttgttaaaaaaaagataaaaagtaatcagtaggtctcaacatggacttactaaattcatgccagattcacctagtttccatttttgtagagtccccagactaatgaattattagaccagtgagagaacatgatttcaatgagatatctaacaaaatggctcataacactcctattagaaacgtgaaaagtacctagtgggcacctagggggcaacaattccttcagatccaggaaaagggggtctttaggggcaggtcatagaattcggtactggattctgccctagtcatcagcatttctagaaataaatgtccttaagatttagaagttaggccagatttatagcagaccacacaaaactcaaagggtcagtagaatgcagaatcaaaatgatcatgtagactgaaaaactaggccaacgccaaattcagatctgactttggcaaaagcctttacgcagagtcaacagcttaactggtccagggccaggtggggaaatcatgagaacattatgatgaacaggacwccggggttttagttagttgacatttctatctgagttggcagtagaatgtaacgtctgcaaaagtcagttcattcatggtctgcatttatggaccttcagtgcatctagaacttttaccttctgcttatcaaatagtatctggaaatactgattattctggatmtgcattgtaatgatattgacactcatgaaaagatgctcaacacccttcctyagtagggaaatacaacacaaatcaataagctctgcttcacacccattaggatggctattaccaaaaaaagggaaggtggtgttggtgaggctgtgaagatgtgggaccttcttgaattgctggtggacatgtgaagtggtacagactctgaggaaaacagtgcagtgattcctcaaaaagttaaacagagttaccacatgatctagcaattccattcctgggtattctcaaaatagttgaaaatgaggactgagatacttgtacactaaactccgtggcagcattattcaccatggccaaaaactagaaacagcccaaatgttcatcagcagargaacaaacaaacaaaatggggcatattcatacaatggaatatcactcatccttaaaaaggcatgaaactttctgacacctgctacgacacagatgaaccttaaaaacatgatgctaagtgagatgatccagaaacaaaggacaaatacgctaagactccacttatacgaggttcctagagtagtcaaatttataggcatagaaagtagacgagcagttatcaggggctggtgagtgggaggaatggggcgttagtgttgaatggggacagagtttgagtttgggaagataaaatagttctggagatggatggtggtgatggttgcacaacaatgtgaatgtatgaatgtcactgaactatacaattaaaaatggctagcatgatacattttatattgtatatattttaccacaataaaaaggttattaaacatagactgagtatcctggcagcaagaactagtacaaaaagcaaactgacaaactttgtgtgtctgggcaaagatgatcaagaccataggtctagaaactctgacaaagaaagataactaaaggaatttagttatcatttactgtcaagaagaacaggcagaagagggtgctggccacccttaattagttgaagggatttcctgtggcagaggcattacatgaattccacttattcagagtaaccagagggcagaatcaggaccaatggaagaaattatatccaaggaggtaaatttcagtgcaggaaagaactttcagccaattagaactatattttgaaaagaagcaggggcactgctaaatgcacaactgagtgttcacagtatactcaagaaagacattttatgcaatttgtgatgcagagtgctgcgctgatgagttctctaaagcagcggtccctaacctttttggcaccagggaccagttttgtagaagcctatttttccacagactggggtggggaatggtttcaggatgattcaagcacattacattaattgtccactctatttctattattattacattgtaacatataatgaaataattacaactcaccatcatgtagaatgagtgggagccctgagcttgttttcctgcaactagatggtcccatctgggggtaatgggagacagtgacaggtcctcaggcattagattctcataaggagtgtgcaacctagatctctcacttgcgcagttcatgatagggtttctgctcctgtgaaactctaatgctgtggctgatctgacaggaggcggggctcaggcaggaacggtcactcaccgcctgctgtgcaccccagttcctaacaggccacggaccaccactggtccatggcctgggggctggaggacccctgctctaaagggtcaacataggtgaatttagaaaagtcagcatcctccaagttctcagaaacattctccgattcactgatgagtcgtgaaaatatagtgaggcagaatgttagggccaacagaaaggaaagtagggctctagggattacagtcaccaaggtttctacccttgtgcaagagaaccatcrcttaatacttagtcatgtcattttcaattattaaaaataaattcatcacgcctgtaatcccagtactttgggaggctgagatgggcagattgcctgagckcaggaattcaagaccagcmtgggcaacatggtaaaaccccatctctactaaaatacaaaaaattagctgggcgtggtggggcgcacctgtagtcccagctactccggagggtgaggcaggagaattgcttgaacctgggaggtggaggttgcagtgaactgggtgacagagcgagactccatctacaaaataaataaatgaataaataaattcaaagtccttcatttctagagagtatggaaataggtaaaagtcaacagcttaaaatctgaactaggaaaatcagtcttattccaactccgactttccagagtccatgaccagctggcactaggacaactctggcagacttatgtcactttggtgacgtcaatgtgacatcacagccaagcaaggaaaggcccccattatcttagtgccgactagatgttctaaaggcaggaggagccagggagggggcatcttggtttgaaaaagcttttccccatgtccttcaaactgagccatgcctatgatagatttgaaatgcagcttttgtcgtgacatttcccaatggaacagcttctgtaaaacgtttcctctctctctgctaagaggtcattcctgtctggaatgcctccagtacaaaactagccttgcttctttagcttccccgaggtccagcaaggaaagacctgaaattggttatgaacaggttggcccaggctggcatacccgtcttctgacaatgccgcctccaagctcacccacctccaggctccagtcctggcagcaatgggagttggaccactggaactagcacagtgggcctcaccttagagcaggtactcctgtttctgagcccacagagtgaggcacaatgaagggtgtttcagctggaacagaaggcacatccttggggaagccagcaggagccttggtcccgctttccctgctcctggaggcagtaagccccaagagagcaattcccttccctccttcttttccttcctgttttgcaggaggccagatgttcttttcatgccacttagcttttatttccaaaccatccccggtgaggaagcgctaaactgcagaggcctcggaggaggaagtgcagggaaggggggcgctgtggaagaggaaccagaaaaggggaaagttagcttgccctccctagccctgagtttgcaagtatcaaagtcaaaatgtgtggcttcttttcttggagcaactgagatgaaagtgtctttgagagccccagagaagtgtcagatgaataagatcggtcagtcatcatatctctgcagcaaggaccagcgaagagagctcagtgggagccaaaggtctcctgacgaagatctcaccataaccaactcagccagttgccattaaaaatcctcacagaacagcacttagtttacaggagctcaaagacctgtgaatgctttcagaatagatcccgagaaaggaagaggttctgggcagtgcaatgtcctcaggttagcttctgtggcacctgagttcccgttcccgcagggctggaacaagctgtgcagccttgagcaaaggtcttcacctctctgagcccatttccacatctgtaaagtaaggacaagagaccgacttggatatgtcacaagatggtggcattaaaatggagagatggaacttgaaaacactttgaaaaaacatcggattttgttagtcctcctcatttatttccttaagaggtaaactgaggtatagattaacaaaatggcttattggtttcagtccttttagaacaagatgaaattttattttagaaaacaaagcgagaaataaaaaaaagaatcaccaacttccctgcaagcattcaacaaatgcccatagtataaaaccaacaagaggagtcaaaccgcctcttctgcwtccccaccagccacactccgacacccccactgcgccccatctttctgtccctgatgcttgtcaaattgttccatcgtcagccccaccagagctcatgctactctgagcccctggcttgggagagcgagaactgggatggggaagggtattcttccaaaggcaccgtaggtattgttttgtttctgggagggaaggtggtgcctccagcctctccttcctcttgcagctcgcaagcaaacacagatggaggagatgctctggctgtttttaattctgctttctctcccagggttcttacccagaaaacctattggaatttcaaattttcaaacctcaggaaagtgttgtgtcgggaagatgatttggggttgttttgtgctatcagctgtggggctgggacaggacactgaagcccagtaccccatttggatactgctcttcatcctatttttgcctgggagaagaacagggagaactggctggaggaagaggagaaggggagcggaagaagaagagatttttagagcataataataaaatcgtattttactattagaataattttttatcttccagaacatgttttcagttatagccttgtctgcttcttactaaagtcttatgaggtgtgctattcattagtctacaagtctgctgctgtcatagggctcccaagtaacagtgactgaaagaagacagtggacatccctcccatgtcagagcccgggctcaggcagtcaagggcatagccaaggtcatcgccaaggtcactgccaaggtgatttgacaccatcacatccatgttccagccagtggcaagtggctgggcccaccctgggggttatacccctcagcaaagggacattgaaggaatctgtgtctgggaccacccaggctcagtgcaggtgggggattagagccatgggctgcccggaccttcaaatgccctcacaggtgatcatgtttcacacattccattctcctcatcctcctcattccacggacacacacaaacctccccaygcacatctgcttccccagggtcccccttacttcctactgtccccaagggtgacctagaaccaggggtagggcctgactccactgctcagtaggaaggaagagggcttgtgatccactgccatggctgccctagggtggtgctcctagaactccatgtgggaggctgggggcatttcctcatagatcgatggcaaatccacagcagttggtttcgtcagcttaaaatgagtgacagacagactgactttccaaagcatagagcttatttgggaagagcaggggactgtaatcgggatctgtccgctttgatggatctcaggtgcgtctaaagaggcgcggcgaggggagacttcaaaagaccaagaggggaggtggacacgggctgttttgaaacagcgctcagtgcaggaggtggccttggcgcatggctggagacaggcgtgtcaggccggcagcttgtctggaatactttggttttggggaattccttgcctacttccttcgtaacctcccaggtctttttacttggggtttgacataagtgactccattttgatactggtaactttcacattttcatagcaccatttggtactgaaaaaaaaatgtattaatacatatgtggatttaacatcatgggtaacatttctatggaaaaaatgtatattccctcacctaaacaaataacttattagtaaagttataaatttttgctgtttcttaaattgggaatctcccattatgaggattggaggattcttggaaacaggaactatggcttagatacccacaatactttccacatatggaactcctgataagttggtattaggtgaaagagagacttgttaaattaccaaatgttatcaaaactgggcatccgaatggtgccaggtgatacctgggaccaggtgaacagagaggtcttgtagtggaaagaaactagtgtcagagtcagcagaagtgagccaggttacttacaagctcggcagccttggagaaagtgttaatttctgtacacatccatttttcccttctttataatgggaacaattcatcctacttcacaaaattgttaggacttcaaaccgaataaatatatgaaaaacattttccctttttgttacacagaattattttttaaaatttgaattgcacattccaaaaagaactagttaaaatcaactaatatccagtatactgaaagatagcattttactccaaattttttcccactgacagatttttatctttgtaatgagtttatatatatatatatatatctatatatatakatagatatatgtttctatttaacttttaagtatattctgtaaatatctttgtttcaataagtaataagccactggttataaaatattccattatagttacatgccattatatatttaaacaatatcttatttttgaatcttcaggctgtttctagttttattattattaaactgtgctgcaatgaacagtcttgtaagtatattttcttacactttccttatcactttaaagtcatttaatacacayttccttctataaagcttgtagaggtctcttatccaaattgctatggcgagatctgcttcataattcatattttataaaggtaataaagttacatgctgtatattacaaaattttcccaaaaagctatgtactggggaaggatattaagagtcatgttcagtagaataaatagactgtaaagagcttcatgtcagactttggattttgctacaaaattagtttatatcacagaataattattttctatttttagagctttttggcatttggaatcacagagaagggattaaagacctggatgatttacctatcttttatttctagtaaaatggaacttgttttattggcccttgataactttacttttgtaaattgcctgttgttagcctttgcccattttttcattaggggatttgccctttttaatgatatttaaataattaaatattttgccacatattttgcaattatgtctcccagctttacgtgtattaataacacacaagttttatgtaaaatagtttggaaatgtttacctttktggggcttgtctgtgggatcatatctaagaagtcattcctaattccaagagggcataattattgatctatgttacctagtacttttagtggtttagcagttttatttctggatgaatatcttcaatctgtctgaatttagtattatattagctttaatgtaggttttagctggtagacacagtctcattcattaagcaatctttccctttcccgttgagtttaaataccatcttctttaaacacaaaacttttatatgtaattggatctgtttctggacattctgttttgttccggtaacctgtccatctcttttgctgccagaaccacattattcccattataatatctttattttaatacctattagggctgggagaaggaaggatgaagagacagagggcatttttagggcagtgaaacttctgtgtgatccactgtaatggtggatccatctcattatccatagaatgtacagcktcaggagtgaacccaggccaggcacagtggctcgtgcctgtaatcctagcactttgggaggctgaggcgggtggatcacctgaggtcaggagttcaagactagcytggccaacgtggtgaaaccccgtctccactaaaatacaaaaattagccaggcatgatggtgggtgcctgtaatcccagctactcgggaggctgagacaggagaatcgcttgaactcgggagatggtggttgcagtgagccgagatcrtgccactgcactccagcctgggcagctgagcaagactccatctcaaaaaaatagaagagtgaacctgaggttcacttatggactttgggtgataataacatgcaaatgtagactcatccccagctctggtgggggatgttgataatgggaggagctctgcatctgtaggcacaggggttaagtgggaattctctgtaccttcttattttactgtgaacctaaaactgctctaaaaaataaaacctattttttaaaaaaacaaaatctaaacattacttttgaagtcatagagcttagattcaggggggaatatgaaaaaaatagaaaattagaatagattgcaatttagcaagtattgcagtaaaacaggatccacagaatagtgcttctttaactctgtggtaaagggccagtgaagaaataaattaccaatatctcttagatttagcagcctcttagttattctcatctttgaaaagctatttgtaaactgtaaagtgctcttgcctattagttatttgccactaatctataatggactccttttaaaaatgaaggtattcactccatctaccttctgctctggagaataatgaaattgcagttaaaaaatgctgtcatgttctcttgagagattggtgtcttgtaagaacaggctgaagtacgtttcagacaagattgggtgcagtcggggtgggatgactgtagactgaagcacatgtcaagattgggtgcattcggggtgggatgactgtagactgaagcacatgtcaagattgggtgcagtcggggtgggatgactgtagaccgaagcacatttcaagcaatgtctcttgtcacaaaataatctgaatggctcaggacaaattcaccaagtaaagtagaagcttgacatttgccaactatgtatcccataaccaagtactgtttttaaaccatgtttttcttaaagaagctaagcttttaatctcttcatattatatgcatatgatgaatatagaaaagccccttttaaagtatgaagaatgagcatttcacccggccactggctgattgaatgccagctactgcactggatgctgctacactgctcagaaatcagtacaagtcacaagcattaagtctgatagggtccgacatctggccgattaaacaatccttcggcatatgtaatattaatactctgtgcatgagcaaatccaatcacctattcaaatcagatcctcactgagtgatgcctggaagagtcaaacactggcccggccaaaagaggaccgagggaggcgctgggagaactggctcctaatcccttcctgctgctaattaggtagatagctttgatcactcaccttaattttctgagcctcagttctctcttctgttacatgagagggcagaccacgagatcaataagggcactttcagctttcaaaatgaaaaaaacaaaaaaacaaaaaacagatccactaactgatttatttcctgtcttattataatggattcatccatttacttattccaaagatgcttattatgaacatcttacatggtcaattcctgtgccacgtgtggtccctaaatgagaagggaatatgggaaagagagagagacagagtccctcaatctaccttcttccattctctgggtggggccagaattcactgaacatgaggaagtgatgagaagtggtgaggaatgggttggggagatattctcggcattgccatttatttagaacagggtttctcagcctcmgcactattggttttgggggggtgcttgggggactagcctgtcatcgtaggttgttgagctgtatctctgacctcaccctactagataccagaagcacaccctcccgccatttgtgacaaccaaaaatatctgtctccagacattgccaaatgttgctcagaggagcaacatcaccctctgagaaccactgatttagaaccaccaggcactgtgctggattctgagcaaatagaaacgagaaagctgctggcctggcctggtggagctgactccagggcagctttgcgaacttcaatatgcatccgttccctggcggccttgctaaagctccatcctcaccccagagcttctcacccagcagctctgggtggggctgcaggatttgcatttttaaagaggtctcagggatgctgatgttgctgtttctccaggaccatctctgagaaccatgtgggctccaccctgctgacaggtgagagtacagatgtccttttctcacatcataaaacaacttaatagttttctgaattcagaaattaggcctccagtggatactcagcctacagtaactctgaaacgtcacagtgaggaggaaaaatagagagtcccgtaagctagaacaatgccaatgggtggtcagtttcatatattccttttggctcctttctgaattagcagatgaacggtcagtgaaggggctggcctaggaacctaagtattacctaattttagagtttctgtggattctaaaccccaaacaactgcagccaagtttttacgacacttgcatttgtaagctggcgacgtttctgactgcaactggatgtgagcaattcacattgccctaaacgcatgcatctgcccagatagacccagctctttctttctgcactttctttctcttcccccggtgcccttccctagtccaccctgtccctctatttgcaacaaccccccctgtgactgtgatagcccagtcccccgttgccgggcagagccggcacatgcgggcttccgtagagtattctctataaaactgttagctcactgcggactgagcactgctgcttccgcttgctgtattgatactaccaaatacygtattttctttgaaaagtgtcacacgcccgcgggaggaagtggggtgtggtgtcacagcagcataggaggacaggagtgtttttgctactggtgtacccaagggcgacagctcactttgccatttcttgctctgactctgacaccaagttcatgggaaccagccatgtctctattcatgggatcaaaggttaagaaagtggagcccaggctctcgaaggctccttctctgaccgcgccctaggaaggagaggtttgccccatacctaccccatgatgtgttgagaacatgaccctgtcccatatgcatatccagtgcagtgctttgcaatatagtaggcagatattccaaatgcttcgtgactaacagcaaaaaacaaatgtgtgtgtcacttcatccccttggcaagtggttcagaggtgttctgggccatgtctgatgacccatgaaacaagttcctatggtattttcatgagggagaatttctaaggatgttttagaaaagtgtggtgtgatcatcgtagccatcttttccaccaaacactgtcatacgcattttccatggattaattcattaaatcatcacaacacagacatagacccaatccttcatagaccctgatgaagtgggtccattatataccttgttttgcagatatgataatgtagtcacagaaagattaagtcacttgtccaagactgtacagcttggaaactgatagagctggcctatactccatgacaccaacatttacaaactgcaagctccttcacatgttaactccttcctgggtctctgtgcctttttgaactcggccatgcaaaggttcgagaatggcaaagcctcatgcccaggggcttcagatccccttctcagtctaggtaccctttgaccagagcacctgagtccctggccccaacttgacgcccctgttttgggtggtgtgctcttcctcactgagcacctacatgacaggaagaaatgtcaggaggactgcaagggatccagcatctcagttagagctgctgggtcacaagatggtagagtcagagagaaggttgtcttttcagagtaaattttgacacaagaagcagagtcctacatttccatttactcctacagaaggcagcatctttgtgtctagtaagtgattatcctaaccatggttagaaaatgatgccagggaggctgagttcctcccaactttatctgatgaagttagcttctttctagactttgtccatagaaatcctcattgatcccaatcagccacttctaaaggcatgaatggcagaagcttggagggaattgcacaggcttatgacatgctgagaaaattacccagataggcacaggcgccctgacatccagaagagaacttagggtattccgagaaactccatctctgtttatatcacccaattcttcattcttcaaaccacagccatggagtagaaagaaagatcattaagccccaggtacaaggagaaacatcctaatagtgcttaagataattaagcaagttgccaggaaagcctgtccctacagtcataacatgtcctttgcaagtagggacaggtgggagcagacagaaacagtctacagcgaaaactctatgcattcatgtcctccctgacctaaccttcaaagacatttgctaacaagaaataacgtattagtttgggtggagacacttagccaccaaagctgggttcaggtgctgttgcttactcactgtgagtcctttgcacagttttgtgggttgtgggagatccaacacataagccctcttggctatgcttgtgcttagaacaaacggagaggcagatcaggagacagggagatggagaagcatgtccaccagttataacaaaggccagatcgatggagatggctaaaacgttcaggcaaataagttggtcgtctgttcacagcgtcccaggcgatgctggactgtgtcagggaccctctcacccctgccaaccgaggaggatgcgcccccaccccaccccagcctatgacatggccaaggatagtgcagaaatggttctgcagatcagcagatcctgcaacatgagaagaggagggtggagatgggtgggaacggtttattcatgtagaacatgttaaccaaaaaatgagtgactgaggcaagtttctctatcagttgaggtttattgagctaaagtttgaggacacacccgggaaaaacaccagccccagaagcacctgtgacctgtgctttccaaagagggttttaggaactcagtgcttaaggagagggggcaagcaggagggaagagggaggagggaggcagtgaggctctaattagcgcttaccaaatccatgtcttacataagataaggtaaatgtgtgagaacagggagcagaggaacaaatccattatgcacctgcctcagagtcaggagaagagtgactgatctcagctggcccttcttctgtacctgggaagatgagcttgaaatcaacattgtcagttgagttcctaaaacagaactcagttttagaagttaagcttaggttgcagtcctagggttgcaatcggcataggcttgttttgtaggggaatgtggatcctgaaggatttaggggccagaaaggaatttcctcgtaagcagtgtgtgacggtggccatctgggagaagctcggggccttttgtcattgtgggagcctggcttacgtagaatgctgtgacacagggttgtgaagtgaccgctgtctcctggggaaaaagaatggcacggtggcaggacttggcttccaggcttacctctccccttggcataactggtttggggggcctgagattttattttcttttacaaacgtatccatcagatcaatcactcttcttcctggggtacagggatgaggagtgaggataggttagagggatgcaagcctctctgtttgaaaacacagggagggaaaatatgagccttctcataatgaccatgattagcaactgctcggtaagtgatgggtgctgttgtcctcataaccaacatcatcatcattacagtttttatatcttttactgactgctgttttctagatatggaaattatatgacatagacctcaaatatctagtcccatgattcccaataagtacccacttgcccaagaagtttcagtacctggctgctgaaaatacaacttttacatccttagttcatgtgtcttaattcttgattcagaaaagctatcaactgtattctccatatctcaaagttaacgtgtccaaaataaaatgtctcatcttctcatgccatctagttcttcccgcagtgctcccatcttgtgaatggggatggcctcctaccatgggttggggccccaaaccttgaggccgccctgctcctccttttccctcccctcatcttcagtggcttggtacatcccatcaagagatatcggaatccctgcacgctgccagggtccttctgctggtgccctccgaccatcaactggaagagtgaagtcgcccccagtagtctctcttcttctgcacttgctccttacagtcctctcaacacagggaccagggtaccccctttctaggtgtaaataagtctgctctgcactcaaagctgaagacagcacgtagacccctcgggcggtgtcctacctgaactccaagttctcaccatggcctgtggacagccccatgggcacacccacctcgtctgtcttctctaccccttgctcaactccacgcagcccatccsccttcccagaacgtgcttggcagctccgacctcacacccatgtttcggccgggaacgttcacctgccattgtctgtgtgactcagtcctctcctcgtgcaggtctttactcaacgtcatttcacagagacccttcaggaccagcaaagccctccctgccgccccacccagcactccccacctccctcctctgcttagtttgtttcatgggagtcacctggtgtatttcatattatattcttctgctttcttgtctgtctcgtgcatctggacctctgcacaaaggatgggttttgtctctttggctgactgcagtgtcctaagacacttagtgcctagtagctctagtaactgtttgttgaatgaatgaatgagtgaatggatgcatagtcactaaatcagaaatcgtggataytgtaatcatagaacattaggtcataaataccaaggatcctgaggaagaaraagaaagaatatctatgatttggacagccatttttccaattgtggaacattgtttagcatttcaaataatgaaaataaacacatatagaaggcttactatgtgctgggcattgttctgttttatacatattaactcgtttaatctgtgcaatgcacgtaggagtttatggagtttcctcataccttatctcattcagttcccaaaataataccagcagattgtgggtgattacaacattttcaaggattcttccccagggcagctgcttgtgggagagctgaggtctagaaaggaggagttgagagcaggaaaggaaccaagsctgaccccacccccatgccagcattttgatttatggaaccctgggagaagagtttctccaaaatgatacttcatggcctccagcagatccccctcaaagaaaccaacctgggaatgaccctctgtgtggagatcaaggaggaaagaggcaagtgagcctttcttttctcctgctcgtggacttagagtaagagtgtctgggacatccaggtatatactatttccatttttccttttgacatcttcgatgatcaagatacctgctaaggatttgttcagaaatcagaattagttgtaaggcagttgcctgaacaactgaaagygtaatgaccccacagagagcactaaggcaacagaaagtacggcgaggtgggattattaggttggtgcaaaagtaattgtggtttttgccaatacttttaatggcaaagtttttttaaaaagtatttttagtagaggcagggtttagccatgttgatcaggctggtcttgaactcctgacctcaggtgatccgcctgtcttggcctcccaaaattctgggattacaggcatgagccaccatgcccagcytttttttaaatttccattacttttaatggcaaaaactgcaaattactttcacaccaaattaataggatatttgatgagttttaatataattatcgtttttaccacaattgaccttcccctactcttaccctcaaaaaaaaaaaaaaagaacttaaaataaatccatagtcatttcaaaagtgacttcaataattttaaagtcattagttgttgggactctgaaaatgtaggaatcctgttatgcatgacagatttccacggtgggcaacagtcacctagcacrtgcctggtagttcagctgtaatgtgggctaaaagctgatggaaagcctaacccctttttaaacagtatttctatgactggctgaactccgtggtggatggcaaggctgtgtcctacatcagtgagagcctgcccgctgcagccaggaggcacctcacagagactggaagcacagagggaggtgggccagctggggcccgaggatccagacttggtgagactcacagaccttggcccactrccctcctccctcctccctcctcacccacttttctcccttcttcacatcagtactggtggcagcaccctgagctgaaggagaaaagttcatattcaacatcagaagttattttatttgtatgtcgctttggtgagagctctgtcctgtaagaggggacctttctcatctaggagaaagtctacccgtacctgtccccatctgagctattaattctatagattctggaaggagaaaaatgaaagtgaaaagtaggtaagaagaaagcatggcagacatgcgcttggaatacggctgaagacggtagatgtggcaggtggtaggatgctgtggaaagggactgaaatctgaggcctgagtttgaattcaggccctccaagcactttgtaaccataggcaagtcacctaaacttgctgagccccagccataaaatctataaattaataagatggagataactaccatagttgtcctgtccacctgacagctactggaagggtttatggagataacataagtcaaagtgtctatgagagttcattacaataattaatgtgatgactatttttaatattattaggtgagtaactagtaacacccactctttctcataggattttttaaggacctcatgaagcatgagaaagattttgaaagatggtaattgtgcttgggtggagatggcagagctcagaaacagaaggaatggcgtgaacagagccatagagacagatattcagggaaccttcagcaaatcragagaagtccaggcaggctgggactccgctgagagtcgtgctgtgtgaaggaggcaacttgaacccaataaacggaggctttttaataacaggttaagaagctgggactccactgagagtcgtgctgtgtgaagggggcaacttgaactcaatacacggaggcttttaaataacaggttaagaattaggctttaactcaacaaacactgggacagctttcttaagtaacagtgtaacttgaccagggctatgccttagtgggactatctattcatgtaacctattaaaatttgtgtcagaagattaataatgtcatcccaggtgttttattttctatatttcaaggtttaacttcaacactattgttggttttttgggggaaagtgcagagtgttgttaatgttggcaggcaggagggcaacacttggtctgtccacgaagcctccttcatctctagttctgactgagggttgactgttagccttcggtttcctttgtcactgtattgtaggggttattttaaaatattatcttcaatttatactttattattattatcattattttgaaaagggtcttgctttgtcgcccaggctggagtacagtggtgcaatcacagctcactgcagcctcgacatcctgggctcaagtgatccttccactttggcctcccgagtagccggaactataggtgtgtgccaccatgcccagctaattaaaaaaagaaaaaatagagacagggtcttgcattgttcctgaggctggtctcaaactcctaggctcaagtgatcctcccacctcaacctcccaaagtgctgggattacaggcataagctactgcacctggcccatacttactattttaattcacttttgagaycatttttgttggtgaaagctaatatttaatctctttattatactacttagtagaagtcttagcaacaaagcaaaacgctacccaactatgtgattttttttttactagttatcatctttcttctgtgcacattgtgaaaaagtttttttttatgtttcttttaacagcagtcacttttacctaagaaayctttctatctcataaagaaatgcaaaagctattggtgtagcttaatttgccaaaatttttctgaattgatgtttaccaaatttggctgagcagatgtaattggaaaccattgaatgctttgtttctcattcccaratttactattgattaatctgtgttctttcttccacatgtgagaggttttgatacaagtgatgactattgttattttaattctgtgagactctcccccaacactgagccatctcccactaaattatagtaatacaaatgctgtccaaacattttattaaatgaagaagtttgctatttcttatttcatttgctactgargaagagaatgcttgatatttttttcaattgatgagagtatattatacttctattgctttctatttatatggaatttgtccccatcaggttcagttatgtggacatcctcagcatctctataaacgcattctgggagtttgaattgtggagggtgaatcagcctagctaaataggtgagtcagtgtccagagaatcaaaagaccagaattctcagttcagtacataatagcgtgtgacctaaagcactgagcaattatacttgatcatgtacctgcatcgaagctacacacaaaagacaaatgagatcacacttaaagctgaaaatagtgagcctctaagagtaaagatcctttgtaattttaaagtacataggggccgggcgcgatggctcactcytgtaatcccggcactttgggaggccaaggcggatggatcacctgaggtcaggagttcaagaccagcctagccagcatggtgaaacccagtctctactaaaaatacaaaacttagccgggcgtggtggcacgcacctgtaatcccgctactcgggaggttgaggcagaagaatcgcttgaacccaggaggcaaaggttgcagtgagccaagatcgtgccattgcactccagcctgggcaacagggcgagactccgtctcaaaaaaataaataaataaataaataaataaataaataaataaataacataacataacatcacataacataacatagtacatatcatgatggtgttttgcagctggggtagcaaaagcttggaagattggatggacatacctgatatccatcatgataatgactgcatccagatgaggacatcagagggtagtaagtgctctgcaagagatagatggagggttttgtgggagctccgtagcagagtgcagaggaaggtcacataatttaacccagatatgctcctgaaagactatttctactttcctcctgctctttttggtacacaccaatgaagttgagaaggcccattagaaaatatatcagagttgtaataataataactaacatttattgagcatttactttgagccagccccattctaagcaccttgtgtgtatttgcccatttaatcctcatggctctttgggatgagtaatagtattatcagtgatttccaaatgagaaagcaggcttagagagtttaaataactccagcagttcagtgtatgagggcatcgatcttttgtttacaacaagtgctgggctgaatcctttgctcttgactccctctgtaattgtctgtcacttaatttgaccattgtattctcttgcaagtaaaacaaatgcatgagatgaagagatttggtaaaatgttgcttttgaaaatgaactccctaagcaaaaatgcagagtctctagcatatatcagacagggggatcagctctggaggcacatagatgatgaagtcatggccccttctctcggaattgttgaggaagacagacgtgaacccataaatccaactgcacattgtagggaaatacagcagcatgggcgctggcactctgtctcttcccctatcccacaagctgaccacatctccaaaggaatgtgatcacaaagggaaattgtttatcttcactggggatgagggaagtaaggcacccaaatgcactcgttctgaggagtttttgctgaatgtattgcagatgagaccagagagamttgtgtagttggagtcaaacccctcttctgagtgtatgtagcatctcaagaatcaagtaggcgacatcctggtggggctctataagtccccacattagagggctgagagctgggagccacaggatcaaccccactcggactgtagaaatggcaggtgtgacgcaaatcaatatgacaggtgctgtctagcagtgcactcagagaactgcaggagccagggctgagaacttcccatggagatgtgttgatgggagggctctagaggaggggaaggaaggcttccaagaggagctagagactgaacaggaacttgaaagatgaggaagggggcagggaggatggagtgaaacagggaggcgttccagggagaggttgcagctttcctagaaggctgaagctgtgaaacacatggcacattggagaaacagcagcagttttgcaagatcctaagatcattcaggctggagcatggagattggatggagactgagaggtgaccaaggctggacagaggaggcagggtaagaagctgctgtgagtcacaagagaggtggtgcagaatcggtggagcaggagatgaagcaagtgggtcgtgaggcacaaggggaagggtaaagttgaagcagcgggtgagggcygggcgtcgcggcacccagcaccgagctggcaaaatgaaggaaraggcaagtttgaaagggaaggcagggagttctgtatgggacctggtgagtttggggtccccttggagatttccaggagagagtcgaatgcgtgactttattgctcagacaaggggtctatggggggacctagcccctgccttgttcggaacagcctggccagtcagtcttcttgtgcatagattgttgtcataaagtatgagactaccatgtgttacacaatagaccaccaggatggctgaacagtagaaaagaactttattggcaatatcagtttgcacaccgggaagagacagtctttggcgtgtatggaaggtgctctctcttcaaagagggaaagtgcaggctggttttatgcctcccaggttccatattacacaatagagtcagatatattcagaaagctttggggaaaaatctatacatatttatgaggggagttaagtgcaggtgccaggggtaaacatatgtccaacatacatcccatgttcactttggrgcacagttgtagcattaaaattagatcctaaatttggctctttacatcaaaaggcaaatgataggacacaatgacatttagtgtgcagcacctgtaagctgctgaaactggcttggggtctgcatttgcttatcrrgaaagaatgcctggaagcctggttccctgtccaatcagagttgcaggggtctgggttgtaaatcagagttaggaagagtctcaaacttcgcctgattattcttgttattagggagactaacaagggtgtggcttttcctgtagctgtaggaatttaggaggttgtgatgccagccaagccctgaatcctcgacccctgggtaacttttgtttctttaaccttagaatccatcttagctgatgaaggggcaactgtcttggtctctcagatcacacgtgaatggagagtgaagatgagaccgactgaaatttagagtkcacagaggacagatcacacagcttagtcctgaggcaggctattccagcacatatttttgtctacagaaactctcatttctggttaaacacccagggaaatccccttccccctactatctgctccgaacaccaaaaggcaacccatgaaaatcttttatgttaatttctttcttgtgtattcattacacatcttcttggctcttaatatagatggatagatacgcatatttttacatccacacatatacatacataaacacacacatatatacttacatatacacaggtgtgtatatctgttaaatgtggtaatttacatacccagcagcattgtatgaaagtgtatgattcattttgtccttaccaacattaagtaatagcatttcaaaaatatttgataattgcatgggcaaaaacatattattgtttttattatatatttttcttttcttttcttttctttttttaagacagagtcttgctctgttgcctaggctggagtgcaatgacatgatcttggctctctgcaacctctgcagggagcmaagcgattcccctgcctcagcctccagagtcgctgggattacaggtgccccccaccatgcctggctaattgctgtatttttgtagagagggggtttcaccatgttggccaggatggtctggaactcctgacctcaagtgatctcctcgccttggcttcccaaagtgctgggattacaggcatgagccaccatgcccagactattttattatatattttaaatattataattctttttacagcttaaattaggacttaaaatgttaatttttcctcaaataaaatgcattattaatttctaatgttattttattctcagctgtgtttgcctaactgcaaatgttcaaaagagcttaaataccacagaaccaaagctattttaattttttaaaagatctgatcatttccctttagtaatttgattactttaagattttaatttaatatgcagctttttcatatatattctttttactttacctctataatctctgtatttataacacatgccttaaaataccaattgcatatatttcttttcttttggtttttgaattatcatacagtaaaattgacttttgscttggtgtagttctgtgaatttaagtctagacttctgtgaccactagaacaatcaagccggagaacagttctgtctttccccaaaatttgctcatgctgctcctccctgctgcaactcctggcaaccactgatgtttttcttcatatagttttgtcttttcaggaatggtacatgcaattacatagtatcttattctgcatgtcttaaattgctcacctggctaaacatttttccacaattagttggaactatgatttttgtatcctgtatagcttgtgcctttgcaatttattttcttgggtcataaacagtgcctttcttacaaatttrtatacccatattatgtaagaatggcgtttacttacttctgttacactaaccatagctatttccctgggtaggtctttactgttaagtttggttattttctttaaatgtataagaccttaccaataggaataacacttgataaataatattgtaatactctggtgatccagtctgatgcagtatccctaaatctgggaaaggttgtaaaaaaaaaaaaaaaaaaaaaaaaaaaaaaaaaagatgctatcttaaagatgcatttttttctggcatgtaraagttggaaacagactaaatatgtagctacagactttagtaacgcagatcgtagagctactgtcaataggatgtcatgcaagaatgacaaggaagcctgagaaaatgtcagagaaacttgaaaaaaattttatagtaaaatgttaacttaaaaagccaaatataattccatacccacaggatgatcatagcatgtaagaaaaaaaaaacacaaaacttgctaatttaaaaagactagggaaaatagatcagaatagtaactgatttcttttattggtggaaatctggagagactttttactaactttgtgtgtcttctttatttttcatcatgatcacctaaaaagtgctctgaactacacagagaaaagcactctgtgtagttcgggtgtaaaacgctgccatctgcctgaaaaactcacacctgagcttgcggttctattgaatgatgtgtgaagattaccacacaaatacctattctgtcttctagatgtcaggtgtatgtcaggtcatgtctgacatacatttctaaaggtctgtgagcagacctttacagaatagtgcaagtgaatctggtgaaacggccgtttaatctgcattgcttattaagtaagaaatcattgtctaggaagaccttcagggggacagagggttttgccccaactctcttccttgctgtaatggaagccctggtcaccctggaggtttccatcttctcttcctggggcagcatttcccagacgcctgctgggctactgttgcctgattagaaacccaccctgggaatagcagggtgacaccagaaaaggtcagggtgctttaactctggctttgtgagttagtgatccctctagactcaaacagaattaaggaaatcttcagaaagtcccracagggcaaaaactcccgtaactgaagatgattcttagtgatttttcctgatttgtggagaaatgaagttttgtctaaaagacccaattggcccaggaaagaagggattctcaaagaaactctctccagagaactcacagctgttagccccgctcctgcctgggaattctaaactcacagggcaaagggcgcctcctaaagacaaatttgtaagtcatctacctgctaattcagcaacgtgacagatacggaacccagcaaatcatgatgtttacccaaccrtctcctttagataaaacttccaaactctgcaggaaattaggacttcattaatatctgtgaaattaatgccygtcaaaagctcctaatttgtctctcttgtggagtcaaagaacactggtatttagcatactggagatcccttttgtcttagmtagatgaggtattacaggcccaagatctccaggtatgttactgattctccttccaggtctttattatttcaaatagttttctttctttatacaaaggcagaaaagacaatcaatgctttgtttcttatctttggcttacttatgaaagcttagaaaaaattataagtataaatcatcaaaaagagagacggagcaaggaagtaacttttttgctgaatatcagatgatagtttcagattaatgggacctcggaaaagtaggtaaaaaagaagaggtatctagttcacataagtggccagaacactcaataatggaacaatagatgaagaattagactagattcctggatttgtagctaacactttgataactatcatctaaacctcttggaaagcataattactgatttttgggcttttatgaagtattttgttcatccttatatgagaaagccctattttatagtagtcaattagtttggagttttctacgtggtttgtgatgttcaaaggcttagagtgtgtgtgtgtgtaactgtgaagaaagcagacctttttgaaaatgtccagagtaaataaggatcagctgccgaatgccttgggccaatcccattacacacataaatagaccatgtaagaattttgcggtgtcatatttaactagtgtgactaaaatagactcgctctatataaactcattttctgattactgtgtgctgtttcctgggcacctacttgaataacagaagacataaaatattggaaaacttttgcctcactctccaaccattgggcctaactccattaggttgaatggaactaactcttgagttacttctcaaaagcaaggttgagtgcagacttccagaaagcctctcccctcagcaagtcagtgtgtggttttgggtgagtccagcagtgtcctctgcagaaggggaagtgaaaacatttgttcacatggatagtggacctatgtgaggttctggctrtccatgataaagcactggttaagtagacatggggcaccaaaaataatatcttttatagcccccaaacagcgtttgtcttttgtctttttccagggcgcaaccatgtcgccatttcttcggattggcttgtccaactttgactgcgggtcctgccagtcttgtcagggcgaggctgttaacccttactgtgctgtgctcgtcaaagagtatgtcgaatcaggtaagcttgaggggattttcaaagcgggggaggaggaggagaatcctgctatgaactgtgtatgaagcaaggtcttccaggacatttgacatcatctggtggaaccaaatcctgccatttaggacrctgatgcccagcaaagccaaggacttcctcatggacacacatttcgtgatggactctaaaccaggacccgatggcccaccggtgctctattgcactgtatcatttttcccacatatacaaagggaaagagaaagctgggttgaggaaattacataaggagttaatgggaaggaactctaatgagctgaagtagaacatagccctatgtggttaagcctggttactttaaataagtctaggtagattaagactgcataatcttccaaccaactctaaagactgcttactgctgctttggcraatcttcagtggatattacaaagcatctataattagccattagaatccaaatttcagaaaacgtacttttgcactcactaaggtcttggctgaatgaaagaatagtgatgtttcatcaagttcaaatacaggcagctcaaggtgagggggaaagtgggacagccacccaacgtcctgtttgtgggttcagaatgttccattccaacagtcttatgtgtagggaatgtctctgtggtcacgtcggccggcttccactctccaagatcttcacctctgcattggaagtttgccacggatttccaaaggaaaagtaggagggagtttagatcccacaactctcctgactgcacaccttttcttgtttccctacgtgcattttgattttagcagacactttgtagggaatgataatgatgatggatgcaggcttgcagtaactatggaagccatcacagttcacttacacaaaagtgtttacggagagaccactgcaagagtgctgggaccagagcrtagagggaaaaaaagtcaaacaagtaagctgaaggaactcaggaagactgccttccctttagagcatctattcttgcagaagaaagtggcaataaacaaaaatacaaacagcaggtaatgaaggaacaaaaagcagtgtaaagaagagagggactgggggcagggatgtgtgttattttatatagggttgtcctgcaaaggcctgtgagygagggacatttgcagatacaagaagaaactgactcagactttgagaacctcctgccagatgctcagagttcagattctggggttcccaaacctactattttgcatcccccaccaaaagcctttttgcttcacagctgactttgtccttccagccactctgaacacatcaaagccagagagactgtctgaatcatcttgatttcctttctgcccagagttctctcctgtttagttaaaagtgtgaatgccacttgctcccaacctaaaacctttcagatgtcacagacatctttgaagtgtaaaacgtctgagtttttcaaagccgcctttgacttaatgggtctcctggatccagttctctttaccatctcaggtctccctgacatttgcttcctgagggcttttttttttttttttttgcatttggccttgcctttgaacttggtctaatgagccatgtggatcgagagtccttgtcagaaaagaaggaaactggttttcctaaatattagcctgtggagttggagggagtttagagatttttgcttttgattttattttgggcttgttctgaaaagaaatcactctgaatattatcattcaatatttacttctacaggatttaaacacatttcagttcttggggtgtaaggctgcattttccacaatgagccaacagaacaaggacaaacaggctacggggctgcggggttgtgagtcgttaaaacggtaacactctacatagatagggccctctgtttaggtgattacaaacgtggcgaatgaaaatgtaaaaagtgccttgctttggggacttttgccccttctcagggtatttttggcccttttctccaggcacagagaatggttaccatcaaaaggaagtatcggaaagggaagcttcaggtctgtggaagtaaaatgttaccgtgatcattaatattgccgttggtttctaaaaagcccaatctccagtccaattttttttttaccaacccacaaaaaatgtcccctttctattccacgtttagtagtctcatggtttatgtctttcctagccaagtttatctaacatttgagtttcaagcttattcaactccttgtatacccccgaaataaatattaatttaacaaatgctaaatgtctgctctgtttagctttgtgtgttggacagaaggggccctcgaaagttagaagggctttatttcctggctttaagcagatttttccccttttgcttaatcgacatctctgaattgctaaatctgccacttaatgtgcttatgtcacaagaaacaaacactcaaatgcaggtttctgcttctgaaatgattaaagaataaataccagagaaaatccaatgtgcgtgaaagacaagaaaaaacttcttaattagtaaactctttgccaatcacagagcggctttagggaggtttcccctagactgaccttcctgtctacagatttgttactatttccagggctcctgcctacctgcctttactcacttgcaggctggcagtcggcttcagccttgctggctccatgggtaaagatcagcaccacctctctgacttgctcatcagcttttgctgagggtgcatggtacatgtaaaatgtatcttcacccaagaattagagaaggaaataatggctcattatgttttaaagatcattgtctcttactgtatttatgtcaaatggaaaaaaatgtaaatatttcttaaaggagcattcattatgcgctgaaattacgccactatgtctttcagatgaacacacagtagttttgtattgactatgtttaagctggggccagtgaggttaatcagtcataggatcaacactacagattaataaaggagaatctcaaaggcataaaagattttttaaaaagtttgttgctcaggtgtttaaacccagagtgaagcaactaactgttgaataggaaaataacattttgaaaccaacccaatagtcccatagacagttgtttttggctgattatagaaatggacccttctgatcttaaagcttggaatttacatttgttttatctgagtttcttcctcaagaaaggatccccacacctctcaaaaaaaatattaaagaactgaaactcaccagatcatggcatccagagactgaagcgccaggcccctggttcatcatgattgcttacttacccctcccragttcctgttttctcatacaaagttacatttcttccctgctatataaatccctagttttagttggtcatggagatggacttcagactgagctctcatctcctcggctgcagcacccaactaaagccttcttccttggcaattctcgtcatctcagtcattggctttctgtgcggtgagcagcagaacttagaatgcctggtgttttggtaacaatttccagtccaaggcattagcagattgttgtctgaattatcaacgctggacttataaggttcaatgcatcaccttgcatctggacccggggactgtctcattctgtcccatattgtctctgattgtttatgtgctacttttgtcttcccaacagaattctatatcccagagaacagagggagcaggtgctactgttgagytgractgaattattttccaggcctggctgaaggaataatgagaccttacgtttctgttcctagagaacgggcagatgtatatccagaaaaagcctaccatgtacccaccctgggacagcacttttgatgcccatatcaacaagggaagrgtcatgcagatcattgtgaaaggcaaaaacgtggacctcatctctgaaaccaccgtggagctctactcgctggctgagaggtgcaggaagaacaacgggaagacagaaatatgggtaacrttgcataaagtgtatgcacataagggataagcatgatggtagccgatgactggctcagaactcccatgtcaatctgagggtgtgattacactggcctcrggtcaccaggctccctaccacttcctactggtgatttgataatggcgatggttattctttatgggctgtagaacacattgacatcttcagatctctttgatgcctacatcaaagagatgtagaaagtctcttagactatgataaattatttaaaactgttaaagcaggcttggaatatctcaaattccccttaagtgggggatgagtttttgtctatcaatccagttgtcagtttcattcactttttcagttttgggaagaatatttgtatataaaacttaatcaagatttatgaaacaacaactctaatgctttttaacttagaaattacttgtttaacccagtagactcagaacacgttaagatatcaaaatcttaattttattaaacttcatcaatacacttttaaagtaagtaaaaagctatcagaatgcgagaggatagaacaaagatccatttaatgtttggtcttctctctctatactttgacaattcctacaatttttttcagctgtaatgaacttagcttactttgactaagaagtgcatcatacacaattcatcttagcacaccaagttgtcaaaaacctggattatggtagtaaatatttagaaatgttaaaaggaggagtaaaataatcaaagcgttaaaaaaattccaatgaaaatttctggggcacaaaataaaagaaaatatatcagtaagaaactgcttttacatgatctgaaatccagaaaatgttttcaaatgtttatatcatctgtgccaaaggagagaatcctgactttctgcttcttactttctataactcagatttttaaacatccacccaaaagattttaaactcagattttaagaaatccacccaaaagattttcaagaactcagattttaagaaatcctcccagaagattttcaagtcacaggtttcaaatgggaatgatacaagcctaaaaactaggtttttgtgtcagttttgtatttttgacctaaaaaaatggatgctttttaagaaagtataaaaatctttgctcgtatcactaaagtaatctttagagacaaatatatgccaagattttttttaaaaggtgctcaggcccatgcttagatatgtccagrtaatttagttgggcagtatctactcagcacttgtgtgttggcttgggaaaagggttcctggggccgggtgtggtggctcatgcctgtaatcccagcactttgggaggccaaggtgagcagttcacctgaggtcaggagttcaagaccagcctggccaacatggcgataccctgtctctactaaaaatacaaaaattagccaggcgtggtggcaggtgcctgtaatcccagctacttgggaggctgaggcaggagaatcacttgaacctgggaagcggaggttgcagtgagcctaattattttattaggtagaagcaggaatgggagaaactgaggaagaccagtttatttggtctacctaattttttttttaaagagtcgtcaattccccaattttaaaaatacgattctattcatgtttccttctcaattaatgaaaggataagtcggagggtgagtatctttttgttaagtagtcttcactgataggcaggttgctgttctatttgtatctcttcaagttgcatatgatttcttgcctaggattttgctgatttcatccttaacagacttttctttgcattctaggattatttagacataagcacatggtggcattcagatgctcatttaaccaactagcacattttttgcacttttaagctttggtgggtttttttgttttcttttttatttttttgccaaggttatttcttaatttacttttattttaagagccaacaggttgttgggacttatattttcccttgcttctattggaatctgcttttccaacactaatttctctaaagaaaatgattctctcaaatttgcctttcatgtttctcaacgccgtattgagagacaccttttgttttcccaaggttgtgactgttttcatggttgtctcccattcactccccaaaatgtgctggaatgtggctttctatgggtgctgtttttccagtagctaattggtttaatttcttccatcactactaagtactgaatactgccaaccttgtggtcacctggtgccaattttcattattccatttggaagcaggccccttaccatagctcttccatctccatttttgcctccatctttactccttattcacaagccagagaacaatggtrcatacatgccatgtcaaaagcacttttcttttcattaatctgttgaaactcatatgaaaatttatagttgttgcagcaatgcaagcttattttatcataaaattctcatggcagtaatgctgtgacataggcattgctattatgtctgtttttcagagatttcccaagacttagtgacttgcacaaggtcacataaccagaaaattatttagccacgattcagattcaatcctgagttccacaggacattacttgctatttcttagttactccggctcacgtggataacccatggacataatgaccaataatgaccttcaagtcattctttcttattctttttggtctgttaatggcatagtgggatggtttaatagattaacaacagygctcagcttgtcttgaacttggatttgtcctttcttctccttatgtcactttatgggagatcctacatcatcccttaaaatgacactttgttccgccctcttctacataataatacagtactgaagtatgtatttatatacatttataaattccttcccagatcagtgtaattagaattttctttagtggaccatccaagactttcctaaaaatacaatctctctttgtgaaagagaaaagccatccccattgaatgccctgattaacctagacatgcatcccaggtagaaaagaagacaggggcctggaggcggcctcaaagaggcaggatttatctttccctccaaaagaagagctttttccccaaggaagccagtcccagtgcctgtgattcttttgtcatgatgaagatctgggtctgccctgtgacagtccttcagatacgcagcattacagggcaagaaaaccaaatagaatctgttttaggattttatttcttccttatgtaagtttttctctccaaataaaattaatgaattgctgggatgttttaagaaaagaaaggcgattgtcacggttgctacagtcgtctgatgacaatgagtttgagtacagtggagagtaacaatgattgtattctgtggtggaaatctcctgccatcgtcagtagccagtgatgtcattgaactcagggcttgtttcacattctgactgatgtttctctccttctcccaaccagttagagctgaaacctcaaggccgaatgctaatgaatgcaagatactttctggaaatgagtggcaagtgacatttcttcttcctgtttgggggtgaggagggcatggccttctcctcaaatgcagcttattttacctttgcaattattgtagaagagaatcaggagaaaagagaggcacaaaattgttttaaaattctcagaggtgctcaggcatgactttaaaagacactatctgggccggaaaaacgtagaaatataaaacatttatagcacttgttttaagtgatgtgaatccatatgcccaaagctcttatactctgtctttagtttagtttgggaattcagtctaaatacaaaagactgttgatgtgtggttatgtgtgtacacattgtctatggttaaatgatgtgctctaagaagctaccatattatcagtagaatacaaaataagtaagaagtcaatcaatatattccataaaattagtaacaaaatgctaacacttgaagttagtcacctcaagtccttttaggaacaagaaaaggtgagaaaacacattgctaaagggttttgattccatgttacatgtggactttggccacagaagtgaaatttcccggtacgatgtgctgagacaggctgtcagggctgtgtatgtgaatcaaatccccctacttagaaaatcctaagtcacagcatggacatgtaaacttactgatggtaaattcacttcattttttcctaaattaattttactaccaagaagaagcaagtttaactttatacatttatggtgctttctgagtttcggcttaccatatataattcctccgtgtctaaattcaaacaaatacatcagagaaaacaatattatgaaataatcatagaaaacttgaacactcactagatatttgatgatattgaggcatggtgaattcatcttttaggtgtgataataatattgcggttatgtttctttaaaaggcacactgatcttttacatatatatgctgaaatattttagtaaaaggcgaaagatttattcgatctgaagaaaaaccagtgaatagctgaaatattttagataaaataatatgataccatagttttgcttcaaaataatccaatggtatggggtgtaggatggacagggtgtattgaaagagagtggccatcagttaataattgctgaaactgaatgattgatatatgaaaattgattatagtatttgctcaacttttaggtatatttgaaattttccataataaaatttttttaaaagaaagaaagaattactgagatgggaaaaatgtactctgaaattttatttatttttcctcttggaaggtgtagatatacagtacacatagtacaacttttgagttggctgaaatagagtgattgcaggatatccgaataaccagatttgcataaaatgtgaaagtgctgacctaaataatagtatcaatgatgtttaattccttgaataagagaaatacattcctcccattagtttaaatcatgacccaatgtaaattgaaaaagggtcytgtctgggcatggtggctcatgcctgtaattccagtactttgggaggccgaggtgggcagatcacttgagctcaggagttccagaccaggctaggcaacatggcaaaacccattctctaccaaaaatacaaaaattagccagagttggtggtgcgtgcctgtagtcccagctacttgtgaggctgaggtgggaggatcgcttaagcccaggttattgaggttgcagtgagcagtgatttcaccagtgcactgcagtgtggatgatacagtgaaagaaagaaaggaaagaaaggaaaggaaaggaaggaagggagggaaggaaggaaggaagggagagagagagagggtgagagagaggaaggaaggaaggaaggggaagggaaggagaaagaaagaaagaagaaaagaaagaaaaagaaagaaagaaaaggaaggaaggaaggaggagggagggagggaaggaaggaaggaaggagaaaaagggtccttcaaaagaaagaaagaaggaaggaagaaaggaaggaaggaaagaaagaaagaaaggagaaaaagtgtccttcatcagaatgcaagtatttttggtaaatgattttaagatccctgctttgaaaaacaattccatggatggtccttctattcctgtggaacttaaatattttattagaatgagagagcaaattcaatcgggcaaaaacaatgatattccgtaaacaataatgacataagcctaggaaatgttttaagaataaagctttggccgggcrcggtggctcacgcctgtaatcccagcactttgggaggccgaggcaggtggatccgaggtcaggagaccgagaccatcctggctaacatggtggaaccccgtctctactaaaaatacaaaaaattagccgggtatggcagtgtgtgcctgtagtcccagctactcgggaggctgaggcaggagaatggcatgaacccgggaggcggagcttgcagtgagccaagattgcaccactgcactccagcctgggagacagagtgagacaccatctcaaaaaaaaaaaaagaataaatctttgtaatatttaaaactttttatatctagatccaaattgacactccatctctaaatttttatrtgtcaaaaaaatctaattttaaaaaccaaagttatggaataacctaactagaaaattccttgttgatgacaaggaggagagcattcttttaagaaagctcattattagtataagaaatcgtcttctgaaggattcagaaaagcaaaacgtgttcttctcctcagggaacatatacccagaggtggtacagattagacaattagataaaattataacctaaaccacacaaatactgattaaccaagagatcagtgtgtgttgctttcatttcagtaagttccacagtgtgggcattaaaggttagcaagagttgagttttctaaagaagagggatggccttacaaggaggaaaaagtgaaggcttgagcaagaatatgccttgtgtgagggctgtggggagaacagcctaggtagaccagcaggctcctgctgaaaccagaatgaagagtcagagacagatgttggagggcaagaggagtgcatagtcttgggtcatgctttgaactaatgggaagaatatactttctcttactcaaggaattacacagtattggtctacaaaatttcacttatgttatggagaggtgataaaaatctgttctaagggtgtagctacaggaataaaataaaaggaacartctaaaagaaaatactgttgcagagagatttcatggtagagtagatgaaatatctacagaatgcctgttaagtgtacatagttgaaatgctttataattctttaaaaattaggctgggagcaatggctaatgcctataatcccagcactttgggggccaaggcaggaggatcacttgaatccaggagtttgagaccagcctgggcaatgtagagtgaccccatctctacaagaaaatttaaaaattacctgggtatggtggcacatgcctgtagtcccacctacttgagaggctgaggcaggaggatcacttgagcccatgacttcaaagataaagtgagccaagatagtgccactgcactctagcctgggcaacagaacaagaccctgtctccaaataataataataataattaatccttaaaaatgtaagttgaatgaagggaaaaaatgttgagaatatctcttaaaatagctagactgggaaaatggtagtcacagaagtgggagatatggaaagaggaggaaaatgattgggggataaggaattcaaatttggataacacttgagataataccatgtctcccatgtttctcttccatggaagcctcacctcctctacctcaccaggaagtaaatggctcagctctccataacagactactttgttctttctctttgaaatccccttctgttgggtttttgagcaggaatcattttttctcttcttcctctgttctcctattattactcttgtaacttcagaattccccaatgtcatctcatgcccccctgccaactttctatttcacaccttcctgtgcttctctatccattcagtaaccaaccttcaacccacatatcatcactcagaattctccacctccagggactcacactcagaacttgctttttcagagctcatcttcctcccctggcaattctgcccttattctcagacaataagtactagcctttagtccagtttctcttttaccctatttattagcccactttctggcattaactctacctagcctggytcccatgataagcctttgtcagcactctgctctcattagttcccctttgccatggatagtctgatctccaaaccttgcattctcccctctcattctccccggctttgctagaaaaagtcatacagctaagtgtgttacaaacagatggtattagatgacattcctatggttcagactctatgtttggcttcttagcagacctctctgaccagatttcctgtacttacacattttaaggggtcaaattaaactaagtatccaaaattacatttgccacattcacgagtaacctatttcttttgtaacttactatcgtacttaattatataataactcactccacaaaacctggaagtaatttttatagcctccttttctttcaacttccacatgaatgcatcagtcaatcatttgtgttcgtgttgtctagtcaatattttttccatttcatcatctaattacatcattactacctcctgccatatcccatccattctcctatggtggtcctagaagtaacgatgccaagctcaaatctgaccatatcaagcctctgcccctactgcagtgttccagcatctgcaaattgtctgcaggaaagtgttcaaactgatctgacacctacacatcttctggaagtgactgctgatcgtttctgcttcaccctctgcactctggcaatgcccagctagtgctggacccccacccacaccctgaggaaccttagctctgtagctttgcttgttcccttccacccagagagagcacctttggcttttccccaccataccttctcccacacattagtaggagttacctgtccagaattcagcacagaaacatttctgccaggacgtttcttttccaacttccctctttctctccttcacctacctccacctgccttagctggtatagtttcctcatttccgtggtcccacagcatcctgtgaatacctctgttctgacacatcgattttctttccctctggactcttaactccttgcagaacagccactgtcaaaacacgtctcattaattcctttaactgtggtgccaagtttctggtgaggcatgcaggaagtacacaatgaatgcctgctgaactgttcagctggactcaccttggcacttagaaatctccttcatttctttttgattcccacacaatggctattcctaccattcccatcctccttggtttctggggatgcctcaatctcctctgattctgggaggttgaccttgcctccaatataagtggtagagaccccatcttctttttatttaatttttttatgtattttttttttcttgagacagagtttcgctcatgtcgcccaggctggagtgcaatggtgctatgttggctcgccgcaacctccgcctcccgagttcaagcgattctcctgcctcagcctcctgagtatctgggattacaagcatgttccaccatgcccagctaattttgtattttttttagtagagacggggtttcaccatattggtcaggctggtctcaaactcccgacttcaggtgatctgcctgcctcggcctcccaaagtgctgggattacagttgtaagctaccacgcccagccgagaccctgtcttctgtttgtctctacactttaggatgcagttgcttcctcccgccttctcctcctgctcctctgcctcagagacagctgctccctttcttggttgcacacctctcatcccagcagtcctgctctatcaataaactttacctctgacatcctcaactcttccttctctctgcagtttcttccttattcccaagacatactgcattatgcatcttccccaatcttgaacaycatctcttcttttttttcacctttttacctccttgagtttttttttctttccctaacacattcctttaaaaagtagtttatatttatcagtttctttttcttcccttctacttctattcttagaccctaagactctgggtctccaagattatgagttctcacaagtggttcctgcttcttagccttcaatttccttgayatctctctatcatacaatgctgaaaacttcatttcttttcagcttgcctgatgtgatattgtccaggttttcctcttaatttttcagctgcctcttcttggtctcttttgccatttcttttcctacctcctaaaaaatatgggtacacatatctcggagcctattccacaccatcatatattgcctcttaaggttggctgttctgtgcctgtgccacgtctccctgacttgactgttagccatgcaagggtgaggaataatgtgtttcttcagcacactcagcaaggcagtttactcacagctgctcaggaaacttgtaatttgattgactacaaacaagtgataggttagaccacataaatagattagaatccattagtataaaagaaaaaaaaytgcaaaaaccaatgagctcattcaaaccagtaaatagagaaataaatatagtcaatacaaaaaaaattaaagaattctatgtttttacatttattcttttgtaatgattgaaatagagaataatgaaaatcacagaaaataacagggtattaattcatttctagaaattcctgatattttaaaaaaattatagtactatagtctaatgtagaaattgtgtatataactatatatttatagtttataaaaatataaactatatgtagacatatatgtatataaacatatatgtatagatatatgtayaaaatatgtttaatatacatataaacatatatgatttttacagtaaaaacctgtatagggtccccataataattcactttcattccctgcatttaaaagtgtatttatacttatttttattttattttatttcatctggaccaaaatagaaacaagtcacatgttataaacaaatgacctactatactagtcacaagttgtaaatagatttggacatttagaccagaacttgtggaagaaggtgattaactcagtgatccttaatttaacccctcatttaccaagccaaatctattatttccagcctagttccaggtaaaaagaccaaaattacctactcttaaagtattaggcaaagtattatgtcccatctgtggaactgttagagggttactggaaatgctttttgtctggaagttggggttgccataaaacaartctgcggacactacagaaaagacttcagtcctacaatgtgtcctgggatgtggctggattcctgggggaggtttctacccacacagctcctcctttgtctacctagagtgtttctaatctagccactgttagggattggacaataaggtatcttggaagataatttgccccaaacgcattgtcaggctactgccactgcttagccacaatagaagaaatttagtttgaatattattaactcattgtgaaatatgatgaacctgctttttaaatgaaacctcaatgttttgtatttgtaacaaaatagaagaagtaatccaagagtcttcaagctattacaaaattataactctgggatttaaattcattatccttatttatttattcacatatttatttgtgtatcatttttgttacagcagtggatatttttatttctttactgttccttgtgttattctctctcacctgctgtgtccactgtgctgtttaaccatgactgccttacaatttggtgtttcatgaggacctgggcttcagcaagggcatcctgagcattctcataatttgactatcttagtttttcaaccctttggaaagatgtcattcaggtatagggcactgtaaacagtgactatccaaagcactttcaccaatatttatgagcccagagtaaaatgaatagattgaatctgatggtttgatgctgatgactaggtaatgcacaggattacctagacaccaaaaaaatgcagtgagctattaattttctggcctttttcacattggtaaatatggttggcagctggtgtgtctgatcactgtggacatcaggaaccaggacacaatgtcccaaagttcctttctcctcacacaaaatcctggtcagctccccctagtctactccagcatgtctccaacaacctgctataaagcatcctggcacctctgaaatgctgttcccaagaggctgtcagtaaccatgtgattctctagaattacagacaggaaagcctttgccacttcctgccttttctgactgagtcatcattgatggtgacaaagagaggttgatagatcccttcaaagttctaatctctggttttgaaacttgaagaggatatatcgctcagcccagtcaaagaggagcgaaggattgagccagcaatccaacattgttttcaccctctaacaatatgycctatgatgaatctgtgttgtagaatttgaggaaagatgcttagtgtggtacccaccataatgagtacctggaatgttacagcaggtactcagagctggtcctcctccatcccttgcccatctccctcccctcctgacccagcttagaataggagtcgtccttttgcagaacttcactttcttcccctctctcttcctgtagacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggtacagtaacttggcatctccctccaagcttcgggttatgcattttgttgcgtcttcttaatcctctacgctggcatgctccactgtggggggtgtgctggagtaaatgctacctcagcgttgtcagggaccttgcctgaactgagaaggttcaaatggtgtgatccaataaaagaggtgcatgaggaagccaggtctagtcaggaaaaatgcccatgggattttagtttctgcctcaatgggggggctattgggggtaagtgggaagraacagaagtgaaaggtatctttattacaaacagttttccagttttatagtcaaaacttcccccacctaatggcccaaccctgctggtgctactttttccagcaggcagcactctgccattgtagctaatggtttaaatgcttatgaggctcttgggtatcttaatagccatcaaacagatcagtttaaacctcagtaaccacatagcaaaggctatgacagagtggagacttgaaataactcctgtttctggctctcagcatcctagcctattaagggatactcttccctttaggctactgcagaaactgttaaagcacagctcctgtgtaaccagggtatccacatgccagatcgacttggcgggttttcatcagcctgctttcgtctaatcacttgaacctcctttctctctaatcatggatgtcactcaggaatcggtcctgcatgtgagactttgttggttgcaaatattctcagatgctcagaaagaggaaataaaatgttacagatgtctttgttcgtctgtagtgagctcagcgaggccatgaatttttaaatctagcacagggaaacgtrctacgaagagtctgtgatgcatgcattttcattcatgcattttaatctctatatgtttggaaaatacaaggatgataaatcagccagttctcatttatttaattatcaaactttttaaaamgcagcttcaaatgaaaaacactctgttaatactcttggcaaatgatacaacagggctgctgatcagaaactgctctgtgatcttagggggttatgagatctcatccatctcttaaatgctgttggtgctgatgttgatgccaacattgaaataaatcagcgtgtgctttattacaggggcctgaacaaacagggctaccagtgccgacgtaagtaagagggktttggttgcattaccatcattctttttatttagttattccttaggctatgaaaatcttaagctgtgatttttttcttcttttcagaatgcaatgcagcaattcacaagaagtgtattgataaagttatagcaaagtgcacaggatcagctatcaatagccgagaaaccatggtgagtatttacactcctctttgacgtgcagtgatttttatcagaacgttaaatgttacagcccacgaattcttcagaataatgccagaacttgcatcctcccatttatcagtgaacatccatctccccaaaactctttcctcttcaataatgattcttactgaattacccaaaccagaggatgaattagaaattagccaggcctggtggcataagcctgtaatcccagctactcaggaggttgaggcaggagaatctcttgaattcgggaggcggaggttgcagtgaaccaggaccatgccaccgcactccagtctgggcaacagagtgagactccatctcaaaaagaaaagaaaaaaaaaaaagaaatctgcacttgtacctcctaaatatacacaaattatatacaggaagaattttcattgctctacttttccagaaaaatggcatagaaagtggccagaaagcatagtttagattaattatatgagaataatccttgtggcacccccagctagaagtgacagtaaaagagtaaataaaggcaaatgatgataagatacagcaacatggcatttacaaggttagagataataacagaggcataattttatgttgagaagcaaatatttcttttagagtaaacgttgaggtataatcggaagacaaattacattttacctaatggaggggkgaaactgggctagcacatgggcagtgtatcattatgaattttaaatttttaaaaatttatatgtatttaggaggtacaagtgcagatttcttttttcaatttttttttttttttttttttttttgagatggaatcttactctgtttacccaggctggagtgcagtggtgtcatcttggttcactgcaacttccaccttccaggatcaagagattctcctgyctcagcctcctgagtagctgggattacgggcatatgccaccacgcctggctaattttcgtatttttagtagagatgcggtttcaccatgttggccaggctggtctcaaactcctgacctcaggtgattcacctgtcttggccttccaaagtgctgggattataggcatgagccaccacacctggcctacaagtacagatttcttctatgcctatattacctggtggggaagtctgggcttctagtgaacccaccatccgaagagtgaatattacacccaataggtaattttcaatcctccctccctcccatcctgccatctgtagtctccaatgtctattactccactctgtcactcattatgaaatcttttgacttccttctcccaccgtttcctttttcattccacaaatcctcactgggtatctgattcatggaagataccgcattcttccaatgacagcataacacaaaacagacgtggtcctgcgaagttggagaaacagataataaacagctatgtatggcttcgatttatattaagtgctacaaagatagtgaacaaggtgcaaggtggagagtaagcatgtggcctactgagactctgtggtccgggartctccccarcggagggaacattgaaactgacagctgaagagtgacagagctggttaggtgaagagcaggaggaaggaagctccttacaggctggaagaccctgctgagggagagtccaaygtgttccaggaactgaaatgggaccagtgtggtgacagctgcaagggctgygcagactggaagcccacactggggaakgcaccaaggcctgggtcatgcggggtttctttggagcctggaaaaatgattgtattttgtgcaacttgtagtagaaagcccactttgggatgctgtagtagaaatagtgcgttgagatgtgaaagtgaaaccagaggagatggaaggaatcctccaagcggggaggttggtggtttataccagtgagacgtcagcagaggtggagcaaaggggcaggttctcaggtgattttgatgttagaaatgactggatttgccaaaagattagatgaaagaggtggatataaggatgatgccgcaggttctggcttctgcccgaggccgagcagtgtggtagataacagagccacgacggagtgaagaagactggaaggagagatgaatttttccagtttggacatgttgagtcggagaggtggacatccaagttgaagcatcaaatagacaatttcacatgagcttggaattcctctgggacaagggcccaaccctataaatttgacagtgaccatcatataggtagattttaaagttgctgaagagattgcctagtgaggaaatagagaaagttcaggactgactacaaaggaatctaaaatgagatgttaggtagaagataaaggacagagatagacattgagaaactgggctcagagaccrctcctcctacacccagagtctatgaagttacagaaaccagaagaagaagaggtggrttgtgttctgtgcagttgaggtgttgaaattgaggcccacgtgcagatcttcacaggcttaaatcagagaaatgtcaggggcatcttggaggcattagtctgattgacctgcatgaagggtgactgaggtgatgacatgaaaacaacctgtaagttgatattatgaagaaggtgaaccatgaaggagatgatggacagagaacagtggctgggaaatgagaccccaaggatggcaagtgctcccrtggccagggagagatggataaagctggagagacagataaacaaaacagtcaagtctgttggcaggaagcgaagagggcctgagctctggtggagactggtccctggagcttccacagtttaaccggaagggagtagggcaagacagttgctgatggggatrggtgtggagctttggtgatgggcacacaaaggcgcttcccttagactgcatgtgtcccccatggagtttgatggctggaggaaggaaaagagaaagcaacaagtgccttcgaggaaaaaggaagatctatgagataattatcttagagaaagcaaggtgactcgtgaaaagcagtcagactgtggagcagagctgaaagtccatttgaatttgacggagtcagcctgctcaggagtatgattttctccaacaaaggggcaggttcagagaaggcgaagtggctgggtttttccagagtagaatttctcctaacatttagaascagaaggagataaacttgtgctaaccggtgattctgctaagactcaaagaggttaaagtagtttgttcatgtttgatcacctgtacgtggcagagctggtactaaaattaagatcacaatctctcagaccatgtttttgcttgcttagatcaaattttcacctcccagacttcttcctttacttgatgccttcagcttttctagaaaaaaacgcaaatctctgaatcactgttaacctcaatgactaacaaagttcctggtacaaagtcttgagaaactgtcagctacataaataaatgtctgtgatattatcttctcccaggatattttgatttcttgttcactcaaggggacatcatctttgggattcttttgttcctctacccctggagyagtattgtccgatagaaataaatagaatgagggctacatgtgtaattttacatttccaagtagcccacattaaataaaggaaaaagcaatgggtgaaattaattttaataatacattttatttaatccaatctgttcaaatatcatttcaacaaaaaatcgacatttgaaaaattcagatatcttaagtaattttatacaaaagtcttcaaactccaggatgtattattttacacgtccagcacatctcaactctaactcaccacctttcaagtgttcgccagccccatgtagctcattggttttcatactggaaagcgtgtacatagcgtcttcatcagccatggtgtcttgagctgtttgcccctgcattcaagattcgaagtggtccccttccagcctggaccttgacctattaattgtccatatttaaactgtggaatataagtgagtcccgaaaattatttttttcttggttgaaaatggctgtagtaagtgctgagcaatttttaatcgattctacacaggctttctaaagaaccaacgctgaccagtacccctggcgggaacgttagatctattgctgtgctgatgaataaggcatctttgctatgcaccttcccaaaggaactgttgaattagaaacttctgcagagattataaacctttagaaaataaagcattttatcctgcacaagaatattsacattcttaccaggaatccaactatccaagtgytttgttgttcctgcaataagtttgatttaaactctggaaaactgttttttaaaaaaattccatgtcgatcactarcatccctctcccactcccctctccctaycccgataagccttcacatttattttgagacagaaaagagaatggctgggctctgattctgactgccaagcttatagatatcccagctctagagctgcgtgtcctgggcaagtttcttaccttctctgtgcttcatttcctcgtctgtcaaaggaggatactaatagaagcgacttcaaaaggggtattctgaggattacgtgagataycacctatgtaatagatgatgcgtgtgacatatttgttaaccgcacctggcaggaactgctccctcctcttgccacctcagttcatgaataataggtgtgaaaatgcttctcacattaggcagtaatactgataaacccatagaaatgtttcctttaaagaaggcattttttttttttttttttacatcttccaaaggttaaaagcactagttctggactgaaagagaaaaggaaatatttatagtaaaacaggaagggaatcttcatctatttaaatgggagcactgtttccttagcactttttaaaataaccctcatgcagtcttcctgagcttttagcctgtctgtgtgaatgcctcagatttcagctgtctgcaaggttcttgctacatgcagaaggcaagcatgccccgtcacgtacagttgctgaggctgcctgccttcttcaggcatgactgtagggcttgacaagtgacaatgatgrtttaaaatgcacacaatgccagygttttcattatgatctctgttagttatgctaaggtatctgcaagaacatccaaagtcggggccccaggaatacacagatttcaccttctgcctttctttcagttccacaaggagagattcaaaattgacatgccacacagatttaaagtctacaattacaagagcccgaccttctgtgaacactgtgggaccctgctgtggggactggcacggcaaggactcaagtgtgatggtgagtccagtgggggatgwgcatggcccgacgtggaccccctaggggatggagcaaggctttctggggaactggagggaggatgtagggggtaccacttccacayccagcccagacaagtcatgatcataagtatggtcttctggggcaataagccactatgttcctttccttgcaccctgcaacacccccacccacacatcccagaaaagagcacaacagttcaggttsaaggtcaaactcctagctccatcaccttctgccgtaccatagccctgggggaaatgaagacagtgtttctcctctcactggtctttctactactagtttcctcagtgggctctgggctgccccttcctaatcccaacaggtctagctgtgtggtaccctaacccttctcctttgcaccagccagtaagattctttctgtcatctcatcaaggagcaagcccagcacattcatttggctgacacatggtcctgcacagaaattctgtaacattagcttgagcatccatccctaaaccattgctgtgaactccaagtgcccagtaagaggctggcccrgttgtgaccgtcattgcctgttttctggtctttcctccaaggccaggatcgcagcagagcctaacctgccattcattattgatggagtttctcagacctaccatcaaaaaaggaaacaaggcaaggctttcttgctgtacaactccaagttgctaaggcgataacgtttagaagctgagatgctgttacactaggattaaggactagggaagaaaaaaaaaaaccctcaagaactgacaaggcactctgctttctggttggggagagacgtgggcagagcccagagaatagagccacaaaaggagaaccacctgttgcatacagacagcttctgatttttttcttcttcttttactttttttctgagacagggtctcactttgttgcccagactggagactggtgtgcagtggctcgatcacagctcactgcagacttgacttcttggactcaagcaatcctcccacctcagcctctcaagtagctgggaccatgggcatgtgctaccatgcctgtttttgttttttttgtttttctttgtttttttttttttttagagatatggtcttgctatgttgcccaggctggtctcaaactcctgggttcaagcgatcttgtctcctcagcctccaaaagtgctaggattacaggagtgagtcaccatgcctggtgagcacagaccttttcttatgatgaagtattaaatatataagccactttattttttcttggcagccctattttgatcagtgctactgactaatgtatgtcctctcttttgagcaatgaggtacgtgatggaaggcggcacagcatcttccgcattctccccttcttcatcccaatcctgttcacatgtctggtggaacccagagcgacctctcagtggaggcaggaggrgttaggttttcaaatcattacctaaagcagacatcacaggaggccaacattagcctcaagaatccgttcctggccccaaaggacactgacacgcttttctctacacccctgttcaagaagacatggataggcagggtattaagagttcattaggaggtcagagacaaaacgtagtgtcccggcatcctgcatcctgacggtatccacagaaacaggagaaattctcgcctcttggttctcctgtgatggtctcaggtcgggttctctgtcctgggagcccgagaatccacttgcaagaagagctggtcccagcagcgccgcggcacagcttagaacttcccaggggttcctgggcgttatttcatggctcttctgcctgcttcgtttcatttctttcctygaatactctttcctttccgctccattcygttccccgctctctcctaccacctacatttcaagtgctcccctcccctttttcttttgtcccctctcctctccctcccctgccctggtttgttttccattcttgcttctgacactcccgggtccctgcccctccactgtgctcaccccgcctgctccgctcaccccgcatgcccccgcgtcctcctttctcgactcttctcgccctcttctccagctctcttccctccctctctgcctccctttcatcctgcctccttgcaggccgtcgtcttaagtagggcctccttagccttttaccctgccttctctttctccccacaataattcccaagaaaatagtcatccaaagggactctttgccctccaagaaactgagttacggcctgataggttagtaacaaagacttaggaccttctcgtggagatggtggtggcctttcttcgcggccatgcaagtcacagagaagcctagatgtggctacagttttaaggagcaaagtaaaactccatccctctatgttcaatcctagctgacaacctcacttggtgtcacggtgatgcataagaaaatggagctggggctaccgaagttgaaacctracaccttctaaatagggcgaatgtgagttatgcgagttttgccgacaatgtggaatttggagcacaatcatgaaaaaaaaaaatcctttctatagtaaagattttaggccgggcacggtaacagacctgtaatcccagcactttgggagggcaatgcggaaggatggcttgagcccaggagtttgagaccagcctgggcaacaaagtgagacccccatctctacgaaaaataaaaaaattagtcgggtgtagtggtgtgcacgcctgtggtctcagctacacaagaggctgaggcaagaggatggcttgaacccaggggtttgaggctgcagtgagctatgattgcaccactgcactccagcctgggcaacagagcaagaccctgtctcaagaacaacaacacaacaacaaagattttaaatatgcagaaaagattttgcttcaggtgaatttttctggctatatctatgcctatatactcggtctagtaatggttaatagttgaccgggcgcggtggctcacacctgtaatctcagcactttaggagaccgaggtgggcagatcacttgaggtcagaagttggagaccagcctggccaacatggcgaaaccctgtctctactaaaaacaaaaattagctgggcgtggtgatgggcgcctgtaatcccagctactcaggaggctgaggcaggagaatctcttgaatccgggaggccgaggttgcagtgagccaaaatcgtgccactgcactccagcctgggtgacacagcgagactccatgtcaaaaaaaaaaaaaaaagtaatagttatttacatagaaaattctgctttattttattattgagctatttgaagaagagtggaccagtgaaaactacaggtgagggttgcccaaatttcacctaaatattttaatatctacatctatgcaataaatgatgaagatgaaaaggaagttgtatttgttgagcgcctgctcgatgccagtcattgtgctaagcttctttgcacacacatgtgcaaatcagcagataagattaagactgcatgatgtcatagcacctggtgcctgcttctattacaacactctctactcrcagactctgtcagctggagtttggaaatctttatatctgatttttctgtaytttaatggtgatgtttctttttttttttttttttgagacacagtctcgctctgtctcccaggctggagtacagtggcacratctcagctcactgcaacctccgcctcccaagttgaagtgattcttctgcctcagcctcctgagtagctgggattacagatgtgcaccaccacacctggctaatttttattgttattatttttagtagagatgaggtttcaccatgttggccaggctgctctcaaactcctgacctcaggtgatctgcccgcctcggcctcccaaagtgctgggattacaggtgtgagccaccacgcctggcctttaatggtgatgtttcattagcaaaatttgaatttctaaaactaataattgtctttacacagtcacatgggcacacgctctccagtccaagagggatctcttggtcactggcaatggaagttagattctatgctactgttttcaagattcatgaatcagaatactcaccctgaattgtaggatccccaagctagaatcctgtatagatcatgagtccagtgctggagatccttaatcgggagcccccagagcgttcatgacttgcccaaggtcacacagtgtccacgctgtgcaagctgccaccagcaccccgttctccacccacctgacaggtgctcgagtatttccctctcctctttctttttctttaacatcttatgtgacttataaagatgacagaaaactttggttctttttcttcgagttacctttcataacaggttgtagatgtcaatttacgccatcagttcatgcgtgcaagaaatatcactttctttatgactgtgagatccacttagttaacattctcatctagtaatccttggggccctctacccttcccataatcacacgaggttttcaggaggcatgggtacaggggcctggaaactggggaatgtgctcaaacacccggttgctgttggcctcctcatctaagcccacactggtgaagcctgtggctttatgtttccacaccgtgtgtagagtttgtgatttttttttcaaagctgaggtcctcatgcctggtccagtcttgctaggtgtgttctgccgtgacctctcctggcattgctagcctcctcctactccatcccttcccacatatacactccggctccaccgtctgatatccatctgcaggctgaggctgcctcctgggcttcaacctaaaggctgggggaagctcttcatggcccaggtgggaaaggggatgttttggacccagactggagtgggcaggaatattcttctgatgcagggcaggtgagccccaaagtggggcttagcccaggagagttcttggcttcgcccaggaagaattcaagggtcggctgttggtagaagaaaacagcttcattggccaacggtattacagttctgttggtgttacagctccatgactgctcctgcagagcagggctaccccagaggcagagagtagcagctcagggcagtgctgcaatcctatttataccacttttaactacatgcaaattaagttcctggaaaaagggtggtaacgtctgggtgttgccatggcaacactaaactgacatggcacgcaggtgggcatcttctggaaagctgcttctgccctgtccctgttttagctagtcttcaatttggtctggcgtctgaaccccacctccagagttgagtcccacctcctacctcacttcccttccagcacgaggatcactaccagggagagccagggtcaacttcctcccagccrtggcactttaggctttcctccctatcygcaaggctstgtcttacctccagagagagttgtttagcaccagggggttcttccactcttgctcactatctgccttcttccttccagcatgtggcatgaatgtgcatcatagatgccagacaaaggtggccaacctttgtggcataaaccagaagctaatggctgaagcgctggccatgatwgagagcactcaacaggtaggagcatgtgccgtggacacgttcccgccatggcckctcagcaaggatgtccatgcacttctgctgcttcacctgtggcagccctatgggaaatgccsggatgtatttctgagcaccggccttgcccttggctttcatatccatgcccacaccccctatctttgagatatttatttaatgcatttgtattatgcagatctttataaaatcttaaattcttcatggcatgagcattgcagaaacaaataaattcattaaagttattgaagattcattgacagctttatgtgaatatattcgggttatagaatagcctgggggaaaacacttatgtgctagcatcatcctcatggaacaccgagtccagggcaaatttggcctgctgtttactgttttggcattagctgaattcctagatccaaggataaaccctctttaagacttggcattgcctgtatcagctgttttcccatccattaactacctgtccttatttgtgatggaatgatgtagacagcatgagagaatcctgtcagccccagaaaagtgtgaaggaggcaaacgtgttcggctaatgcataaaatacagtagatagactctcccagaatatggggttccaaaagaacgttgaggataaggagatctttgktgaccctatgcatttaaacattttaaatggcctttgtccccatcgttagcaggctgagctgttccatcaatggtgggtgggtgggtggtctgactctctgtttgtcatccaggctcgctgcttaagagatactgaacagatcttcagagaaggtccggttgaaattggtctcccatgctccatcaaaaatgaagcaaggcygccatgtttaccgacaccgggaaaaagaggtagctgtcctgatcagcagtctaatcactgtcagtcattaatctcaattaaccctaacctaatgcccttggatttaagttatcagcttacctggtctgataggtgatccacctccagctaccaactaagaggctcccacttcttagaaaagaaactaaaaccttttacctttgtaaaaggcaggaggtgggggttagaaaatgggataggtctggagggaacaaccacaaatgttttcttagagtttcagcatgttacattctgtcagtgtcaaatggtttcacagaaataaatctgtcttaaaatttgatggtgggaaggccacagaagacattcttactctgcacctttgagacttaaatttaagggtaggaaagagaaggactcaaagccactttcatgacattatggcagtttttccagcctactgtttgaaagcagttcatgagtggatatgacccatgtttctgagacctgagtcgtttcagcatacattctaaaatacttagtgtccttggaagagtatgaaagataaacctagggatttaaaaatatagagactattgtaggcagggggaaattcctaaaaatttctcttatgttttctctgacttcmaatcaacttaaaaatgtaaatgaaaggtttgggttacatttaggaggggttgccaggcagtcaaggagactatgtcttagcaatgatcaacataggcagcatcttttttttttcttttttgaagacagagtcttgctctgtggcccaggctacaatgcagtggcacaatctcagctcactgtaacctctgccctgtgggttcaagggattctcctgcctcagcttcccgagtacctgggactacttgcgcacacaaccgcacccagckaattctttgtattttagtagagatggggcttcaccatgtcgcccaggctggcctcaaatgcctgagctcaggcaatccgcccacctcggcctcccgaagttgtcagattacatgtgtgagccaccatacccggccaacgtaggcagcatcttgacttgaattctgggatgaatgatgcagttcagatctttaaaaatctgctagatttcatttcctgtctctctcacgctgtaaattgtagaaattgatgccactgtgtttgtgagccatgcaaasaattgaaaatcatttttttcctaaaatttggttaaaatccctagatgtccttgatgtggcattattaacagtgcttgtgtattttgcatatatggtcttttactgattggaatttgtttcttaagttgaactatttcccagtctattgaagaaagagacatagtccacactccaaaatccaaatgccaggctcacagacagggggtgctgccctcacagacagatggaaaggtattaaagctgcctgaactgtaggaaaccctctaaacacccccaattactatgatggagcctcagcatgggaagtagaagagaaagcatgtgctctcagtaactagaatgacctccattactccatgttcatttttaaccaccagcttgcattttcagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtaagctaatgcacgggagaatgctatggcccaactccaggaactgatgagccaagttcctggtcaaagaaattaaactcatagggccactaggattgcatgtgagtgtcagagacagctttcctgagggagcgctgaataaatagggaccccgagggctctaggcccatagtagcctcagctttctggaaacctgtgtctccaaagctactttgcttggagagtgtacatctcacacgcctatgagtttgatgtctttgggcaccaaagaaataggaaggtgcctcagccacttcctgtttcacacggtgtttgtgtttgtttcattttgttttctcttcttttgcttcattctcaagcctggagtgttgttttagtttgcatgtgatttttttctctctctattaaatatcttccagcttgtataagtttccttggggtgtgatagggctcggctctgtgtccccacccaaatctcacgttgaattgtaataatccccaggtgtcatgggagggacccagtggaaggtgattgaatcatggggatgggtttttctgtgctgttcccatgatagtgagtaagtctcatgagatctgatgattttataaagaggagtttccctacacatgccctctcacctgccaccacgtaagacgtccctttgctcttcctttgtcttccaccatgattgcgaggcctccccagctgtgtggaaccgagtccattaaacctctttcctttataaattatccagtctcgggcatgtctttattagcagtgtgataacagactaatacaggctgctataacaaaatctcacatactggctggcttaaacagcagaaattcatgttctcgcaggtctggaggatggaagttcaccatcaaggtgttgtctggsttgtttcttcccaggcccctctccatgctttgcaatggtcgccctctctccatgccttcatatcatcttcctcctgtgcatgtctgcatccaagtgttctccttttttgagatgacgtctcactgtgttgcccaggctggtcttgacctcccgaacccaagtgatcctcctgtctcagctccctagtagctgggattacagttgtgccaccacactctgcttaaattttctcttcttgtgaaaacaccagtcatattggattaggacctgccttaataacctcatctaaccttaattacctctttgaaggtcctgtctccaaatacagtcactttccaaggtcctggggattggaacttcagtatagacacaattcagcccataagaaaactgtagcttgagagtcctggaaaaaaattgtggagaaagtccctcctctaaattcttcctgccatacatgcaggtggggggttgtctccatcactcacagatgacaaggagaggaaggaaagagggagaggaggagcaaaaaaaaaaaaaaggggaggtgagaagaaggaagaagagataatttaagaaattataaccaactaccggtgactgcagaaaattttcaagctggtgatttaaggagggatgatatggaatataggcttttaggtaatttttgatattaagggtatctcatgtattaacggggctcctatttgttttacattcttggatgggactcccaggaaaattttaatcagagatgactgttctatgaatctgtgcagccaaaggcagcattatacaccacaactgctcaccagactttggcaggatgtcttacccagtttatttaatattaaacaaactaaaatgcaactgagcggtcaccacagctgaataatattgagctccatttggggtttggatttaaacactgatgccttgcctttcagcagaatcgactctgtccagcacatggtagctgatattcakgaattctttttgttcagttccacaataatatgaaccacagtaggctcatttggtgctaatctgagcataataggcaatgttacagccagtcttcattgtaatttagcagcaattaatgtgcaattataacctgttaccaaaaattgaaagcacattatatagatggaaattgtctttttggcttcttagtttatggctggttttagggtgttttactgaaagaagcaattactaaaagaggacttttaattgttaatgaaatgtttatctttctttgttcccatgtggatttccacatttgaataaggttaataaggaagacattaagttaaacctacaagccttagtcggtatcccaaggtgcagctgggagccccaggtttccccyactccatgtccaaagctgtctacttcttttcatcaggaccctgggtccctatacacggagaggagaggagggggagatatcaaagcaagacaggatggctgtttctctttctcacaacactgagaatactccaaaacttgtcttttctctctcttctggctttatgtggaaagtatgtttcctcaccaagacctctatacccttgttctcaaacaamttttaagcctaagaaaacaaattgtgtgttctctggggatgtgagcatcattcatttgcctgaattcccatctaagtttcatcccttcccttctatcaagtcagctaccatcaagctacgaacctgctccgtcgcttttaaacctagacacttacatgttcagggctgttgtcacatcattgacttcggcctttcccaaaagtcaataasagaaacaaatgacaaatgactgaattttagcaactgtgattcagagatcattttagagtctactttcccaggtctcatcttacctgactttcacaacagtcctgtaagttagagaatgcagtagtaattggaaactgaagcccagaggggctaattcatctgcccacatttccacagctaataaatgtctgygaaataaaactagagctagaattttctgtatccaaatgccatgcccttaccattgccaacagtgtgttgctgcatcatttgcaaaaactaaaattgttgaaaccctccatcatatgccatctggtgtcctttgatataagagccacaaaatcaagtgggaaaagtagattttggagttaaatcttccctcatagctccaagaatctgagcaagttattctttgaactcagtgtttgttgttgatgttgttaacttctgtcttgcagagtgtgatgagctaagaattaaattagataatacaattaggtcgtaagtgtaaagtaggtagcagagtgtatgacacacagtaggtcctaaaatgtttcattcccattttggtgtcctttgatacgagagccacgaaatcaagtgggaaagtaaacttcggagttaaatctttccctagtagctcgaagaatctgagcaagttatcctttgaacccagtgtcagtcacattttaggacctactacatgccatacattctgctatgaataattcattgctgtgttgtcagagaaaatggtgtttacttatttatttttttttattttgagacacagtctcactctgacgcccaggctggagtgcagtggcatgatctcagttcaccacarcctccgcctcccaggttcaagcaattccccacctcagcctcccgagtagctgggactacaggcacccaccaccatgcccggctaatttttgtattttttttttttttttttttttttttttagtcgagayggggtttcaccatgttggccaggctggtctcgaactcctaacctcagatgatctgcctgccttgacctcccaaagtgctgggattataggcttgagccaccgcacctggccrgtgtttattttttaagtacacaaggagaactatatccctccattcttcttttggcctggaaaaactgggtaaaacgtaaagctaggatttatgtgcacttgcagtgatgtttcgagtacagtttctcctctccacactcaactcttctttcttcactgtgcactttatctctctggatttttattgtaccttcactcagatccctgagcaggcagggcacacttttaaaaatccattcaattgcttaataattttgtgaacccttggaaagagtacaaagatagtatgaaatagtgatgtcatgtccgaaaccagagaagtgctccattttgtctcaggaatggcctatgcaggatggatgggggttggagaaggaaccccttttcccacccaacacaggtgtctctcaggactctgtctcttttttaagaaatgggaatccaaattctaaaataaagttayttcttccctctccttctaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacrcacatgttttgtacattycagaccaaggtatggcttctgctccgacaaccctacctcccctctaacctgtctcagcatgataccttcaatggcgccctcattaggagacacgagtcattgcctccatatttatcttacatttcggtgtacctgccatccatccaaacatcccttctacacaccatggaagtattacttagaatgttttagtgtcatcaattgggaaagatctttacttctagatttgtttgtctgttttcctgttttttagaatttggtttcatttagcataacaaccaggcttctcagcagtccgtgacttaggggaaaatgtaacaagtgtttgttcatctaccctgcatgtactggaagagataaaagttggaaaatagatcaraacgcacgtacactattatttttctcttcaaggcyggcagaaaaagcagccttggagtgggctcatcagtgagcaagcccctgagctgggaggtggaggttggatgcgtctgcattcccactcggtgttgggaccctttccttatgctgaatttgccagaaggctgtgccgttctgggaggacttgcatcctggtctcctttttccttaaaaaaacaaaaattatccttttctttcctgactcaaaattattcaggatcattgtagaaaatttttataaactcaaagaagaaaatcacttataatcccaccacttaagatatactcgccattaatactttgaagtttctccttctatagattctctctgcagtggacttctaaaaacaaaaatagcaacccactgtaaatacctactgcactgtactctgcatttgttacactctattttgaacattttcttacgtctttggatattctacaacgtgatttaactagaacatctctaattttttgttctgatttaaataacactaaaatgaacatcctcgaagattagttttcatgcacatgcattatgattcttcttactggtttgtctcctctctgccaccccatcccggctgtccaccacccgcactaattagcagcctcaagtgggaccatatgactaagggccaaagaacacaaggggcggaggcttttccattttctgttttctttctttttgtttgtttgttttgtttgtttgttttgagacggagtctcactctgtcgcccaggctggagtgcaatggtgtgatctcagctcactgcaacctycgcctcccgggttcawgtgattctcctgcctcagcctcctgagtagctgggattacaggtgtgcaccaccacactcagctaatttttgtatttttagtagagacagggtttcaccatgttggccaggctggtctcaaactcctgacctcaggtgatccacccccctcagcctcccaaagtgctaggattacaggcgtgagccaacgcacccagcccttttcccattttctatctcaagccatgacgactggagagtgaatgagggaaaacttctaaggagacttgagccatgggaagaattaatgagggaaccagggaatgaatgaggaaagtggatggcaactggggcatccatcmccacctctgcagttcccagtagattctcagcatatgtgcaataaccaaatcaatgaataaatgcacttacctaagataaagagaagccagaccatggcaaagcacttactgagcatatgctgtgctcaaagcactgtggaggatacagaagtatataatacagctcccgaccttgagaacttcacactctaataagagtcaaggctgcatttctaacagtatgagtaatattagatcagaaggcagacacaaagtaccagagctgagagaaactagaaagaggaatttgaatgggcagaaagggccttgggcatgaaaggtgtggctgcaggagaggaagtagaaaagagtgaggtgtcctggtcaactatttaggagaatgcaggcccgcttcctgctgcagggagcaggctggaacttcccatgatgaaggctagaagagattttgtactagaaactccctcctggagatgataaatacccattggcctgggagggtgaaggtatgtcacctgcaggcaaagggacaaactctgccaccctctccatgctgttgggagggtgaaggtatgtcacctgcaggcaaggagacaaactctgccaccctctccgtactgttgtctagattttctgcacatgctggggctccctgtaatcttttccctttgcagtattttgaggcttgtagcaaactgctaaacacattttttcttttttgccataaataaagatttttactgtaaagctttcatagtagcgaaaaattggaaacaacacaaatacccaatgacagatttattgaataaattattatatggtcagagaaaataatactatataaccattttaaatgawgatgtaaatgcttaaacatcaatacagaatgttgtttatgaaatcrtaagtgagaatatatagtatttccttttaagcaagaacatttgcatgtataagcatgaaaaataatgaaaaactaacagttgttaattgggaggtaggattataactgattttatttttattatatctttctgtgtatgttactataaacacaytttagactgggcttctgggcacttaggcagttgtgcttctcttggtgccttttccccatttttttttttttttttgatttgcatgtatgacagttttcatgtcttacggggaaggctattgggaatcccactttgtagaagataggtatgctcctttctcttgcctgtccatcacagcttcaggcagcatttgtttctgtccctcttatgagagatctccttaacccatttatgcctgaggttgcaactttttgaattttgaaatcagaccttggtgatgaccttgagcagtargatataaataactcccacatgcttagcgttccaataatggaacactaggcataaatgagttccgtgcagctgggatgctttaccaagacctgagccacaagtgcatccacagcattggtgctgggagagaaaaaaaaacttcagcagagaatgtttacatgaaatgtaaatctgactggctcaagactcagatctcaaggaactgagtccttttagaaagaggaaagaaacaaaggaagaagcttgaatcaccttttccaacaccccgagttgttgtttttgagatgtcttaattattcaaaccttgcttgtcaaagtaastgattaaataccacaagtgaatgcaaaaggcaacgattgatacgtgatatggataatgctttgttctgggaacatgttgggaatgacctttcttgggaggacagttacctgtgtatgctagtgtagacatcagataagataaattaactatgtacttctccagggcattgttattttttaaaggaagttattcatctgctctctgcctccaaagagcgcacctgttgaataccagattattcaggagattctgaggacaggtattcacttgttattaattagggtcatttggattaaattgttaaagtttttaaagttcctagatgagggatatatcacctatggaagggtgaaaatatgataaakccatttaggaagctacaaaatgtgaaaattcctgtggacttggattccgaagttcaagcccagctctgccgtttatcaacagggctctgaggcacccactttacccctgcccaggacagagagtaagagttacaggcagaggggctgggagctgtaaaaccaggggccctaatgggacggcaccgtctggggacatagatgtrcaggataattcatgaaatctgaacctgaatctgaatgaggctcaaatcaaaagaatcttcacaatgaattttctgtgtgctagatcaaaatgactttgtacatcatccaggctctggcataaattactggctcagggtctaacgtagatcagcattctgagaggctgctgtcttggcaagaggaaagaagggctagctcttctttcttttactttttttctaacatttctttgttgttaatatttacattttctgtcttacaaagtctgcagggcttgaaattgcacgatcccttctcagtacccccttcagtgcggatgccagccaacttttgcactactagatttccaacttagatttttaacagtttccattacttacattttaaaaagtaaaaaaataggaaaatccacaataaaatttgtctacaagaagagttgtcataaatcttttaactatccacttacaagtagatttaaaacaattagaaaaaaataattaaccataaaactttgaaacacagggaaaaataaacactgaaacagtttccctctttttagttatgctgcagtaaaagaaagattaataactcaagtatccaaagtttctgtgttctatctctgataaaactgtggaaaaataagaggatttatttctaaaatttgtttggaaaggaaagatgcatctaacacagtaaggatgctatttctttttaatttcaaggaaataattttcccttaaaaattaaaagtgaactaaagtctaccttcctctgtgtctcctttgaattctgaaaggccgatctgtattctgacatttaagtagtgttactatttcacrcctaagtagctctagatcctataggaacagctctgtctctgggtcgttccctcaggttggatttgagggcaggccgccgtggttttgcaggcctctgaagagaggcctcccagggtgatgccaagaggcagaacgctagtgttcctggattcacatcactgcccttgactcccacactcccaatatgcaccagttgaacattcttggtcaatatcactttgaaatttttcttttakgaaaaagaaaactgagtttcactttctattcatagaacacacaaagctctacttccggttatggcttcagggcatgagtgtgtgagttactttgaacaagtcacctaacatttctttgtgacactggttctccttttttgcttcctaaggataacgtgaaaaataataataataacaataatagcacttgcagagaagtttggatcttttttggagaaagtaccatactaactacaagatattattatcatttaaaattaaaaagaaaaactccttgaacttgatactttttaaaaagtatgtcatcctggtatttccatagttttaaggcaaaatccatctaagaaagtttttaatttcaagcattttattcagaaactgcttcatctgaagctctcaaaaatgctgcaatccatgaacctttcagttgagctaggagccctggaaattaccacaattgtagcaaagaaaagaaaacccacggaaaccacatccttccaaagacgtgtccctgcactaagacaagaattaacttttcatgctgcccccatctgtagtgacagataagcctcttttctttaacgtcctctggcggcgttctgatcctgagaacgcttacacgttgttatttcagaaactggggatcactcagacattctgcaggttcccctgctatgtaaccaaactgtgatttggcaaatgttagattttatagcaaatttacaaaaatgagtcgatttacagctgtcaacctgaaataatcaaaaaggccagaatctaatttaaagagcatttattcaaactcaaagtttgaggatggcccacctggaaacaccccaaaagaatgaagtcagagttgtaaaggagggaactttagggtttccatagggagagacasaggcatttttagcaggattacattttttcatacaaggctggtgcatagttccaggaacttggttacaggcagtgtttctttttgggaaagggacatttaacatcttttacagagtgtgctatagtcatgggttttctgtcatctggtctaaggaaaataggacaaaaaaaggaaaaggtaatctttaacaagattcattaattaaaaaggcaggaggcggccaggcacggtggctcacacctgtaatcccagcactttggaggctgaagcgggtggatcaccttggggtcaggagtttgagaccagcctggccaacatggcgaaactctgtctccactaaaaatacaaaaattagccaggcrgggtggtgggcacctataatcccagctactcaggaggctgaggcaggataatcacttgaacccatggggcggaggttgcagtgagctgagaccacaccactgcactccagcatgggcgaaacagtgaaactccgtctcaaaaagaaaaaaagaataaaagaagtcaggaagtgtttgtccctgacaattgtttaattctctctagtcattgtacagaacaagagaaaaaaggaagcaagttaatctataatctgagaaacagaagttgtaaccatatgtgactcagatcacagtcgcatctctctcaaggcgtaaaacgcattttaggaattctaacaccttttaaatgttatttattttcacacagtaatttatgggaaattaatgttgcactcacaatgtttccttacagttttctcgtccaaatacacaggaaataacgggcaatgagtgaatacatattcaggaattcttggactaaaagaacaagacactcactcagtgcatctgaaatgccgcatctttcctacatgcctgctttttttttgtttgtttttttctgagatggagtctcgctctgtcgcccagcctggagtgcagtggtgcgatctcggctcactgcaagctctgcctcccgggttcacgccattctcctgcctcagcttcccaagtagctgggactacaggcgcccaccaccatgcctggctaattttttgtatatttagtagagatggggtttcaccgtgttagccaggatagtctcaatctcctgaccttgtgatacacccacctcggcctcccagagtgctrggattacgggcgtgagccaccgcgcccggcccctacacgcccactttttaagctcacagatctgttctcatcttgatgtgactctgtaatattcttccaggctcatggcccatattatctgcccattcctttgtcagccattctcacaaagtcccaaaagtattgtcaccagcttcccagaagacatgagcatttgacatctccttcaagagagtgcctcaggaaagtgcatgccttctgtgaatctactatccctcttttgttttttgttgttgttgttgtcattgttgtgtttgtttstttgttttgaraaggagtctcactctgtcgcccagattggagtacagtggaacgatctcggctcactgcaacctccatctcctgggttcaagtgatcctcctacctcagcctcccaagtagctggaattacaagcgtgcgccactgcgcccagctaatttttttttcttggtattttagtagagatggggtttcaccatgttggccaggctggtctcaaactcctgacctcaagtgatccacccacctcggcctcccaaagtgctgggatcacaggyatgagycaccatgcccagcctactctccctcctttgaaaccttgctgacaaactacctactctataaatcacgctcagatacactaaatcctacttgtcattcagacgctcaggcttctcagcttacgtgacccagaaagatgattttgctcctgtactgctgggtgtcttctgtgacttctttcatatgttctgtttaaataataccttgtctatgtaaataatacattccttgataccaagatgcatgtttcgctcttttcttttgtttcatttgcccgtagagtgctagataatgttcaggggctgggcacaggggggagcggaagagaaaaagaaagataaatggtctgactgtagatcatactggctaactcaggtgccaggaaggctggtcccgaatagaactgcagaggagaagtctatctttgacaaaccctcttcccacccctctctgacctcctgtttcattattttccccttcatcccagagttcacatgatcttgtacccactgtagctatcaggtctctgccttgattttttttttttttgcgacagtctcactctgttgcccaggcggctcaatacaacctccacctcctgggttcaagtgattctcctgcctcagcctcccargtagctggggttacaggtgtgtgccaccatgcctggctaatttttgtatttttggtagagatgggatttcaccatattggccaggctggtcttgaactcctgacctctagtgatccacccacctcaggctcccaaaatgctgggattataggcatgagccaccgcgcttggcctctgccttgatccttgatggcaaaatcgttcttctccatctccttgtctytcccccttaaaacttctgtcacttcaggaacctcttctccaccaccagtcttagagaaatatctgataaatagcatagagcagtttaatatgtgttgttcctagcaacgatttcttcctaaagtggagcagagtggagtttccttattagacccaacattacgttgtatttgaggtgattacagttcccatcctgaggaggtgacacgcatgggactcttcaggggaaactgtgggaatatatgagcgtcagaatcaacgtactgcagaaattcaagtgctaaaccacagaaaagccctcttttacaaagtaggaggaagagcaggggggaaaggtgatagggaggatcccttggggtggtaagaagaggaacagaggagttaggagtatcggaggacaggagaggaaagaatttcaagagagaaaggatcatatatttaatgtggtgaagagttgacaatcaaaaactgagtgtggaatgtgtcatggaggaggaacagacaatacagtgtgaaggagtgagtggtggataggcagattcagtggtgatacagaaatcttccagaaagagttttcagaagatggaagctcattatgactgcagagtgtaagggatgagaatcatgggaaatgcttgagccagagatggagaaaccagacaagagggagactattcaggttgtagccttttcagataggcttctttcacttaagaatatgcatttaagggttcttcttttctttctgtggcttgagaactcatttttcattgctcagtaatattccattgacaactaatgatttgttatgttcttttgttttccttawaatgacagactccatggatcaagaattttagagtagggaggggtggtagaggttatcaagtcagatcccctcattttgcagcaaaggaaatggagctccagagaagataagcctagctggtcacaggagagtgctcttttctgtggtcaatccaaaattattagtaaagttgagacttcaagatacctaaacacaaatccaactcacaacttatttaattggaaaattgttcattccatgtcctaaaccttagacccaagcaagaggggttcygcccagcccctcacttagaatcctccctttggcctttctcaaaccacactccttcctgtgaagccaagaggtcgtctctgttcctaaactactycccaggacctcggaattccatacctaaacagcctcaagcctgtgtagacatctccctaggttctgtccttgaaaggggcaggaggagactttcccgatatggccaattaactggtgcagaattttgagggatcctgaatttgtcacgatccttcttggtcattatgaagttatatttcccaagagacagaacatataggaatgtagagcatatttaattgaattgttggtgagcttgattaataacacttaaacctggggacccacagtgtggggcctccctctgcacactcgctccaaatcttgcaaaggttggggctgtcctttttctgattataatgcaacttaatgcttttcttccctgtgtgataaataataacaatgtatgtgataaagttaatacataaggagttcttgctatatgccaggcacagggytaaatactttatatgaattctttcatttaattttaaatatgaacgatagctcccctttcttcttcagagcagaattcccaactctttccatcggctgtcctatgagatgtcccaaagaagagttgaattctatctctggttttcatcttgttgtactacagtcttcgctgttgtaacatttgttacgtgtccttaacatatgatactttgaaaggtgtgatggtaaatttagatgttttgtcataaatattttgatcttaattttatttattttgcagagattgcaaatattctcttgtgtaaaatttattacgttggtttactagccttcggagaaaaaagatacctcgaaaaaaatgactataattattcttttccttcttttcccatcttgtttttctggagagggagtctayaaatctgatcttatttgcatgatatttgccaagttctcagtgcatttacaaaattaactgttattagtctgataaaaatmatgagtttatttctttaatgctataaacctgtcattcatcctataatatatgcacatttgccagccatttccttgtttactcaatatttgattagctgtgttgaatagtcatcacaactaaacacttttccattctctttattctcattctctcctttgaaaagtgtaatcactgtaagaagaaagcagtgtagaagctaggttgtattaaataacttttgaggccacttttacaattcaccctttactaattctagaatattcacaaaatgtcctattcctccctttaaagaactatcttgtgttttaaataatgatatattttgacagctctaggacctttatctgctccaaatgatatttgtgtatgcaaacgcagtcctatgagaattatacaactgattttgttaaatctatcactttgatcttgtatttaatcatcattttttttaagacagggtctcactctgttgcccaggctggctttgkactcctaggctcaagtgaacctccagcctcagcttcatgaatagctgagattacaggcatgcacctctgcacccaacttaaataccatttctttaaaacatcaataacacaaacataagagtcatacagctttgattacccacctatctacagaatgtcaacattgtttattgccttcagttgtctggaaatcacaacaaagctgtaggtaatggtgactctctcattttcatggacagggttcatttttcagaggaggaaaccaaggccctgtgatggtgggatttacctgatcacacagctgattagcgacagtctcatttctcacagactagaatttccattcgacagatgctttgccaggagttgttgacagtcggcaagactgggacgcgtttggcatgtcccatcccccaatgccatcacagcttcaattctcacccaccggaaagaatcatttgcctcggttaatgtattacccgccataaagacgtgaggtctagactagtaagtgacatttacaattaacccaacacaggccacattctctccctccctccctccccaccatctctctctctctctctctctctctctctctctctctgtctgtctctctctgtctctctctctctctctgtctctctctctctctctctctgtctgtctctctctgtctctctctctctctctctctcagcctgcttggtatcctctctcagcaggtggccagaacctaaacggcagcccaggagggaatctaattctgttttcttctttctttcgagagccatcggccagagaactgttcatttgcttcttctgggaagtatttgctggtttttggattggttttggttttgtctttcctggcttttaaattgcttcctagaaggacagctgccatcagttatcaattgcccactgaggaccaatgcagagattcatttccacacacactattttgtttaatacccacagcaaccctaggaggtaggagtattactaccccatttcacaaactaaatgaagctcaggagaggttaagtcacgtctccagagttataaatagaggggctttgaacccagggctgagtaaggatgaagcccacattctttgcaattactctgagtctcattcttcttggtttgtttctatctatgccagcccagagtctttccagcaggcagacacttctttttgcttgcggttctgcagaggttctagtcagctgtgggttgccttcaactctgagctctccttccccagctgtttatgaaagtttgagcctattatatttgtatttaccttttatgatgggattttggattcagcttttaaaaggcttatccatccctcaaaatgtgctcctcaaaatccaaacctctggacygtgtagtttgtatgtgcatacatttgtgctaattttatcacagagcagaacagatatttgacagatttattgtggagcctgcagttctcttgggagggttaaatgtggggcatccaacatactataaatctccattgctgttaattaataatcactagtaacgtagtcttcttctcaccctcatgktagtaaacactgactgtgccctgtgatctcttagactttaatggccaattcaacccccccaatgctcaccactagtgtggcgtctgattcagacctgagaataggtgggaaggtgtgtggaatgcatgggagtggggctgaactgttgcctccagtcccctcccaccactttctccacatctaaattgacwgtgttaaattctgaaatgtcagcctttctaggaatttgtaagcatccaaacacttagaagaaaccgttcactcaagcactgttggaaatggtttcgctctacactttcatacgctttgctctcgtgactacttaaaagaagattccacctttgtggcttgtatagggccattatagtttgagtaaaaagctgaggttagaacagaagctctttctgtggtgctgatgagagcaagaggtagcatgagaaagcaggtgtgtgcaggcaaagccaatgacgactctcaaattgggtttgaaatctgtgttaagtcatgatttatgtcagctgagaatttgggcctgtccagaagagaaaagggtgggcttcacttaaagatatatggaattagtaaatcagatcggaaactaacattgaaaaaagacggatgcttaccttgacctggattattgagataattgccacaatacttggtttccccattctgtggtgaccaggcaaggagtctcactgtcagaccagaacaatgtttctactattacctcctatgccccacggcctcggttgggttcacatcaaaacrtaaaggttaattctgttaagaaaccacccaggtgagactttcagatgcaaattcatgcccagacgcaccgaaggtcctcacactttatggattactgattctgtgatgcattacaaccctttaaaaaatcaggtttctctaaagtgttataaatacatttattggaaaaaaaaattgtctcacatcattgagttgctgaggctggttacaatcctggctgatatgcccaccacagcctgaagaccacccagccctacttctgactgtggccactcgagggccccagctctactgacatacatcatgtcctctgccagaagaactccgtcataaactgtggcttgcctctgccatgagttaagtcaggactggagaaaaataaggttaaacttgattgcaagcttcagggaggaatgactgacatgacccgcccactccccccacgccacgcccacagaatatgctcagtagctaattactgagtgttgagtgaatgaatgttttcaagctccgcccttggagtcagagaccaaaacacattctccttatcaccctgcaccctgtcactttcaataagtatacaatcggcacatgctaagtgccctaagtgcctggcaccatcccattgtctggccagcaggtcaactggactctcscttgtgccccccgctcatctgctgggttgtaacacgcaagcatctagatgccacagggcatcccacctagattccccaggcttcctggggctcaaaaacatagattgtttaaatgattttgacagtcttctgataagtgatttcacaacagaattagttcccctgaaatgatctaatccatttaaaaagtagtcctccttgttgtattttctctaaagagctaaaaattggaactgtgactgggtatggyggctcacgcctgtaatcccagcactttgggaggccaaggtgggcggatcacctgaggtcaagagttggagaccagcctggctaacatggcgaaaccccatctctgctaaaaatacaaaaattagctgggcctggtggtgcatgcctgtagtcccagctactagggaggctgacgggagaatctcttgaagccaggaggcggaggttgcagtgacccgagatcacgccactgcactccagcctgggagacagagtgagaccctgtcttggacaaaataaataaataaaaatgaaatgaaataaaagttggaattgttttgtttttccacaggaaaacctcttttttgtgatggagtacctcaacggaggggacttaatgtaccacatccaaagctgccacaagttcgacctttccagagcgacgtaagaggctttaaagggtttgggagttttccactgttcttgtcagttcttgctggtttttttttccttttttcccacttggcatgcctgaatcccagggccaggtgaacccttgggaatacatcgagcaaggcgacagttttcccaggttgtgaaactgaaattcgtgtcagtttggtttcatttctctgtgatttaaaactaactacttagtttcttaaggaaccatcccgattcatcaggcttctaactaacctgagcacagaagcaaatatgtamcctttggaaaggaagcagtgaaatggactgcagacctcaagggtggtccccagggatggagcttrtagctgaggcatcttatggaaagcctgatgtggaggcataaagctttagggagcaggaagaggcacttagtccatctgagaacaaagcttctccttcctagtgccggcagcctgagacacctggagacggggcagsctgtgtgtacctggtgggactgcacctgcatccacagttctcaccaccactcctgcccatgctgttccctttgggtcccacttcctgctccccatgacatgcaagtaaaagaaagctctgccactgggctccttggaaaatgatgagtacatgctagcttcctttgctcagcgctcaataatccctccctcccatctgcatgaacactttgagtggtttaggttgaagtgggttgagaaatggatttggtccgccagcttcttaaaatccctggctggaatggctgtttatcacatctagtgggtagcactctgctgagatcattgctctgggaaacctcagcaatgcacccagaggtaattttactggatttctgcagcagagaaatcatcgggcatttttcatgccggaaagaattcacttagtccactgtcgtctccagccagcccggacccacgctatccatcctgtcctaaatgccttccaggaaggagaattttgcattcttccacaagatccagcaagcttcccttccaggaagctatctcttatatccgaccttaatcccaccagtgatggggtaaactcatttcctttaaccttgtcaccattgaagatgaagtgtaacttatcttgcatctgctaatatcctcttttccacctcatgggctgtaagtgttgcccaggctaaaggttctcagtacgaaaataaaccagctagttctattcagaatggtgcatacaggtctatgggtgccaaccagagtttaaaacaaagggagaaattatttgcctattatctatactattacttttttttttttttttgagtcagagtcttgctctgtcgtccatgctggagtgcagtggtgtgatctcagctcactgcaacctctgcctcccaggttcaagtgattatcaagcctcagcttcctgagtagatggggctacaggcgcccaacaccatgccctgctaatttttgtatttttactagagatggtgtttcaccatgttgcccatgctggtcttgaactcctgacttcaagtgatccacctgcttgggcctcccaaagtgctaggattacaggcgtgagccaccgtacctggcctatactatracttttaatgtctgtgtatgttttattagcaatagcaaaaacaacaaaaaaaatgacaatgtgagcattattgtttaaaatataagaacaagtactagatacaggcaggactcacttaagatgccagctctgttttatgctgttaggactgaggctggaggtgtctgagcctctactttcttatgtgtagaatgaatggacaacatcttccttgttaggattaaacagagttatgtgtgtatgccatttagccatacacagcatgtcagaaaaaggtcagtctgggtttgggattttatttcgttccatgacaacattcatgttgaaccttggttctccttcccccaggttttatgctgctgaaatcattcttggtctgcagttccttcattccaaaggaatagtctacaggtaaattttgckttgtggaaacaaatgctaagatatcggctttcctggctcagttaatttaatcattgcaccgagtgctgtgagacagcccatgtgatttcctgggagtaagctccacacataggtctsctgcccacartgattacatggatgatgacttacaaccaaggaagacattccagtctcaacagcaggaaagtgctgagctcattctgtcctttatgctggttctcacttgaattccttctttcaccttccttttcccattttcactgtcctgttttctctttcttatcataccttacggtttctttctcttttgtccccttcatacctcttatttttgcttgtctttgctttgagccacctagaaatgcttatggaattttcttcttctctgctgtatgacatcatttcacgttcttctgtccaagctcttagattgacactattgtatctcaatctcctcacttcttttctcaaaatgtagttggcacttatttaacatacaaacctttacaagcttactgtcagatttccaactcactgcagattaggaggaaaaatagaaaggaaaaaaaagaaaggatctagtgaggaggatggctgagctgctggagagcagataattagtattgaagctttggtgcttacagagtgtagaattcacttaacaaggaaggatctctccattttctgagggtgcagtcaagtgagggttgccctatttggagtcacacaactaaaggcttagaggaggtttgagaagtaagtattcttaagcagcctctttgaatgtaattttttttggtctwtctacaaaatcatagattaagaatctgttttataattttttaatcttcaggaaattgagaaatactcaccagaatattatttwaaaactcttagcagaatttttttaaatttttctttatatgtgtaaggcctgcaatgtatctaaaatatttttgtacctaggcactgactaaattgtgtggggtggatggatagatggatggatggatgatggatgagtgaacagatggttggatgaatggatgaacagatatttggatggatggatgggtgtggatggttgaatggatggacaaatgatggatgaatgatgaatggatgaacagatggttgaatggatggatgaatggatggatgtggatggatggatggatggatggatggataaatgatggataaatgatggatgaatgatgagtagatgaacagatggttggatggatggatgaatggatgtacctggatggatggatggataaatgatggatggatgaggaatggatgaacagatgggtggatggatgatgtatggatgatggatggatggacaacggatggatgaacagatggttggacggatggatggatgggtatggatggatgggtgatgggtaaattgaacagatggttggatggatggatgggatggatggatggatggtgatggattggagatatggatggatggatgggatgatggatggatggtgatggatgggtggggagataaataaatgaaaggggctgggcacagtggctcacacctgtaaatcccagcactttgggaggccaaggcagatggatcacctggggttaggagttggaaaccagcctggccgacatgacaaatcctgtctctactaaaaatacaaaaattagctgggtgtagtggcccttgcctgtaatcccagctactttagaagctgaggcacaagaatcacttgaacctgttaggcggaggttgcagtgagctgagatcacaccattgcactccagcctgggcaacagagcaacagtccatctcaaaaaatttaaaaagttaaaaaaaaaaarggggaagtaggaataaaaattaggagggactggagagagagagagacagagatcttagactggaagggaccccgtgaaacctaaacccacatgcctcggggcattttatttccctgtgtcacaaagcttctttctatcatgtcaccatgtaaattattaacactcagaacaaaaaaaaaaaagcaatagatgtccataagtagctttactatcacaacaaattgtacccattttcgagtcttaccctgcccatgcatggaagttatgttctttaagccttcttaggcaccaacaagaaaaaaaaatgagtttattttttgtgctcattaggttgcaggagaccctwgaaagtcatcatcaaatagttataactgaggataggtcaccagacaagtatgctggctttaaaactggcctgctgcataataagaaataagttgccttataataagttgaatagtaagaaattattcaactgtctgtgtgtaatttgactcacctaaacttttaatttggcaactgaattaacaaaaggattcaattcatttctttcttttgacctcataggataataattttctgaatttgttcacaaaactgatacattagttttgaagggctgccataagaaattaccccaaatttggtggcttattctggaagctagacatttggaagcaagatgtgggcagggccatgcccccaccaagccctcgatttaccagcctctggtggctgcaggcattccttggcttgtggctgcatcacccagtctctgcctctgtcttcccatggccttctcttgcccccatctgtcttttctaagaacacttgatggatttagggcccacctcgataatcaaggataatctcaccttgatatctttaacttaattacatctttaacttaattacatttggaaaaaaagaccctttttccaaataaggtcacatctacaaggttctgggggttctgacatgaacatacctggacatawcttctgggggccaccattccacccatacagctgatatcacagaccatgtgtgctctggatgtgcaggtctttgtcaagcatggcagtgggtactaaacatagagaagtcccaacccccagaaacctgatgagccactttctggggtttcttcagaggtagaatggattgatgatgaatggatgaacagatgaaaagacacaagctgtacattcaaaaaatgtccaagtgaatgttattccaattaaaagtgcaagarctgaaaggaaaaaatatatcaccagacttaagtaggggagatggcaaacaaaaattcttctgtgaaggtagactttttagagtggaagaggctttgcagatggaagaagtgactccaggaaaggcacagcaataggaaaatggaggaatattcaacaggtgcatccagcttcaggggcaaggctgctgttggtcgatgaaaagcatgagatgtggagaagcaggtgtggtggcgtcactcaccatctgccagaggaaccacaaaatcgacggcatcttcaaagatgatgtaagccctggtttgggtcaaatgtaaaaccacagagccggraagtatgcagatgtggaaagaagaatctagaacttccaatcttagagtattagaactaagaagaaccttaagwttatattttattgacaataaaactgggcccaacccatgtgtttgaagccactttcaatgctttcacrtgattctcattggacgttacaggaccccatgagacaagcaaggcaagtgtcatggtccctgttccttggatgagtcttggaggctgccagaggggaaatggtgaggcggagccagccggccgtaatgctgggattgggaagccaactgtgatgcccactccacctcttccaaatagaaaagctttgcctccgttaacctcatgatggaatgaaagggtgcccctggatgttctcttctgcttgatgccatgatggcctgcttctcctctgacagatgaaagcttgcagagacatgcacaggctgtggactctgaagttctcccctgggtcctgatgccccatagggtgtaagcatgacatgcctcagaataccctgggcctctgggttctctgccctctccagctggctccaggggtcctcactggtcttccttggcactccttcctcacccccatggggggctggcttcacatggcagcctttcagaacctttcccatattgacctagatccctcagagctggccagkcgcagtggctcacgcctataatcccagcattttgagtctgaggcagaaggattgcttaatgtcaggagttcatgaccagccttggcaacrtagtgagaccttgyctctamaaaaaattttaaaaattagccaggcatggcgatggcacacatgtggtcaagagtctgaggtgggaggactgcttgctcaagaggttgaggctgcagtgaactgacatcatgccactgcactccagcctggatgacagggaaagacctcgtctcaggggaaaaaaaaaaacctgatatcaagggaagcacctgaattatctttaaaaaatcaatttcacaagtacagaatgagaagaaactgggataatggcacttcataaaggaaagcagaaaaacacctgaaggttttagtttacaataaactcaatattgggcattactgtgatgaaactatgaaaaatatggtgcaggatcttagtccaccrtggcaaaaggcaagaggatggtaatggagctctgggtgccgctgtaacctgcaccaatcagattgtctctctggaggattctggcttcattctgagccaagtcagtcragaagaaaacggacaaattcaagatatttggaaggtagaggccagaatgtttgcccttcatccagtttcccccagtggccacatctcatgcagctgtggtacaaggtcaaaagggtctgaaaaccacatcatgaggagcgaagtccctgatcttggtgagagaagagaaaacttgatgtcatttttttcaaatatttggggtgtcacatatggtaacaatagaaagcccccttggaccaataggtgacatcacatggaagcaaagttcggttaattgttttttaaaaaatattatcagttacatttccctaagaatggaatgggttcttttaagaggatactagttctccaaggaaacagaagtttgttggcatgacattctggcgttggatggattccggttctcaaggggttcagtattagttaggaacaaacttcatcaactggacttggaattaggtgcagtataattcattcacaaatatgtagaaaatggcatacagtaagtatattttttaggttttcctccttcgtcattaccctcaggaaagtcctgggatcaagggtctccaatgggtatgggtgctctgtcctccttatactgagctgcaccccttggtaaatcagagaaagaatccatagcagccagcgtgcccttgcagaatctgctttgtctacaccccacttggtgtgcaagtggatagatacataagcgcctctcgtgagcccctctcaggctgcaatgagacaaactccctcgcctcctatggaattttatgttaaccaaattatattgattaatgtgasatttgcttcacttttgtttttcagggacctgaagctagataacatcctgttagacaaagatggacatatcaagatygcggattttggaatgtgcaaggagaacatgttaggagatgccaagacgaataccttctgtgggacacctgactacatcgccccagaggtaggaatgcagtgacaggctgctcccacctcaccatgccctggccacatgccattgcttctttagcccctgaaaakcagaaggttttaaatatcttcattcaagatttgtacctgttttcttaagtatctcataaacgccaccatgcatgtgggtttctattattattttgtggggagcgctacttttacaaatcacatctctccaaggcttgcagagtttggcatttcctttcccccagccttaaaacatattcactctgctcagacctaccagaaggaacagctagtgaagagccaggtggagcaagygtccacccaagtcaagtggtgaaactgtggggtcagaagacctggactgagtttctaagccaccactgatgtaagcacagagtgattgccaaagtctcactgacttccatttcctcttctgtaaaatgggtataatgctgatgtcattgtgttattgtgagcattagatgagaaagagtgtgaaagttaaaactcacccctgcccccattaaaaaataagaagaagacactgctgtcacattctggacacacaaagaagtgacatttgcacagaaggcatccatcaattcaactaaacccacctccccccttttcacagaatcctccccagctgcccacccagggagattagtgacacccctcccacttggtctttcccatggcacagcacttgttctggttgctttttcatcttcaaatctccctgcatgactggatatttgctctgcagtcatggacagattcatattcactttttaaaaattttcatttcgaaataattgtagattcacaggaatttgcaaaacatagtccagaaatatctcccaactgtgcccttcatccagtttcccccagtggtcacatctcatgtagctgcagtacaatgtcaaagccaggaaactgatgtccatccaaagtgtacatggtgctatgccatcttctctcatgggtagatttgtgtgatcttgttcacttttacatctaaggacctagtgcaggtgttggcatattaaggtgctaatagataccttctagaagagtaaatggatgaactaactaataaacgtgtgattggagatggttgtttgataaagactctggcagacctctgatttcctgggtaaaattattcagcagcaagttcctgtcattgccaaaggagttgtggccatctgagtcctrgaactatgtagctttgccctgtggttgggtgatatgtaatttgaatttagccttggcttctattccatgaggaatgatgtcttttagcttacatggcattgttgaactcacagarcgaggcttattgattaaataactttctgatcgtagaaatctatgtttcattcagtttggcacagatacaggttttgatgctataaaccattttcatttgaagtgaaaccaaagctcatcaaagcaygagtgatggggacttaagaggacggactcaactcaattactgaattcccctttgtaacaattctgaaatatgcccaaatgcactctgctcagaccaccctcactgccatccccagcagcagtctcctttgtcactccctcagcctcacctgagccatctcaatttctttcctcttcaccttgcaacaccttggtgtggctgccttactctgatgtattcctgtctacagattttgggtgccgggtcttttccmcggcawaccttccttcccgatttccatctgcttcttgcagaatccggcttccacagcttgcttctctctgcagcttcactcccttcttttcttttacgtgtgcttgtctccacgtgattcagtgcttggtcctcttctcttcttactctacatcctccacgagcaacttcattgatgactgtggtcttcgctgtagagtcaatatggcccacctgcacttcttcctgctgcagacactacgtccactttcctgcttgagacctccaagtaaatgcatgagtccttcaaagacagcaggtccaaaactctctctgttgaacttgctccctacttcactctttccttttctttcttggtgaattacatgtcatccatccagtcttctagagagaaaactaggaattatacaaatttcccctttctttcttacccttcaaatccacccaaacaccaacaccttctataattggaccctctcatgtccattcactsccctaaacttgtgactgaattcagactctcccttgattccttctccaagctcaaacaaatccccttgatccagctccgcccagatctccaggtcctctcgcccttactgctgttaccctagtgcagaacatgagcatctcttgcctggctcttggtgacacccttccatctgctttcctcccttatcatccatcaccagggcatgctctttacatatcttcatgccttttgatctgttagaaaagcatccccaagatctgtctatttatatatgaatcatatacattgtcaccagctaagatagactgtgtgttatcaatgcctaaaaaggaatatgatcaggttatactaacaataatatatagtttaaaataactaaattgcattaatttatttattattattatactttaagttttagggtacatgtgcataatgtgcaggttagttacatatctatacatgtgccatgctggtgtgctgcacccattaactcgtcatttagcattaggtatatctcctaatgctatccctccccgctccccccaccccacaacagtccccagagtgtgatgttccccttcctgtgtccatgtgttctcattgttcaattcccatctatgagtgagaacatgcrgtgtttggttttttgtccttgcgatagtttactgagaatgatgatttccagtttcatccatgtccctacaaaggacatgaactcatcatttttttatggctgcatagtattccatggtgtatatgtgccacattttcttaatccartctatcatttttggacatttgggttggttccaagtctttgctattgtgaatagtgccacaacaaacagatgtgtgcatgtgtctttatagcagcatgatttmtartcctttgggtatatacccagtaatgggatggctgggtcaaatggtatttctagttctagatccctgaggaatcgccacactgacttccacaatggttgaactagttggcagtcccaccaacagtgtaaaagtgttcctatttctccacatcctctccagcatctgttgtttcctgactttttaatgattgccattctaactggtgtgagatggtatctcattgtggttttgaawtgcatttctctgatggccagtsatgatgagcattttttcatgtgtcttttggctgcataaatgtcttcttttgagaagtgtctgttcatatccttcgcccactttttgatggggttgtttttttcttgtaaatttgtttgagttcattgtagattctggatattagccctttgtcagatgagtaggttgcgaaaattttctctcattttgtaggttgcctgttcactctgatggtagtttcttttgctgtgcagaagctctttagttgaattagatcccatttgtcaattttggcttttgttgccattgcttttggtattttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagataagtggcattatttctgagggctctgttctgttccattgatctatatctctgttttggtaccagtaccatgctgttttggttactgtagccttgtagtatagtttgargtcaggtagcgtgatgcttccagctttgttcttttggcttaggattgacttggtgatgcgggttcttttttggttccatatgaactttraagtagttttttccaattctgtgaagaaagtcatcgatagcttgatggggatggcattgaatctataaattaccttgggcagtatggccattttcacgatattgattcttcctacccatgagcatggaatgttcttccattggtttgtatcctcttttatatcattgagcagtggtttgtagttctccttgaagaggtccttcaygtcccttgtaagttggattcctaggtattttattctctttgaagcaatcgtgaatgggagttcactcaagatttggctctctgtctgttattggtgtctaagaatgcttgtgatttttgtacattgattttgtatgctgagactttgctgaagttgcttatcagcttaaggagattttgggctgagacaatggggttttctagatatacaatcatgtcatctgcaaacaggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattccgtatgatattggctgtgggtttgtcatagmtagctcttatgattttgagatacatcccatcaatacttaatttattgagagtttttagcatgaagggttgttgaattttgtcaaaggccttttctgcatctattgagtaatcatgtggtttttgtctttggctctgtttatatgctggattacrtttattgatttgcatatattgaaccagccttgcatcccagggatgaagcccatttgatcatggtggataagctttttratgtgctgctggattcggtttgccagtattttattgaggatttttgcatcaatgttcatcaaggatattggtctaaaattctcttttttggttgtgtctctgcctggctttggtatcaggatgatgctggcctcatcaaatgagttaaggaggattccctttttttctatttagtggaatagtttcagaaggaatggtaccagttcctccttgtacctctggtagaattcggctgtggatccatctggtcctagactctttttggttggtaagctattgattattgccacaatttcagatcctgttattggtctattcagagattcaacttcttcctggtttagtcttgggagagtgtatatgtcraggaatttatccgtttcttctagattttctagtttatttgtgtagaggtgtttgtagtattctctgatggtagtttgtatttctgtgggatcrgtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcagttttggatttttcctgctttctcttgtgggcatttagtgctataaatttccctctacacactgctttgaatgtgtcccagagattctggtatgttgtgtctttgttctcattgatttcaaagaacatctttatttctgccttcatttcgttatgtacccagtagtcattcaggagcagattgttcagtttccacacagttgagcagttttgagtgagtttcttaatcctgagttctagtttgattgcactgtggtctgagagacagtttgttataatttctgttcttttacatttgctgaggagagctttacttccaactatgtggtcaattttggaataggtgtggtgctgaaaaaaatgtatattctgttgmtttggggtggagaattctgtagatgtctattaggtctgcttggtgcagagctgagttcaattcctgggtatccttgttaactttctgtctcattgatctgtctaatgttgacagtggggtgttaaaagtctcccattattattgtgtgggagtctaagtctctttataggtcactcaggacttgctttatgaatctgggtgctccygtattggatgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacrtttaaagttaatattgttatgtgtgaatttgatcctgtcattatgatgttagctggttattttgctcgttagttgatgcagtttcttcctagtctygatggtctttacattttggcatgattttgcagcagctggtaccagttgtgcctttccatgtttagtgcttccttcaggagctcttttagggcaggcctggtggtgacaaaatccctcagcattttcttgtctgtaaagtattttatttctccttcacttatgaagcttagtttggctggatatgaaattgtgggttgaaaattcttttctttaagaatgttgaatattggtccccactgtcttctggcttgtagagtttctgcygagagwtcagctgttagtctgacgggcttccctttgtgggtaacccgacctttctctctggctgcccttaacattttttccttcatttcaactttggtgaatctgacaattatgtgtcttggagtygctcttctcgaggagtatctttgtggcgttctctgtatttcctgaatctgaatgttggcctgccttgctagattggggaagttctcctggataatatcctgcagagtgttttccaacttggttccattctccctgtcactttcaggtacaccaatcagacacagatttggtcttttcacatagtcccatatttcttggaggctttgttcgtttctttttattcttttttctctaaacttcccttctcacttcatttcattcatttcatcttccatcactgatactctttcttccagttgatcgcatcagctcctgaggcttctgcattcttcaygtagttctcgagccttggctttcagctccatcagctcctttaagcacttctctstattgsttattctagttatacattcgtctaaatttttttcaaagttttcaacttctttgcctttggtttgaatttcctcctgtagctcggagtagtttgatcatctgaagmcttcttctctcaactcgtcaaagtcattctccatccagctttgttccgttgctggtgaggaactgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacaaacaggaccctcagctgcaggtctgttggagtttgctagaggtccactccagaccctgtttgcctgggtatcagcagcggtrtctgcagaactatatttattaatactacaaaaatatctatgcttcatcaaaataatgagattaaatgactttttaaaaatcttggttttggccaggtgcagtggctcacacctgtaatcccagcactttggtaggctgaggcgggtggatcatgaggtcaggagatcaagmccrtagtggctaacacggtgaaaccccgtctctactaaaatataaaaaattagctgggtgtggtggcacgtacctgtaatcccagctgctcaggaggctgaggcagggcaattgcctgaacccgggaggcggaggttkcagtgagccgagatcgtgccactgcactccagcttggtgacagagtgagactctgactcaaaaaaaaaaaaattaagtgctaccttccctggccaggccacactgtgcctctctgccattgcacatccttggtctgtgaccctcccctcaaacagtcaccttctccctaaagttgccaccggctttaggaatcacctgctgttcccttccctgtgcaaccacagcaccyctacatccacctgaccaatccattgagcttctccccatcagggaccatggcttatccactcacaggctggagcagcagccctcagctccttcctgaataaacgaccacacaaagtcaaacaccctaaaagttcatctctaagtgtatactgaattccccacctctgggcgtcttttgttaaataaccctccccagcttccccctactccacctggaaaaatcccacccctggtcggaggctgccctcccaccatccacttggtgaagttttctttcacctcactcagttccccattgccccttttgccctcaaaaaccaaacaaaactggagctgtgttctccctcctcagtgccttagagaaatgttagcctctcttgtgtgattctaagtcratgctgccctgcagggtctttatgagtgttccgctgctgtctcwcctacaaacrtgtctgtaagcaccttcagggaggggactctgtggcctggggaaggccgactaggtgaggcagagaattaaaacacaggaacacacaactgctgggacagaggccatctggcaggcacccrtcrttcctgtgaggagaactcaaatctcagaagctcatgcatttcgtagcagagtcaggagctacacatgaaaaacacacctgtgctccctcaactggggatcgtctcactaggctgcacctcctgagagctaaagtgcgtctcaaaagccccactgttccccctgtgttcctataataggagcaaagagaggctgatgtctctttggaggtgcaaactcattttgacaaagaatagcaaggcagttaaacagggaaatatcgtactttttttttttttttttgaggtggagtcttgctctgttgcccaggctggagtgcagtggcacaatcatggctcgctgcaacctccgcctcccaggttcaggcaattctcctgcctcagcctcccaagtagctgggactacaggcgcgtgccaccatgcccggctaatttatgtatttttagtagagacagggtttcaccatgttggccaggatggtctcgatctcttaacctcatgatccgcccrccttggcctcccaaagtgctgggattacaggygtgagccactgcgcccagccggaaacatcatactttctatggcacactagacactcagtaaatccagatgggattgcaatgcatggaagcagctccctggagaaagtcggatttccctggaaaccacactggtattggccccaggaggtcactgactgctggggcagcactcacccagttgcacatcatggtggcagagccccgcctgtccagacctgacttcccagcttctgaggctgaaggagaacagatgaggcttgctctggcgtcgttcggtgaaaccactgttcctctctcgctgctttcccgggtttccttrtgcattttgagctgtgcatctgattctttgggtcaaagcaaggactgaaaaagagcagaacacaagaagagatcacaatgaggcaaggtcccggggctgagagagaaaggggccacccttgctggtgtttctccaccacagtctctttaaaaattgggcatgggccgggcatggtggctcatgcctataatcccaggactttgggaggcggaggtaggcggatcacctgaggtcaggagttcgagaccagcctggccaacatggtgaaaccccgtctctactaaaaatacaaaaattagctggatgtggtggcacacacctgtaatcccagctccccaggaggctaaagtaggagaatcgcttgaacttgggaggcggaggttgcagtgagctgagatcgcgccactgcactccagcctggccaacataagcgagactctgtctccaaaaaaaaaaaaaaaaaaaaaaaactgagcatagtgtgaccatgacagcttgaggtttaaaaccaagaggcacattatgctatggaaggaacatcacgtggtaaaatcctgaaagaccagattcagaacattgctctcagctcactaactaggagactttaagtaagacctttggcctttctaagcccaatcatcaccccctataggagagggataactgtgcctagctcaggggggttcttatcaataaaagacataacgtctgcaaaactcctaacacatatcagtattcctgaggcgaacactctgctgcacgtgtgagtttgcgttttacttcttcctcctaaggtaaaactgaaattttttaccaacatcgccaagctttgaagccttaatttgcaccacagctgtctcctgtccttccaaattttctttttgtttgtcctgccaaaacgaagttgtttacaaagatatgtggttcagagacgtttctggttgctttgacgccgccttgtgggcaagtctcggaaattgcatgtgtccctggcccagcaaattgagcaaagattktattaggtgcatcttatatttccttatcattctccctgggtctaccttcagatgattccttaaggcaaagcctattttttctaaattataaagtaaactttagcatgtaaatatcgaggtaagagtagtgggtagcatttttatattggaaatcagtaacattgcaaaattctgtttgcaacwttattttcagaaacggggacaagtgcatcatcaaagcagatatttatcataacatttatagttgtcccataagacaaatcatcttgactttgctacttttcactggatctcacaagaagcttataagaagcgggccagatatgattcccgtttttcacaaacragaagggtgaaagggtcctcccaaaactacacaataagggattaagccagaagtagagcctgtgacgttttacatggccagaaaaactcttgtgctgctgttgatattgttcttctgtttgtttagcaagtctgccttagagaracttcacagcacccctgggcctcacttagcactgatctgtctcccaggagtgggccccggggtggtggagggtcagggatggggttgccgtgcacatcagtctgctccatctaaaaaagctcaccgacatcaaaacatgtggctttcctagaaaatactggaatgtctggaatttttttttttttttttttttttttttttttgacagagtcttgctctgtcacctaggctggagtgcagaggcgcgatcttggctcactacagcctccacctcccgggttcaagcgattctcctgcctcagcctcccgagtagctgggattacaggcgtgcgccaccacacccagctaatttctgtgtttttagtagagacggggtttcgccatgttggccaggctggtctcaaactcctgacctcgggtgatccacccgcctcagcctcccaaagggctgggagaatggctggaattgtggtgtcattttcttttcaaggccatcagtgctgcaattctgccattcattccaaaggcccattagagaaggaagagaaaaattccatgtcatacgagtagcgccaacaaaaaaataccttctgcgtgcgtgtgtgtgtgtgtgtatttatgtgtgtctgttcacagatgcacccagctaagcccaaacacattacaaggtagwacagatgttcatccccaagagagtctgactgtcttgcttttaagtttagtgcctcaatcctattattccttctccattttgttttggctaataaagcaacttgcccgcaactcatccttggagcagcagtcatgaattaacgaagattttttttccctcttttccattaaaaaaaattttatgtgccactaytatgtcctagggttttgtttttaattgtgggaaaatacacgtaacatgaaatttaccatctgaactatttttgtgtacagttcagtaatgttaaaaatagtgccaggtgcggttaatcccagcactttggaggccgaggtgggtggatcacttgaggtcaggagatcaagaccagcctgatcaacatgtgaaaccctgtctctaccaaaaatacaaaaattatctgggcatggtggtatgcacctgtaatcccagctactcgggaggctgaggcaggagaattacttgaacccaggaggcagaggttgcagtgagccgagattgtgccactgcactccagcctgggtgacagagcgagactccatttcaaaaataaatagataaataaaataaagtgtattgtatagttgtgcaatcaatctccagaaggttttcatcttgaaaaaccaaaactctgtccccattaaataccagctccctattccccctccccacagctcctggcagccactattccacttcctktctctagaatttaactattaggytggtgcagaagtagttacggtttttgtcactgaaagtaagggcaaaaacttctgttaatacttaaggtaccttatgtaagtggaatcattcagtatttgtctttccctgcctggcttacttcacttagcataatgttatcaaggttcactcacgtagcatgtgacaggtttcccttcaccttgaaggctgaataatattcctctgtgtggakgtaccacattttcttcaacgccttccctatccctcctccctaccctctgcccagaccctggcgactgccactctcagcttctatgagttcaacgtgtttacgtttcacatataaatgagatcttgcagcatttgtttttctgtgcctggcttgcttcactcaacatcatgttttccaggttcatccatgttgttgcaagtagagattttctcctttttcagggctgatactcccctgtgtatatatagcacagtttctgtatccatttatccactgatggacacttrgagtccatatcttggctattgtgaatgaagctgcaatgagcaagcaagtgcagctgtctcctctacatactggttttatttccgttggtaatttacccaccggcacattttccttatttctttcatccatggatgggtcctaccatgtaccatctcagagaagcttaggcacagtttgttgggatgtcagacgctgagcagaatggcgcgtgccctctaccttccaatgtccaaaaaggaattcattgaaagatcaacatacaaagccttttttgccagaagagtgggttggtgaaaggataggaatctttcaaaatgttaggtaggcttccagactttaaatcctcctccctaacagatagactcagaccccgctatcgagctgtaggtagctcttagagatctttcatttctagatttgagtgctttggggttttttttgtttttgagwtggagtttctctcttgttgcccaagctggagtgcattggcatgatcttggctcactgcaaccactgcctcccaggttcaagcgattctcctgcctcagcttccrgagtagctaggattacaagcacccaccaccacacctggttaatttttgtagttttagtagagatagggtttcaccacgttggccaggctggtctcaaactcccgacctcaggtgatccactagcctcggcctcccaaagtgctggaattacaggagtgagccactgcacccggcctagatttgagcactttgctatcctaggttctctttcctggcacaggacacaatttgattctgcatgtcagtgattagagttgtgccccctgaactgaacagccatagatagcaaggctttaaggaagggaactgtccagatgacctctttggatgcctgattactacagagtttatgcaaagactcaggacagtacaagtcagcaaagcacgtaggcttggtttccaggctcacaccagagccactgaagaacttagacacataccagctttcttaggtccaatatctgccacctaagttcccatgtcactgatgggaaaataaaaactaatggcatagtttcattgtttctttataagcagaggaaaagtacaaattgaaactgaaaagtgtttactcagactcaaactcaaaaatttcagcattgtttagacactgctctccagtcattggcttcccaagagatgggtttcagggtgatctttcttgcacaccatcatcctcgaccatttactgagtggccttgagacgctcaggaagagttgtcactcctcagcctcattcctgttaatttcctgtctgccttttggttgtgcagatcttgctgggtcagaaatacaaccactctgtggactggtggtccttyggggttctcctttatgaaatgctgattggtcagtcgcctttccacgggcaggatgaggaggagctcttccactccatccgcatggacaatcccttttacccacggtggctggagaaggaagcaaaggaccttctggtgaaggtaagaagcgaagccaagagcgtcttcataagacgagcattaggtcttctggtcagttttctgttcctcttagtttccaacttgcatgtggcaaacaatgattattattgaactgggtttaaatgggatgtgcaccgtctgtgttttaatagaggcaccaatattatgagcattaaatgtcaaaatgagtgtaagagaaaccctcatgtgcatcagttataacataacggcccaggaaccagttccatgaccttgaatacgctcacctggagatgtagttggttcattaaacaagcacagtgtgtggcttaaaaatcaatcttctagctacttgggaggttgaggcaggaggattgaagttggaagtgtgaggtcagcctgggcaatgtatcgagacccctgtctccaaaacaataaagggaaaaaaaaaagaaacaaaatgggcatttaggctgggygcagtagctcacacctgtaatcccagcactttgggaggccaaggtgagcggatcacctgaggtcaggagtttgagaccagcctgaccaacatggagaaacacggtctctactgaaaatacaaaattagccaggcatagtggcacacgcctgtgatcccagctactcagaaggctgaggcaggagaaaatgggcatttatgttatatagagggtttttttttattttactcagtcttttgtttcccatagttttttattagaaatattcagtccagttcatcttcccctgcctctggttgaaatcttggacaggatgtatgactttttggcctgctcttagataaaagacaacctattgtcactcttatgttatgaaacactgtctcagtggggaaattaaaaccatccagtctgggatattattcatcacataacttttttcttttttgagacagtctcactccctcacccaggctgcagtgcagtggcatgatcttggctcactgcaacctccacctcccaggttaaagcgattctcctgcctcagcctcctgagtagctgggatcacaggtgcaygaccacactcasctaaatttttgtatttttagtagaggtggagtttcaccatgttggccaagctggtcttgaactcctgacctcaagggatctgcccgcctcggcctcccaaagtgctgggactacagatgtgagccaccatgcccagcctcatcacataaattttaattttaaagctgggactcctgcttcctttcctctgctcagagctcgtgattggcagctgctcactactggaggagacagtgttgtcatgctcttgctggctgtgttcttgttctcttccattctaactcctgagtttctgcttcagaccttaccaggtagaagctgagagaggaaagaggatgagcagaaaaaaacagttcttattcggctggcagcctcctacccctgaactggaggatggctaaagctgagacttcaatgaggcactctactaggttctgcagaaatacttatccttgcagatgtgtttggctgaaacccttgagatacaggcattcagtccagtccctggcctatatactgtaccaacgstgattctgcaagactctctcactgttggtttcctgcccagcagattgtcytgggcagtgtactagtctgttctcatgctgctgtaaggacatacctaatactgggtaatttataaaggaaagaggtttaactgactcacagttctgcatggctggggaggcctcaggaaacttgcaatcatggcagaaggcacctcttcacagggcagcaggagagagaatgagagccaagcgggaagggggaagccccttatgaaactatactctcactatcataagaacagcatggggggaaaccgcccccatgattcaatcacctcccatcragtccctcccgtgacacatggggattataggattataattcaagatgagattctgggtggggacacaaagccaaaccatatcagccagtacagttgacctttgaacagctcagcagttagaggagccaacctcctatgcaatgacaaatctgcatatagcttttgagtcccccaaaacgaccaccaataacctactgttgaccagaagccttaccaataacacaaagtcaattaacacatgtgttatatgttatatgtatgatatactgtattcttacaatctaagaagctacagaagaaaattctattaagaaaattataggaaaatgtgtttactgttcattaagtggaagtagatcatcataaagatcttcatccttgtcttcatgttgagagggctgaggaagagggggagttggtcttgctgtcttaggagtggcagaggcaaaagaggtggaggaggtggaagggaggcaggagaggcaggcacacttggtgtaaatttgattgaaaaaatctacatattagtggactggtgcagttcaaatcyaggttcatcaagggtcaattgcacttaaaatacctacagaccagctctccccaacctgccctacccactgtccaccagaaatattgttgacttcttcactctaacaaactctgagagtacaggctattaccatcttagcagcaatctccagaattcaccatcaaaacggaattcagcgccctatccgtggtagcccaggatccatcgagaatacaggcacagtattacaggtggaaactgggctctgagaatcacaaggtgtgagccaggagctcccaaggcaaacccacgtggagacagaggaacacctgagagccatcaagaaagatctggactctagacagactcagagttggccttttttgaggatgcgaaatattctccacagtgtatgggcgtagcaagttgtagaatgaaatgaatcatgtcaatacaacatgctaaatacatagaagaataataaggacctacatatactgagctgtcccagcaaatatttgggtcaaagagacccatcactgtaatcaagagcctagcacatctaggctgggtgtggtggctcatgcctggaaccctcgccctttgaaaggctaaggtgggaggattgcttgagcagcccgaaattcaagaccagcctgggcaacatagcaagaccccatctctacaaaaaatctaaaaattagccaggtagggtggctggcgcctatggtctcagctactcaggaggctgagatgggaggatcacttgagcccacaaggtggaggttacaatgagccatgatcacaccactgcactccagcctaggtgacagagcaagaccctgtcccccccgcaaaaaaaaaagagtctagcacatctaaaggaagtggaccaagaatgcaggtgttttggaagaaacattgttttgatttctggcatttcatatgtcagctggttaaaaaataatcatcatttagagaaataatttttagccttgttcgtgctatattgaaaatgggaataggataagatccttcaacattggaagctatccatgggttctaaattaaaaactagaaaaatattagcaggctcatcttttttcactaatctacttttttgcttttgaagaagtacttagaattaaatgtaaagggaatacacttccacctctctaataaaagtgacaacttgtcttgggcattagaaacttggaggcaactccagggctctccctggaaaatcaagatcttgaatmtgagaagtgctgacaaagccctcacaggatccccagcccaggggtaaaggaacaagatgtttaaaaatttgagccacttccattcagctttcactttctgactatgatccaaacaagcaatarcttagaaaactccctcaacaatcaattaaaggcacttttaatgaccaaacacagataaaatgaaaactaatctcaaaattaaccaatttttttaaaaaggctgacaacagtaaaaataagttagtgggagccgggcacggtggctcacgcctgtaatcccagcactttgggaggccgagatgggcgrgtcatgaggtcaggagatccagaccatcctggcttacacggtgaaaccccatctctactaaaaatacaaaaaaaattagccaggtgttgtggcgggcgcctgtggtcccagctacttgggaggctgaggcaggaaaatggtgtgaacccgggaggcggagcttgtagtgaaccgagatcacaccactgcactccagcctgggcgacagagcaagactccatctcaaaaaaataaaaaataaaaaaaataataagttagtgggatctggatataaagttttttattttatataaaggcaggttcaaacactattacaattgctacatttgtagcaataaatgtagcaatcgtaataatgaactcagtgtgaaatgtgtcagcttgggctccataacaagatatcacagactgagtgggttaaacaacagacatttctttctcacagttttagaggcagaaagtccaagattaaggtccagcagtgtcagttcctgatgaggactctcttcctggctkgtagacagctgccttcttgttgtgtccttacagcagagagagagagagataaactctggtctctctttcatgtgagacttctagccctattggatcaagaccttaccccatgacctcatttaacccgaattatctccataaagcccttacctacagttacattgtgggttagggcatcaacatrtgtattttgagaggacgccattcagtccaaagcatgaggctgcactgcaaagcctgggccagcaaaacccactggaaaaaagtgagcacaaggcttagtctgtacaacctgaggcgtgagagcacctccagactcaggggctgtctccaagtgagtcccaaggtggaggctctggagggagagtcacaatcccccaacacccctcatggcccataaatgccagcttccccctgtgcttcacaaacccagcctaccttgaggatatgcaatacttcaggccaggacggagagtgaaggagggacagaggtaaccagaagtaattccgtggagagaagttggaagtgatgatttccaaggagagaaagattggatgggaagaaagggttccttccagttggaggagaaaaggtgaaaagccgtgtgctggaatcctactcagcaatgaaaaggaacaaactattgatctataaaacaacccaaggcattatgctgagtgcaaaaagccaatctcaaaagatcacatactctctgagtccattgatataacttcattaaagtggcaacaccatagaaatggaagtcagattagtggttgcctggggttggggtgctggggacaggagggtgggcgtgactctcaggatgcagcacaggtagatctttgcagttatggaacagtttgtatcttgcttggcgtggaggttgcccatatctgcacatgtgataaaatggcataagtagtatatacacacacggtaccaggccagctcctaatcttatgctatcattacgtgggatggaaccgttgggagaaatagggtgaagagcacccaggacatctctgtactgtcttatcaacatcctgtgaatctataattatttaaaaacaaaactaaatctaaggctaaatgccttgcaaacacccaaataaaaagtcatctgcagagtttcagtggcaagagaaagagttgccacaagagaagaaaataaatttggttgaatagagcagaaactaagataataaagtttaaagaagcaaacaagaggactggtgggtgaaagaggttcttttcttttttaagacagagtgtcgctctgtcacccaggctggagtgcagtggtgcagtctcagctcactgcagcctatgcttcccaggctcaagcaattctccagcctcagtcttccatgaagctgggactacaggtgcatgccaccaatgcccagctgatttttgtattttttgtagagacrggttttgccatgttccccaggcaggtctcaaattctggagctcaaagcaatctgcccgcctcagcctcccaatgtgctgggattacaggcatgagccaccattctcagtaaaaagaagttctaaatgaagcttgcccaacccacgccctgcatacagcccaggatggctttgaatgcagcccaacacaaattcctaaactttatgacattacgacattttttgtgatttttgttttagttcatcagctattgttagtgttagtgtattttaggtgtggcccaagacaatccttcttccaatgcggcccaaggaagccaaaagattggacactgctgttcaaagttgacatagaagagtttggacttgttatttcccatgtgagttagtaaaacttccatgaactttctcttacacatattcttgcagttgggctgataaaattaatttccattatgcaatctgctgcccataaactggcttgcagctttatctctattcctcctttgctttgatccaacagcccccacattcttgagccccatttgttgcaaaaataaaaggtaatgccctttctcagaaacgtcttctagggaatttgacaaaatgttatgaaacccagaagtcataggtcctcyggaaaagctgaggatagcagcatttcatggcatctgtgacagcagcagtgccagacccgttgccattggcccacctagggcatggatgcatgtcgtgcactgaacaattgcccactgggagaggctgtgctctggcaagaattccagtggggacactgctgtccagttgatgattgccaaagaaacaccctttactccccgtctctactaaaagtacaaaaaattagccaggtgtggtggtgggcgcctgtagtcccagctactcgggaggctgaggcaagagaatggcatgaacgcgggaggcggagcttgcagtgagccgagatcgcgccactgcactccagcctgggtgacagagcaagactccatctcaaaaaaaagaaaaaaaacactctttacttcctcatttatccatccaggatgtcctgtctatttgtttgaaaatgatgggaaactaatgatatagaacataaatatctcttcctttcatagaaagacatatctgaggagggactgaagagggaaggcaggytccaggtacaatctgtcagcactactgctggctgtcctctgcagcctggagctgctttcttgcacagactgtccaataaacttaaacaaacttcaactacatcctggctattttttcccatcaatgtaaacctccgtcctgacagcttttacagacaaaatcaagtcttcaggtattttatttcctcagtgcagctttccaggggcggagcttccagcctggccccactcccatgaggtcacctgtcatcctcaggacctcagtgggttgagtcgctgcaaggcagaacatatactaatttaccgttctgtgcaaaactggaaagaatattgacgctcagagctggagaccatatgctcttctcattacacatttwattttttaaaatatatttttaaattttgcaggtacacatccaagctaagaaagcccattgacatgatcctcttggtacaaataccacatgttcactggaagaaatagaatagaaaacccagcctgcagcacacacggcccagggcagttacttccagcctactttgctgaagcatctcattagaacaacatgagcgaggttttggccccttcctgagacacttacgccatctatctaatctcgtttcatccaaatgtccttaagaagcagagaccaatcatttatcatttagtatcattgtttcaggagaagggatatagggcaagtcacttattccttttgcttccttttttttttttttttttttaaggagtcttgctctgttgcccaggctggagtgcagtggtggtgcratctcggctcactgcaacctccacctcccaggttcaaatgattctcctgcctcagcctcccgcatagctggggttacaggygtccaccaccacacccggctaatttttgtatttttagtagagatggggtttcactatgttggctaggctggtctcaaactcctgacctcaggtgatccacccacctcagcctcccaaagtgacgggattacaggcatgagccaccgtgcccagcccctctttgcttckaaaacatcaatcagctccatgtgatgactcctgctgttttatggtttgtataaatgtatggggtgcaggtgtcatttcgttacctatgtggattgcacagtggtgatgaagggcttttagtacccactccattttctgagtctacagaaaaatatatcttaccgtgaacttggtgcttcttttctatgctgaaaacaggcaaccgagataaaatgaggatagaagatgcgtgatctgcagataaacaaaatggaaagacagcttattcacttactctgcaggcatctactgagcatctatgttgtgcacggcactatgctagcttctgtaaggaatagatatgtcaatggtgcccggcctccagagcttacagtgtggtaggaaagaagacaaccttggaaraaagatacaatgtgctaattctccagtggagcgaagatgttgtgtggtacacagatgagagattatccatcaggatgagggggaaggaggccrcttgtcatcaaagtgctagatcctctgaagctcggcttcctcagcygacaactgggatgatgaatttgtttctcttagaatttgtttgaaaatcactgaggcatctagcacagtgcctgcctctcaaagaacattggttggagtggatgwtgtatcagtcgtaagaatcatgagtgatgtgaatgatgtatgatagggtgatcaatcctgaatatgacttgaacagaagagagagagctccctgtcaggggaggtaatcaaagaaagtttcacaaggaaaagggggtgaaagctgagccctgaaagataaggcagaatttaaagatgaggggagggaagcaggagtcgactaggggagggtrtctcatggcaagatggaaatgtcattagtgagggacagagacaggaaggcaggtggtgttttcggtgagcagaaatgtctggactggagagggtcctaatgggaaatggwaggtcctgtgagtcagcgtcagactccagagagccttgaatgccagccgaggrcccgaggatgtcagaactctccaagccctagagatcaccttgtctagcccttcctttacacacgaggaaactgagactcagaaaacttatccaaggcgacgtgggtagtcagtctctcggatagctgtcgtgttatttccaccgygcagtggctttctaattgggtactttggaaccccaagtttccctagagagtcctcagcagtccccatatggtaagggggagagaggaagttgagactgctaagaatttgccaatcagatacaccgggtgattgcacaaacatttcaccyggaactttaaaagattctcctactttttttwaaaaaagcgaaaaaacttcactttacaatagcatgttgtttggtctttatatttttttggtagaacggagcctttgaagattttcaagtactcagataacacaagtgaagcactatttcagaacatgcaggctggctatgtttatgagcagtaaaaacaagagactcgcaatttaggtgtgaatggaggtcaagtccctgggaaagcctcctggaaaatcacgcgttccaccatgttttctgttttaaagaaccttaggctccttaaaatgccctataactcatggttacttcataaataaacatctagctgatgtaagaataacyggtaactactccagacacccaggggacctgttacttttctaagttaatgtttagactctcctgtttcttaatgcccttgacaggttttatttaagtttgaaaaatatccaagtttctttcctgtcttgccagtgttcattttaacttcttaggcagaaagaacaggagaaggaacagtgcagagaggaatgtacatatgtatgtatgtgccagctcagaaattattagatggaccttgaattaaatattgctcctccagcaggtttgcaggagctgagggtaattctcttcactcagatgccttgtagagtccaaagctgactgtctgggactagtttctattatacctgagtccccacaatgctggaatcattctaagaatgcagctttgtaagaaatcagactggagtgatggataattgatcaaatgacaaattatcactgactctatgctgttgggtgtaacagaccaggagttatactgcacaaatgcgtgcgtgtgtgtgcatgtgttcctgtacgtgtgtgtatgcgtgtgtatgcctgtccgtgtgcgtgtgctcacatttgtgttttagtgggtgtgcaggtgtatgtgttcatgtccatgtgcatgtgtatgcatgtgttcatgtgtatgtatgtctgcacgtgctcacatttatgtgcatgtgtgccagtgtgtgtttatgtccatgtgtgtatgccgtcacatgtgcctgtctgtgtgcacgtgtgtgcctgtctatgtgcgtgtttgtgtgtgtattgctgtcttataaatcgtcacatcagccctgttaggagggcmcttggcttactttacaggtgaggaaactgactcaggtttgtcagttgcctaaggtccaattaataacacagggcaaagccggtttcaaatcaggtctatgcacctcagaagataacgygtcagactccagcaaatttagaaaggcttcttcaagggagagtgccaggacaggttgactttagtcagtcctgatgaaggtgagtagaaaaatgaggttagaaaagaaggggctggtgcaccaggaagcaccacgmcctcctgatgcaaaagggtcatccctggagacctcagggctcctgctctgctccctttcagctcttcgtgmgagaacctgagaagaggctgggcgtgaggggagacatccgccagcaccctttgtttcgggagatcaactgggaggaacttgaacggaaggagattgacccaccgttccggccgaaagtggtaaggactcgctcatgggccgcttggtgtcagccactctccctccgctcagggccgtctgcctgtccaagtcaccgcagctgctcacccctgccggtgccccaactccccaccagccccactctccaggaggaatgcacgtctctaacacatgttactgggctggtggggcagggaggggaggtcactcttgtttgcaaaatttaatctctgtcgtcaagatgcgcctgcatgaagaatggattgctgtgtgtccacgccttaggttgaatatgaatttgtgagggtgactattaaacaagatgggggttgtgcacatgacacatacgtacttaatggtccagtctgggtaacccaaacttggacataaaccctgcatcctacgtcaggaattttggagctgttttttccatgatgtttattaaagtatctgtaaagtgctcatataacgacatttcctaagggtaattgttaggtgttctttggtttaagggagaaactaactaaatccgtgctttaaaaaakataggtctgtacatttccatttatgtcctcactggcaaaagtcattaagctacatcagcaaaggcagaatgacctggctcacctgcgagacgggccaccataaagtgaagtcaaaaataaagcaaggttgggctgggcatggtggctcacgcctgtaatcccagcactttggaaagccgaggcgggtggatcacctgaggtcaggagttcgagrtcagcctggccaacatggtgaaaccttgtctctactaaaaatacaaaaattagctgggcatggttgcgggcrcctataatcctggctactcgggaggctgaggtgggaggattgcctgagcccagaagtttgagactagcctaggcaacatagtgaaaccccatctctacaaaattaagtgggcttggtggtgcatgcctgtagttcaaactcctcggtaggccaagacaggaggattacttgagcccaagaggatgcagtgagctgggttcacaccactgcactccagcctggtgacagagcgagagactgtctccaaaaataaaactttttagaaaaacaacaaaaaaaagtcattaagaaagtaaattttaagttatgtatatcacaatttctaaaaataatgatttttaaaagagtagagcaaagttgtgggtttgccagccttaaccattccctgtgattgcctggatagacatgggccatatccgygctgaagggggccaggctcatggacttcccaacagattccaccccagagaacgcacaggctattagtcatgatagcgaatggccagaagaagcaggtgcatctcattcccagggcaagaatagttgttctcaacatctgtcccaagctccagtgatgttccaaggacccaacaggccagcctcaagcactctaattayttgtgacagaaccacatctaatacrtgggttagtcatttgtgataaaataaaaattttaccttgtttttagctatcagaactattaaaccatgtctcaccttccactgcagattaaaattgacttaatattttgcacataaaaatcaaaactttgatctaagcttaccctaaaggacattcccagttctgccagtaggaaactttccctgacctgtggtctgagctgccattgacctcacagccccagggccccttggagggtgggaggggcctggttcttcatttcgcttctctgtgttcatagcactttctgttgataatggttgttctcaatcttgggacactgaattgaacaccatactgaacagcatgtatgaaatagatgtttgctttccctttctctgttgtttggtttggttttggtttttttgccatgaaaaccaatggaccaagtggtctgaaaggagtctgtcccagtctgtgctgtctaaaaaagcccaagatacttactaataaaattaacaagggcaggggactgacaacagccaagaacgttgataaaagaacaggaatatgtaattgtgaaattccttctctcttcccatccctccgctcacaccccctcactccctctccccaccaccctcccttatccccaccttgtgttccatgaaaactgaagaggcagaggtcaaattcaggtggatcactttttcaaaggttgccaaccctgcttcatgtaaaccattagaaacattagatcccatttgaatgtctacagtcgtagtctttctgtgaatttatgaatttatattattattaagctgaggacacaggatcacagccatgttcaatgagagctgggcatggtcatctgtaggcattgcctccatttagtgtctctgcaaacaccaactttgccatacgcagatcacggcctagataacaaaagtgaagatcatgaacttaatggctratttttcttctctttctttcttcccttaaactctgactaagaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacacwgcttgggttcctttttcaacttggaaaaagaaagaaacactcaacaataaakactgagacccgttcgcccccrtgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaaygaaatgcttgttgaatcaggggcaaacggagtacagacgtctcaagactgaaacggccccrttgcctggtctagtagcggatctcactcagccgcagacaagtaatcactaacccgttttattctattcctatctgtggatgtrtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcrtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttmatggcaaacaggtggatgtgtaaaaatggaataaaaaaaaaaaaagagtcctcttaatcgtttacttccccgcttgccccccacaagaacttgcttctgctgtgtcagtcctcaaaatgtagctagcattgagatgatgttttacagttgggggattggctgggcacgatggctcacgcctgtaatcccagcactttgggaggccaatgtgggcagatcacctaaggtcaggagttcgagaccagcctggccaatatggtgaaaccctgtctctactaaaaatacaaaaattagccaggcgtggtggcgggggcctataatcccagctacctgggaggctgaggcaggagtagagtaagacaaagggtgaggaagtcagatgacattaaggcaattgtaagaaaagcaagtctgcataatattyggagtcactagcctacctcatcacatggctggaaataactttagatattatatttaaaatagaataattaatataagcagactgttgacagtctgcaggtgtgctggaacattttcctgactatacggagctcttgtgattttttttaaatagacactcccctaaaatgaacacgagtaacctcatttaaggatgggcatctatcttcagatgtgtccattcaggtgtccgggccctttgttctgaaaatagcaccatgactacaaacctctagttatgtgagaaggcgacacttgtcctccccttgctccaaatgaaaatgctcacacatgtttaccaaattcacctgcttgaaggagggagagggtcctttaaggccctggatgggccagtggagggcagggagccgcccgttctgttctgatctctgctctgctttgcatttgctgtgaagccctgaacaagtcatttcatcttttggggcctccaagtaatggaggtgaagatgctgtctaaagtcccgtctcactagagtgatggggtcggtgaagacgctatctaaagtcccttctcactagagcaatggggttggtgaagacgctatctaaagtcctcactagagcgctttctggttctaaatctgaatcaaaatcctgcaaagttaaaaggtcagtgagcaacactttccaaaacacagacactcgtggattccactcgctgcaggcctgggggcagctctaccccattttccttccagtcgtcctctcctcactctgggttcccacatacccctgccccagcacccagcatcctcctgacacccagagaccccaacaggacccctaccaggagacaaataagtgaagactgttggctcttagaaacaggaaccaacgcaacttttatcccctccactagaccaaaataaggtctattcatcatttggttttgtttgttttattttttatttttttgaattagagacagagtctccctatgtttcctaggctggtcttgaactcctggactcaaatgatccccctgcctcactctaccaaagtgctgggattacaggcctcatcatttgtttttaataaatgtcatctgtatgaatatgtcaggtgactaacaagcttactatttgcttcgtatttctgagtgtgcgaagtacttgttacttccttctattctttcaggtgtcctctgaaattgcttattaatatccctatttaataggtgagagacctggccaggtgcggtggttcacgcctgtaatcccagcactttgggagacccaggcaggcagatcatgaggtcaggagtttgagaccagcctgaccaacatggtgaaaccccgtctactaaaaatacaaaaaattagctgagcatggtggcacgcgtctgtaatcccagctactcaggaggctgaggcaggagaatcgcttgaactcgggaggcggaggtcgcagtgagctgagatcgcgctactgcactccagcctgggcgacagagcaagactctgtttcaaaaaaaaaaaaaaaaatagaggagagacctgaggcccagggagaccataaagcttacactagagggttgaccagtggagacttgaacccagaactcttagcatcagatcttgcttcattccagagtgcagggtttcagcgacatccaccaatcagcatctgatgattgttcactaaagttttaagtggacttcctaattcagggccacacctggcttacctgtcccccttctaggggacgcagtgcgggggccagtctcttcgatgccggtcctctcatcaccactcccagttcccctccactttgcactttagcctagactcaaccttgccaatagaaatgagaactttacctcagggtatagttaaaggttttggaaaaagagagatcagtgcttctttttggaagatacagactgagagtttggctgagagctccctgtgcacgagaggctggccacagagagagcattgaccaggattttctcagatcccgtccagcaagaccatgcttaggagagaggaagaagtcgtaaatcagccagagaagaagaaatgcctttgttacatcataaaactgcaggcaggggtctgagctctcagagcctctgtctccaatggacccatcaatgatggccaacagaggaagcatcagccttaaacacccacagaccgggaacatcccagaacccactcacaacaatgcaaaccaaggaagacttctcctgccacctctctcctttctctgtcctttcccaacttcggggaagaaggagcagaaaccatggtcatcggactgcggaaggagaggactgagcatgggcgggtgagaagtatgaagacgctgaccacgtgccttccccaccacaagccaccagcactgccctctcgagctagatgagaggacagggtcaactttaaatcggttttcaattattcatggcattgcacatgtaagttacagaaatgaatcttgagggagcaactgaaggacatgtctaatgtcaccggaaaggtcatgggacctctgagatttcagccaaagtttggaagaatgagccccacagagcaggtctgaatggatggtgggcgcaaataataaaggtgttggtttggtttggttttgccccgagaattttgcttgtttacacacagacaagccctagagtgacagtgatgttgctcttggtgccacagctacacaggagatttcttgcacgtagggaccacgctctttaccaccgagcctaccaccctggcagacactcctccatcacgtgcatttgttgagtgagtgggtgaataggatgtgggtgagcacgtctctacaatcctctgtctgtgtggggcctggcacacgagaatgcctggtggaaattacttcgtcctacaggcactacaggattaactggacttaggtatcaggtcctctctcctgaagaattttagacagaggcaaaaaccagatggccaagagaagaggcatttggtaaagaccacaaggcagccaaagggatgggcagcagaagccaggaggtagggtcggtcacagtagcagagacacagggtcgtcctgccaccgcagtgtgggtgactcaaggagggctaagactagcaacttccagtaagttgctctcacttcccggagttactgaggggtccccaaggtgctgggagtcttgcaggcagccctccagtcagtcctgtgttattcctctctctgactcagggaaccatcctgatgggcagcagcccccagccgacggcaggccggggaatgaagccactggctgctctccttccctcaatgccgtctgctcagtctcctggagggtcagtgatgagggaaggagccccaacttccttgtttctccctgcgtcctaaataagtccggaacccaaagagactgagtgtgtccctggggcatgcgtgtgcctgtgtgtgtatatcagagcaagacaccacactgccgtgagcaccaggctggctgactcattgttccctacatgcctgatgtctgctcctgctctagggcttttactcattctctcctaccaggctgaaagggccaacacatctcataaacaaccccaaagccaacccaccccaggcctggctgcagcatcagcctcctgcctttgctgaccacaccagctgttgctgtccagagatgcctcccacctctatttgtcctctgaaataagcatagtgaagagctgggccaaactcccagagcccagagatatttggaaatggagtaggcgccacccaagtttgtttctgtacagcacccaactcactgtctgagaaggaccctcagaggttggcagcaactcccaccagggggtcatctgagaggcacagtgaccacagtgatcaatgatgtctcaccatgaggacaggaaggaaatgcccagccagggaacatgttttctgcccccagcttctgccttccatgtcgtttcttcactctactgcggatgaagctttgactataaaatatgctgttggaatgcaccaactgccctactcccaggtggcagaaggagagctcagttttccttctggaaaattcttgcaattaccaggtactgggtgaagtgctttgtgtatattacctcatttaacccctgacgacaatctctgaggacagcatcattgtctccattttatcaacaaggacactgaggtttggaaagattacacatctttcccagaatcatagaagaagagctggaactagatcccaagcctgtttgatgacaaagcttgtccctctatcaccataaggggagggacagcaagtgggttatggagtcaggatgcccgggtcacacccagcctcacccccgatgtggtgtataaccttggacaagtcacttaaacactcagcctcagtctcctcctttctaaaatgaggaccaaaaaataaagacaaaaaataaaataaaataaggacaataatagtgctagcctcacaagccatatgagaagtgaataacgccatctatgcaaagcacttggaagagtacctaatgtggaataggcacccactaacatagtattattattttattgctgcatcccaacataaatcatttagagacctctttcataggaaaaataattctatctgattgatcacaaagaaagggggtatcaaacctaaatatgaagaagtaaaaaataaaaacttctgctttatttttcttatacagctataaaagcaagatacaatttgtaaaagttaatacaaagaaaactacaaaagtaataacactgacagaacaagactgattttatggtgatgatgacattacgaggctaaaactaaacgactaccctccatgtcaatgtgtcttaactaccatggtgtggtttcttctgagttcagcacggttagatgagcacacatggtgcagtgactcgatctatgcaccacctttctctactggaactatcaaggaagagccagctgtgcagtgtgtcttgatgtcattcaaccttcatttgtcaaaaatgcttaagtgcatctaggctttttcttatagcacatgacaaattaataccattggtggaaatgaagtcatgaacaaaatgcaccacaaactctgaattctgacaccgtctaacagaactttctgctgtgatggaaatgtaccacatctgcactgcacagtatggtagccactagccacatggagctattgttggcttgaaatgtagctgagatgaagaaactgaatttttctttctttgagacaggcctcactgtgtcacccaggatggagtgtattggcacaaatacagctcactgcagcctccacgtcctgggctcaggtgatcctccaatctcagcctcccaagtagctgggaccacagatgtgcaccaccatgcctgattaattttttgagtttttgtagagacagggtctcactttgttacccaggctggtctcaaattcttgggctcaagggatccttcccccttagccttccaaagtgctgggattacaggcatgagctaccatgcccaggctacaacaattattatcttcagaaacactaaggatgtattacat

SEQ ID NO: 1674 - DNA, 67403 bp, Homo sapiens
tttcctatattccatactgattccagctgtttatagaatggaatccttggcttttctaggtatataatcatgtaactaggaaatactgatatctttgtctctttcttccaataacccacataaaactagactggcttactgggtctcgaaaccagccacaacatagaatttcactataaaaaatactagtggctgggcacggtggctcacacctgtaatcctagcactttgggagtttgaggcaggcagatcacttgaggtcaggagtttgagaccagcctggccaacatggtgaaactccttctttactaaaaatacaaaaattatcctggggtggtggtgggcacctgtaatcccagcttcttgggaggctgaggcaggacaatctcttgaacctgggaggtggaggttgcagtgagctgagatcataccactggtggacaagagtgaaactccatctcaaaagaaaaaaagaaatactagtcactctcaaatagaactaaaaataaattgaaattttcacataagtcttttaagaatacctaaggaagaatccaaacataaaacaaaaatctttttttctctctatttcctatccatctagtatgtaatattatctcacacagggagttgcccttctctccaacttcctcccaaaactctttctgtcccaaatttcccttcaaaaccatctcacatagaaccaagtcctttgtccctcatctcctccccaaaactgtcctggataattctttgctaccatatttatatgataaatatgctggtttcacctgctggctttcccagttctctacttcaccattgccctcatcaataagaagtgtccccagtggcaaatagtcaatagaagctaacttagaatgtggtgaggatgagagaagaaagggattcaggctacccacatctaaatttaatgtatttattaaacaatgactttgaatgattctcattagccaagaatatctaaatattgttaagtcctgtagttctctaaacaaccttcgaaggcattatttttatggcatttttatgacacatggaagctttcatgaaccaatttttagataattgtatataattttccattttaaaaagtgtgaaaactgatacttccatgaggcaactggggataccctgaatgccctctggggtcaggaaaatgctttggtgccacctgccggtttccaaagatgtttcaggaacttgctcctgttgatttccaaatctttttttttttttttaattcctagctccctcccagtacatttcaaaataaccaaaaaaaaaaaaaaaaaaaaaattataaattttttggtagcaagagcacaagtgctcaagcttataaaaatgcaaataaatttgtttgggatgcaatatgatgaaacacatacttctcaatcatttaactagtcaattttttttagcatattgccaaaatgtagatttcatatgttgactttacattgctaattacacacatcctatttcttttctcgttatttttctttctttctttatttttactttttgcgactccctctggtacccaggctggagttcagtggtgcaatttcagctcacttcaacctctgcctcccaggctcaattgatcctcccaggctcaactgatcctcccattttcagcctcccagggcgtgctaccatgcccggctaatttttgtgctcattgcagaggtggagtttccccatgttgctcagactggtcttgaattcctgggctcaagcgatatgccagccttggcctctcaacctgctgggtttacaagcgtgagccactgagcccagcaacagatatattttcaagtggatggtatcccatcagttgtgatatatgatgtaaacactctactaataattaaactttgaagtttgtgaaaattttacttttattatagttagaataattctaagttattcctataataatgctacacttattcacttgaattctgatacacatttcttgaacaggaaggagatacagatacagcttatgcacatttatattcattcattcattcgataaataaatatgtattgttaaccacgttccaggtactttatttggtagttaggatttagtagtaaacacgagaaagtcttcaacatcatccttagatcgtgatctctgcatatcacaaatcatacaaaataaatttgcttaaaaatgtgggaacctgcctttcaaaacctgccatttagcactactgtggcataacctataaacctaaacatagaccctcatgatttatgcatttaagtttgtgggaaataggtctcttgtcccttgtcctgaaagtaaaagacaaccctgtctgaatacactgaatatccgtggattgtactgtttccggaccctgcctaagagcatagggagaatttgtttttttgtttgttttttgtttcgttttatttttgagacggagtttcgctcttgttgcccaggctggagtgcaaacggcgcgatgtcggctcactgcaacctccacctcccggttcaagagattctcctgcctcagcctccctagtagctgggattacaggcgtgcgccaccacgcccggccaatttttttttagtagagtcaggattagtattattagtagagatggggtttcaccatgttggccaggctggtctcaaactcctgacctcaggtgagccgcccgcctcagcctccaaagtgctgggttacaggcatgagccaccgcacctggccgggacccgaccaggatgctgaatacagaaatgcttaggtaagagaaaagaaaagttaatttgtcacacttttcctttcaaactacatgaacatatttttgcattataaagtattatatctaagtagttccaaacatggaatttcttatttcctttttttccccccaatttatggttctggatatactcaggaattagtgtagaattctcaacaatcagatatggttgctgaggaacatttaacaatattaaacaattcacatgactctgaaatttgaaaataggtagatacagacataacatgaacaaagggtgataccaattctttacactggcaactaggtggacattgaatgatacgcttgtgagtaatttactttaatgaacaatttcattaagtaatatttaccaaaaaaacaaatacaactttagatttatttaaattattttacttaaaattttgtcactaattaaaccccgtctctactaaaaatacaaaaattagctgggtgtggtggcaggcacctgtaatcccagctacttgagaagctgaggcagaggattgcttgaacctgggaggcggaggttgcagtgagctgagatcacgccaccacactcgagcctgggcgacagagcaagactccatctcaaaacaaaaaaaaaatattgtcactaattatactttacatcttataagaaaggtaaatcttttgaaaaaagtgaaaaagatttaatgtattgctttttaatttaatttatatttttattgaaacattcaaactatatgtttggaatataattaaattttatttttaatcctttttgatcattatttctgatagaacacaattacatgaaaatcttgatcaaacagcatacatggtaattttgctgaaatgaaggtaaattttcatgggctaaatatataggaaatgtattaactatagatgtctttatcactcatccaaaataatcagccaatcaataggacacccggacaggaatgatataattaaatgcaatcagattttgctgattttcatctatgtaaaaacatttttattttgccattataaatgtttactcaccaatattgagagttatagcatatcctagttaataatgtgttaagttaatttataacttttaaatatttacacctacagcagtgagtccatctgtactctttctcaggctccataagtcttagggatgggctttatgccaacgtgctgaagccaatattatagtgagggaatacaagaaataaacaggtaaacaaacagacaaatcaggtcatttcaagtagtgataatggctatgaagaaaataccagcttggtacatctgtccgtcagataaaaatatataattcaagattattacattttttttaaaaccaaagcttttttttaaaaaaaaattacatttatgaacatctgacttgttttcctttttactttccaaagtaaaattcggcatggcactatacaccatcacagctgacataggaaggactgagtcaaatctttgtagcactttttcaagtttcacttaaataaagcttttaaaaaatatatagggtattttttaagcaaaaaaagcaaattatcttatcaatgaaacagacctggtgttcatttcttttaaagtaccgaaagctgattgcttctgtaaaggtaaaactcctgtgacatgttagaaagaaaaaaaaaattcctttgagagatatgtttgtaagaatgaaataggtactactagaattttcatgttattctctgcaaggcactcaacaccacatgaaaagaagattattaacagtcagtagaaatactaataactgaagaaaatatttggttgttttaaatgcttttaaagcaaaccaacaacaaaagattctgtttgtaaatgggagagaatctgcatgaggtatagacaaccagggcctccaaatttgtagctgtgtttctgacattctccagggaagacggttacagaaagacttgaccccctggccccgcagagctcttcagagaaattaatgcatccagaaaagacagagcatcagatctcactccttcgtctggaagacgtcagttcatcctagttctagcgcataccggtgttttggaaacagattagctatattcatacataaggatactcttccgcaacactatctgtagtgaggccaagaccagtggttgcgggaatcttcgcaaacaggcaagagacaatttttaggggcgatggaaactgtcattttgactggggaggtcattacacctatacatgcatttgctaaaagtcatcaaactcttccactgacgtgggtgtaaccattgtttgtaaattatacctcaacaggattcgattaatttatttattgagacagtctcgctctgtggagtgcagtggtgcaatcttggcccactgcaacctccgactcccgggttccagcgattcttctgtctcagctttcctagtagctgggattacaggcgcccgccaccacgtccggctaattcttttatttttagtagagacggggtttcgctatgttggccaggctggtcccgaactcctgacctcaggtgatcagctcgcctgagcttcccaaagtgctcggattacaggccgcgcctgactatgattcgttttgaaagaaaaaaatatatgccatttacccctcgggaatggaaacatagaggagtgacaagatctcccccaagctctggggcggtggagtccagcatttatagatcggtttgcactaggagcagaagctcctttcacgacaatctcggcctcttcccactttgtagagtgagtaacaagctcggagagatgaaataatttggtggcgttaacccggccgacaggcgccagcgccaggatttgaacccaaaccacgtgacttcacaacccatagctttcaacactacgcggtgctgctggcacctagtaaaggctggatcactactgaatgaatgattctggctacggatccttaaagcccacagaaggcccatccagagaccgaaagcttcagacacaagccgcagagcagaccgctaaaccggagctacagaggcgaagctcagacttgagcctgagtccggcgggctgaggggcgggctttcgtctcgggaggcggagctgtctcgtcgcattcccggcaagcttgaacctcttcacttgccgtagcgcctgcagcaggaagttgctctacagcatgccttaggtttccgggtgagggttgggctccttggtaccatgtgggaagcgctgtgaagagttgttgccttccaagatatacccaaattcccagttccaggtaagcggcacagagccgcttgatgtggctgcggatgggggcrgcatatcgagggagggtaagagttttccggatatctgcggaatcagggttgaaggaaagccttggcgcggtcgccgctactgkaattagttgttaacgctgctgccatcgtctttgcatctccggggtccacaaatctcaggacacccgcgttgtgtgtccatgacggtgctgagtgcagaagagaattgtttgtttacgaggcgccttataatttcgtagaaacttatcaaagtgcttacgtttttttagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcrgccacaatcgacagggacaccgccttcgccattggtgagccatcttttaacttagaaaagctcttggaagcgtttgttttctggatgttactgttttttttttttccccttsttttctcttctgtcccgtcctcttccttagcagtttctagcatgttgatgtatatttttaagggaaagagaacataacagtcaggtgcttggtgcttgaaatgyttatgagtagaggtatctggatttcacagatgaagaaacaaaattagagaggtcaactaatatgtcaaagagaagaacagctaaaagggggatggaggcagtgactggggtgacggagaagtcctctcagaggactggcctagttattgtaggggatatccaaaaaaaaaaaaaaaaaagtgttccctgccacgaagtactttctgttctagtagatgagataggatttactctaaaagttgaaaactagaaatcagtgtttgggactgtattataaattatatgtacttaaagaattcagaaacttcttaggggtaagtaaaactgtaaaagaggggtgggatgaatttgcttacgaagaattgttaaataaactggccttttttgaaatttaggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggtagctaatagaattacagaaataactatgggttaatcactttggtcttgtaaaaaattaagtagttgagaacttatcaaattaaagctgaaaaattaggtatattaagagattgatacaatgtccattgtgtgagataagcatgctcttctgcctttaaattcttttttgttgatagtgaaaagtagaactactggtgattttgagtaaatggtctaacctcattagtttttttttgagatagagtcttgctgggcactcaggctggagtgcaatattgaaatcttggctcactgcaacctctgcctcccaggttcaagtgattctcccacctcagcctcccaagtagctgggattacaggcacctgccataatgcctggatgagttttgtgtttttgtagagatggagtttcaccgtgttagccaggctggtctttaacccctgacctcaggtgatccacccgcctcggcctcccaaaatactgggattacaggtgtgagccacctcgcccagcctaacctcgttagttctgaagagcccatgctactttgccattacagcttgttcctgcacacttgaggcagtgagtactaagctgctttcttggcaaaataacaagatggttggggaagcaggcaatgttatcctctgaaataccattrcttgagaaaaacaatgatagctaatgtgtttttgagcatttatacactaggccctggtaagcactttatctgcattatctcatttaattctcacagcattcctctggtgagattatttgyattatccttgttttacagttgagaaaactgaggcttagagggattaagtttcttgagtcacacagctagtaagtggcagagctaggatacagctgaagtttatttccaaggtctgatcttttatctgctttgggaattgtctcagtaagcttagtttattttctcacatattggtgtcacatcacagcatacacatttttgttttatttattctcccaatatgtatgtcttttttttttgagacagtctcgcactgtcgcccaggctggagtgcagtggcacgatctcatctcactgcaacctccacctcccaggttcaagcaattctcctgcctcagcctcccaagtagctgggattacaggcacataccactacgcccagttaattttttgtatttttttttttttagtaaagatggggtttcatcacgttggccaggctggtctcaaactcctgacctcgtgatccactcgtcttagcctcccaaagtgctggtgtgagccaccacagccactgcacacggctgtctttttatttttattttattgagtgtcaggatttcactcacccaggctggagtgcagtggtgtgatcgtggcccactcgatctccagggctcaaatgatcctccgatctcagccacccaagtagctgggattacaggcatgcaccaccatgcccacctagttttttktttgtttgtttgtttttgtttttgtttttccattttttgtagagacagtgtctcactttgttgcccaggctggtctggaactcctggcctcaagcgatcctcctgccgagtcggcctcccaaagtgctggggttacaggcatgagccaccacatccagtccaacttacatgttttaaaagtagatttctattccattaattggagacatggcttcaaggccagcctggccagcatggtaawacctgtctgtgtgaaaaatacaaaaattagctgggygcagtggcgagcacttgtaattctagctacttgggaggctgaggcaggagaattgcttgaatccaggagacagattttgcagtgagctgagatcacgccactgcactccagcctgggtaacagggagacgccgtatcaaaaaaaaaaaacaaaaaatggagacgtggggataaactaattttttttcaagaagcaagtgagtcatcaagaaaacatgattttaacttgggtcttctgattgtcagaacattagggcaatcagacaaagaatatttaaaagtctgtaatatttccatctgttttctagcacctaactttacccccaaatagatcattaatgtaaggaatactttttgcatttgatttttcattttatgtcttcagataacttatttattcagcaaatactaagttcagtacwtagataagtaggttgccgytgattactgttttgaaataaatgccataataaaggattaagcagagttttgtggatatagttctgcctggaatagttgaagaaagcttcatggaaaaagtaaccgctaaaaccgtatgtcaaactaagaggctgggttcagtggctcacgcctgtaatcccagcactttgagaggctgaggcaggccagtcacttgagatcaggagtttgagacgagcctgaccaacatggtgaatccctgtctctactagaaatacaaaaaaaaattagctggktgtggtgctgtgcacctgtaattccagctacttgggaggctagggcatgagaatcgcttgaacttgggaggcgaaggttgcagtgagctgagatcacaccactgcactccagcctgggtgaccaagtagactctggaaaaaaaaaaaaatctaataaaaggcaatgtatggtactgtttaaaaaaagtacmcgatgtaaaaggataggagagttttcacagaagagggatcagttggcagaattagaaaaaacatcttagccaggcatggtggctcacacctgtagtcctagcactttgggaggctgaggcaggtagattgcctgagctcaggagttggagaccagcctgggcaacatggtgaaaccccatctctactaaagtaaaaaaaaaaaattagctgggcatggtggtatgmgtttgtagtcccagctacttgggaggcggaggcaggagaatcttttaaacttggaggtggaggttgcagtgagccgagattgtgccactgcactccagcctgggcaacagcaagactccctctcaaaaaaaaaaaaaaaaaaaaaaaaaaaatgttgacagaccagcctgggcaacacagggagacctagtctctacacagaaataaaaaattagccagctgtgatggtgctcccctgtggtcccagctactcaggagacctaggtgggaggatcatttgagcctgggaggttgaggctgcagtgacccgtgatcgtgccactgcactccagcctgagtggcagagcaagactctattcaaaaaattaaataaaaattgtaaagctgagagaaagttaatgggatgtatattttgatgtagaatattcaaagatattgcataggaattggctggaccatgttgagggatatgtgaatgcaaaattggggactttttaaatgctctgtatcttataattttgtgatttttactgctactcrttctaggttgttttagcttattaataatacagtttgggcatgtgaggaaataggtgcttattattaagttttgtgttcagttggactgtttgctttttttccccaggttccatatacatctctataatcaagatagcctcattgcttgtgttctgccataccacgagacaagaatatttgtgcgagtcatacagcttctaaaaattaataattcaaarcacagatggttctggttgttgccagttaaggtataattgctgaatgacatatgtctgtaatcattacagatcttgattaagggatttaattaggaaaaaataagtcattgctcctggggatagtccagataactacctccatcatttttatttcctgacttccaattgaaactattattaatgttaataatatttagcttttatttagtatctgacatcaggctaggcaatgtacattatattatcttggattatcacaaaacttcatttttacagatgaggacaggctacttgccaaagttcacataactataaagtggcagagttgagatttgaacccaaatctgattccagagtctgtgcctttgtatcgtaccatgccgtttggcattttaaatttggaactgagaacttaaaaaaaagttgaaggtgaagaaaggcagaaaatacttacaaaaattaaaaggataaggataacttcaggggtttcaagaatttactaaagttgtgaggaagatgctaggagttaatttacagactaagaaaaggatgcttgtrtaamaggaagggtctgggtaagaaaagacagcatgctattgtaggaaaaccaactgactaaccgttagcactttgtttgcaacatatggtggaggaaagtagatgtatgttgttagcaggaacttgactgcatgttgggcatggtgatccagggtagggggggaggcaaatggggatgaaggtaagctaacagatcacgaggctgtgcacattaggctgatgatggtagtggggtcagtgttcagaattagtaagataggagtaatgaggactttttaattagaaggagaatttaagaatctgaacgtaaagcacttgaactaaagaaygttggagaaggccagcctttgataaagctcattaactgctcttcccaacattcactctgcccatagcatcaaaattattcttcctctaatctaccytggatcttgctgctccctaggcactcttattscaggtagccaaactccactyacctactaaagttcacttaaaattctcctttcatttatttaatcagtatttatggagcatctattacataccatgtacaacgctagatggtgggaatagtggtataagttgtgcagtttcctagtctatttctgttcttagtgttattgtaaagcaatgacagaagcgtatcatagtggctcagaaaccaaatcgaaccagtaaagttactaagaatctagagaatccagattttgataaatacctttcaaaatgtgacatacgataagcaaacatctttcactaaatacctctgccctcattgctgaccttctcttttgaatttctaagtttacatgattttatgtgttaatttcatcaccaccaccagttataaggagagattatattttttatttatgaattgtagcagtatgaagacattactagggtaaatgctttaaaataaggatcagttgatgaatgttgctagtagtttgttctttccatcaataacagcaatctggagtgccgttagctaaaggaactttgattacccactgctacaaagatcttggattcatggatttcatttgcagtttggtgacaaaatctgtgaaggtgagcagtctgtttcatgagtatataattttatgaaaagattgcttgctttgaatgaagaaaacatactaaaacattccctaataacaatgatactttggataaatttattttgttaaatggtctggtgttttgaagcaggagcagtttgagagtccgtatcttttttttttttttaagaatcagtcttttatcaccaaaggtgtttttctacaaaaataaatgtctattccttgccagattctagttacagtgactattcaaagagagtgtctagaaatgtcrggaatattcaacctgggaaagctgtttaaaaaattttaaggccaggtgcggtggctcacgcctgtaatcccaacactttgggaggccaaggcaggcggatcacttgaagtcaggagtttgagaccagcctggccaacatggtgaaacaccgtctctactaaaaatacgaaaataaactgggcatggtggggcatgcctgtaattccagctgctcgggaggctgaggcaggaaaatcgcttgaacctgggaggcggaggttgcagtgacccaagatcatgccactgtactgcaacctgggcgacagagactccatctcaaaaaaaaaaaaaaaaaatttttttttaaataaaaatgttaggaatatcattaggcagttaattgttgtcacattgtgtattcattgttgcatatggtaattcaggagagctgtaaatatttatttggcctttcactttttttttttttggagacatggacttgctttgtcgcccaggctagagtacagtggtgccatcatagttcrttgaaatctcagccttgaactcctggcctcaagcaatccttctacctccctttcactgttaaatgtgttttgtttgtgttccttgtttcaggtttttgctgagtacccgggcagctcagctcagttgagggtgctcttggctttctatgcttctaccatagtgtcggcgctggtagctgcagaggaygtatcagacaatatcatcgccaaactatttccctatatccaaaaggttggcactgctgatgtgttaagtagattattttgtacttaaaggaattttcttgctttcgaaagtttttttagatttaagtgtttttaaattgacagtttatttcagatgatagctgagatttagcctttaggttgaaaatatgacacttttttattagaaactcactggmctgggaccttaattaggactcttaagaataaatattggctgtctggtcctgcggccatctcctagattgatttccatagcagtctttgtacctcactggaaggaggacggagcagacagtctctttgaggcgtaagcarcctctcagtattctttgtgcactggctcctgcctctcagcgtttctccttcccaagtgccttcttgcctgctgccttcccaggtgccctgtggaggtactgctttcacttcccaccagtgtcccaacttgtgacctttcatcagacttgtttcttccattagtgatctgattgaggtctccctacyataagtaggattttatgtataaaagaagagcttactggctcctgtcaggacatgtggtagatgtttgagttgggaaattttctgagatcctttgtctcgttcaacagacttgtctcatctctgtatccactctgaaaaaggggtcagctcctttattgtttatgtctgaagagtgattgactatgcattaggttgtattaatctctatgacatttctaatttgtcagattaacatttaaagtagcagaaaataatatggtttatcatttttccttatatttaaaaaatatttagggattgaaatcatctttaccagattacagagctgcaacatacatgataatatgtcagatttctgtgaaagtgaccatggaaaatacctttgtgaattcattggcatcacagatcatcaaaacattgaccaagattccctctttgatcaaggatgggttaagttgcttgatagtgctcctgcagagacagaagccagagagccttgggaaaaagtatgtacaattgaattgagaaatggtgctagtcagaggtgaataaaattattttgaataatttttttttgtragataagtgattatatattttcttatattgttactcattgtctaacttgtaaagtcaacacgatatgtacttttgcttcttcaaaggccattccctcacttatgtaatgttcctgatcttattacaatacttcatgggatttctgaaacttacgatgtcagtcctcttctgcrttacatgcttccccatctggtcgtctccatcattcatcatgttacaggtgtgtggttttatattttttgtccagaaattttctaagatttgatcttaaaatagtaaccatatcctggttaacagcttcaaaatatttaaaatttctgttttccagttgttcttgtgtaacttgtctatttcttaagtgagaaacatctggggtggggagcaggttggttgaagaaagatcattgttaattgagtaatttcttagaattttactttttttaagatctgtgttcttaaatacttaaatagtctctacatgaaaaagactggaatacttttaaaatttattactgagtaaacctttgccttctcatttaggtatttaatgaactttagtgattcatttayaatgaatatctcatccagttgccaaaaaagttttttccctagagtaattaaaaatataagaccaagaaaatttttatacataaaaatccaaattatgaaacaaagcaaaaagcaaaaagtaataattagagggccaggtggctcaaacctataattctagcactttgagaaactgagatgggcagatcatggcaaaaccccgtctctacaaaaatatacaaaaattaaccgggcatggtgacatgcaactgtggtcccagctgctcgggagactgaggtgggaggatcacctgagtccagggagttcgaggctacagggaactgtgtttgtgccactgcagttcagcctgggcgacagagtgagaccctatctcaaaaataataataataattagaaagtgattatttgcattatgtcttttaataaatacagaaaggctaggaagaaacatttggttctgttgctacttggagaatactaagaaagacttctctaaacttatgtcagtctactgaaaaatgaggtttttgtaaccaaatcttggtttgaacatgcattttagaaaagtgactagcaaaatgaaaatgtattcttcctattctgaaggtaatgagtaatgtcccagtctttgaaagcaagggctaagatcagattcatatgtttattataaatctgaaatagatracagcttttggttcagtaagggggtgggtactgagataaaagtttaacctcttttcagagatagttgattggcaccatcacaactaatttgtaatgtgacctggggaaagactaattttggacttttgttttgttattgttataagcatgatagtacttgttaaaaatagagaattttagataaaagaaaaatgaaggtgatctatacaaaagagctttaaaaaatataaatgactaaataagtggaatgcacttgtgcaaatagataaaaagctggatatcagtgtgtgtgttttaytctgagaacgattttctgctataagtgaatttaataatgttagcttgcaaaataaatttttcccaacacaattttaatttttacatattaaggagaagaaactgaaggaatggatggtcaaatctacaagagacacttagaagctatacttacaaaaatatcactgaagaacaacttagaccatttgttggctaggtaagctattatttttgacatgcttttgatttacatttttgtgactcagtataattttcaagattggttagaaatttcccagyattcctttttaatgtatatcttgttttgyctgtatcatttcattaactataagtacttaatccagtaactggcagcattaaaagcaaaagtaatttttcttgcatgtstttagtgcttatagatgaaaatggaaagttagtggttaagacaaatttgggtaataactaaatgcagtttgtggccgtttgaagttttctcttagtaaatggaccataatatctgaaataacacatcacaattaaaacgcagtaaatgtcatttagaaacaatattgaaggtaagcatagagtaaggattatttctttaaagataattcagtctttttttttttttttttttttttctcttaatgggcaactcgatacagtgaaaagatgtaggcgttgtggtcagacataggtgtaaattctgcgcctaccacttccagggctatagtaagttttggaggttagtctggatgtagctttgccattttgtaggatcaagagagtgcctgtgtgttggtgtgcatcattcatgcccctttgctcagagggttggtttgtgaattaaaggagagtatacacgtgtagtaatgttgagaacataggctctagaatcagactggggcttaaaatgtgaaaccccactctgtggcacagaagggcttactgaatgttgccttttattgctgttctcatgagcaaattggaagacttacactctagtttcttttccttttttttttttctttaagatggagtttcgctcttattgcccaggctggagtgcartggcacaatctcggctcactgcaacctccgcctcccaggttcaagcgattctcctgcctcagcctccctggtagctgggattacaggcatgtgccaccatgcccagctaattttgtatatttagtagagacaaggtttcaccatgttggtcaggctgatctcgaactcctgtcctcakgtgatccgcccacctyggcctcccaaagtactgggattacaggcgtgagccagcaccatttaaratagcaatgtagtcttactatgttgttcagacaggtctcgaactcctgaccttaagcagtyctcctgccccggcctccgaaagtgctgggattataatgccagtgrtgtgaaccactacaccaggcctctagtttctttatctgtaaaataagtattaaactataccttgtataagtatgacaattagagataatatttctaaagcacttagaatatagtaggtactcaataaatagtaactcttatgtatgctgatatttctgtttttttttttacagccttctatttgaagagtatatttcatatagttcacaggaagaaatggattctaataaagtgtctttgcttaatgaacaatttcttccactcattagrcttttagaaagcaagtaagttaygtgtgtatgtttatgctcttctaaagtacttcctgttctataaagatatgattcacaagtcacatcttaatatactgaattgtacagagactgtcctttttaaatttgttcttcaagaaggggygagtatcggaatcaaaaatatttgaaatataagaggaaatagtggttgtgtgggggctatggagagtataattttttatagagagactattttgttattggagtagtcatagtaacacacttgaccaatgtcatttggttttacctacaacatttgttaaaatttaagtcacagtctcagtaatttttaagattttatgtctttcctttatatgtgtatggtgtatgagattaataaatttattaagaataatgaattcactytttaattgcttcccagataccccagaacattagatgttgtattagaggaacacttaaaggaaattgcagatctgaaaaaacaagagcttttccatcagtttgtttctctttctacaagtggaggaaagtatcaggtatgttgttctccaaaggaattatgacaatttggggtacatttgtatgggtatgtgaagagctccagaaggaaatttgccacttttttcccttgtgtggaaaattttacagagataaccttmtacagtttgcctagttgcctgaagtacggctctgaggcaggaatagaataattggagaaaggtacaataatttgtacataactatgaacgtgatacttatttcaggaaaagtattgtttgagaattttgtatgggatattcattaagaatcatcagaggacggcctcatgtaggtttctagcattctctgtctttcatctaggtctatgctttccagtgtaccagccacagatggctatttatattattgattagcaagggggagatgggttctatttcatgatcacattaaaacttgagaaattttctggtgattcaagcctaaagctttatactagaggttagacatttaagcaggagttcttatatttagccttaaaaacagataattatgaagagaaatatgattgttttagtatttctcttccataattagactttcatttttaatggtgttgcatttccaaatcttaggttgatggataagactttctttttagtctaattgcgtaagtgaactaagttgtcacgaatttgagtgtcactatttgttatatcatgtagatgagttgcattctgtcttctggaaggtgctaaaacagggatttatcttaggtgatttatcagatacgcatacaaaatacaaaattactttgtagaattacttgactaaattaaacctacacatagacacaagtatacatgaaatcataccattaacaatacaaattttttcatcaactcatgtgatgttctagaaacaaagattttgcatttttttgtttgttttctgtagttagatggttgttactgaaaatgttgggcaatttggggtggttttctctgggttttattcttgatcatagactgttcagattaagtgaaatcatttgataactatgttgaaccctgtagtttttagcagattctgatacttctttgatgctcagcctgaatcatccacttgctcctgtgagaattctggccatgaatcatttgaaaaagatcatgaaaacatcaaaggtttgtttcagatcgcttttttatatggtttttttttcttatgatgagcagtgtaattctgaataagaaattgaagttaccacctaagtgggtaatgatacagatgagttgaataaacctcatgagagtaccttagactaatatttaggactgtgtatgccagtygtccccattttaacaataacctaataacaactacttttatgtttccacattgacagttgtttatctttagtgtttttcaaactggaatttgtagattaattcacgtaggttcattaattatctgagaatttttttagttttgaaatttgattttgggccggtcacagcagctcatgcctataatcccagcactctgtgagaaggatcacttgagcccaaacgtttgagaccaacctgggcaacatagggagacccccttctctrtaaaaaagttcaaaaaataaaaaattagccaagtttggtggcacacgctttggtcccagctacttgagaggctgaggtaggaggatctcttgggtgtgagaggttgaggctgcagcgagccatgatcacgccactgctctccagcctgggtgacagggcaagactctttcaaaaaaaaaccgagaaatttgattttgatagtcttaattttagatgaagacatattttgggacatttgaatgataacttttgaacactgttccatgattttggtgcctgcagtttcgtttgtctttaaaatgttagtggtttcaaatatgtattgaggctgactttatttgtaaataatttggtctaatttgcatttataccaaaaggcattggtatgaagacttggtaatgatgcacatagaatagtagtttccaaactttagtcattcaagcagtccctgtacaatttttgctaaattacaaattaccactgatagtagtattattttctcacaatttttctttatttcagatggactcattatttttttacatagccttcaaattgtgggtgtgaggtgctaattgtatatgcattttactatagttactataattaaaataggaatgctccatctgtgtcatatctaaaattatgcaccgtgatttgcatatttgagaaatttctggaacagagtaaagcggttaacagagtttagtttccttgtagcacatggcagtgtaaacgtgccgaactctagaacttgtgtcatagcaattagaagcagattcttactacaagtaaaatcatatgatcagtaaaatttaatttcagctaattacarctaatcacactaagttcatcttcatttgaattttattggttttatagagtttttagtatttcccttgtagatttaaaaaaaaatttttgttttatgtcatctatattttaagaaggagttatacttaattttaagttgatatataaacaacaaacaacatttagatctttgagaatgtttctttgaaagtgactgatgtaatattcaggtttgagaaatgttgctttatttgatctgacatgaattctgcttttgtaaactgccaataggtttattttgtcgatatgttaaataaattcattgaataatagtctttgttgtgataggaggatttcagtgataagaaattcttctagaataaaggggagtcctggaatcttctgtttctgaagttattctcatccttccttcttttactgcctttctctcctgttctctgggtttggttcgtttttcggtgaagggccggccctgcatacattcaacttacaggcttgaggattgtaattgcagttgatgtcctcctttgcataccatgtttcattttcttttctccattgatgacaggacataggttttattctaaactccaggttcagatatatggctgcttattagctcttgaggatttgtttaaatgatggggtcttgctatgttatccaggctggcctcaaactcctgggcttaagcartcctcccacctcagcctccagagtagctgggattatagacatgcaccactgtgcctgactaacttaatttttgtgaattctgtgaattttcatttttctcccaacagagtgacctatgttttttatattatttagttgcctgccacatatagatagggatatattcaggttgattagcagtcctagttttctttctctgtgaatgaatatacattgttttcttttatttgttatatttaaaaaatgatctctatttttggcagactggctttgtagtacatgtccttatccttgtaaaaatttagataatactagctagcttttaacagtactatgtgtaaagcactgtgctacagactgacatgwattttttaatcttctaacaacccttgcaggtaggtattatttattagcaaacctgttttataggtgagaatagtgagatccagaaaggttaagtgacttgactaaagttacacaactagtaagtggtagagctaggatttaaattagacattcttattctttagtctatatcccgtcaatatctgggctctcactttaataagatgaactccttaactacaaaaactatatttggagtataccatatttactatattttcactgaaaacttgaaaaggatttgtaccaaacaattattaatctcaaaaggccctttagcgattatctagttctagtgtgtttcagtcctcatccagagcagagcctgtgttagactgtcattctggagtgtttttcacaaaaccatacttcctttctagtgcaaagccttaagagatttttggcaacagctaaattaatgtttttcttttattgctcaggagggtgttgatgaatctttcataaaagaagctgttttagcccgattaggtgatgataatatagatgttgttttgtcggctataagtgcttttgaggtgagtgaatttgtcatttgttgaggtatacaattttgtaaatttccttgcccttctcacttgattctctgcttgagactagaatatttttggaaattatttttccatgggaaatttgttctctggagagcacagacttaagtctggttaggagaaactcacagaaattcacaatttgatatattaaatatatatggaagttgttcaaacaggaaaaatgttttgtgaatttttatattgcttttaacatatttttatcaatagcaaataccttgggacctgtggaaattgtcttatgaatgccacttttgagaaatagatcttaaaacttttaatttgtactaggattcctgggagaaattccttataattcattctttttaaaattcgcatttaaaaagcgccatacatgtttgaagcaagtacaaatctactctggatatttttttccctttagattttcaaagaacacttcagttcagaagtgacgatttcaaatcttctgaatctctttcaaagagcagaactttcaaagaatggagaatggtatgtattcatttctcctcatactattttgaattgatgaagttcttatatcaagttctttctatttcttcttctttttttttttaaggctttgattacatgacccttttgtcgtggtagtagaacagatcttactgtaatactctctttcattatacagttaattaatttgtgtttgtgtgtgttcattatactgttctctatgtttggaatttctcttaataaaatgcaaaaggaagtatataatgtatgatattgcattctgggaagtaagatgggtaggactttctaatttgctgctttatgtaatttttactttataattaaaaacaaataccaatgtgttaaacaaattaaaaaataagttcagagacacatgataccatctgtggtaagtttttaatgagctctgtttatttcatttttggcaccaaagctttttgcaagaaaaagtaagcaagctccatagrggatgagagtgtgtcttacgtgtttttgtatctatcgtatgggtagatatctatcatgtaggatgtgcttggttcattttttttgagtgcctgagtgaacctgatttccggtagagttgagacatctagtgtgatatgtcttatgttatagttaacctctagtgatttctctaagaaaaattattattttttttttaagattagacaggatgagcagattaaaagtattgttggccaggcacagtggctcatgcctgtaatcccagcacttgtacaaaaaataaataaataaaaatattgtcacagataactctgttattggcatggattttaagtggtgtcttagtgtatctgaataatagttttggtcaggagaccaggatattgtcagttaagctggagtaatgtaatgatraatttttgcccaattgaagccttccaatgtgtctttcaaccaagtgtgcttgcatgtcttttaggtacgaggtacttaagatagccgctgacatattaattaaagaagagatactgagtgaaaatgatcagttgtcaaatcaggtggttgtatgtttgctgccatttrtggttatcaataatgatgatacrgaatctgctgagatgaaaattgctatatatttatcaaaatcaggaatctgctccctgcaccctctattaagaggctgggaagaaggtaaaaaattcagttgtttttttagaaaaagtgaacagataacacaaaagaaaacaaggaaaatttaaaatttattgttggtcatgcttatatgccagtaaggtcttktaaaatttttgccaagataaaaagtatacagtgaaaaggaagccaattcatagacaaattcagaatcggatacaaggaaaaataraaagcaaaccttcataaacaatagtaaaatgtttgcctgaattcttcatgtgattctttgagtgttggtgacataagagctctctgcattcgattttactttacagctcttgaaaatgtaattaaaagcacaaagccaggaaaactaatcggtgtagcaaatcagaagatgattgagttgttggctgataatataaatttaggagatccttcttcaatgttaaagatggtaagtatgctttgaaagtccaccccctggatttctttctcatactcttattaaattctcagcttttgctttactagatttttcttaaaaaaawtttyttttattcttgagtacttggttttactttaaacgttgcagtgttgtttaatatattctgtgcaatgtttgaaatcttttaacattttatatattttttcaatgtggatccatatcacacccataagaataatatatcctttttaccaccattttttctcattcccatttaaaatattagtctttttgttgttgttgttgttaaaatagcaaaatataatcccaaagaggagaaaattatctttgccttattaaataaacctttgtaaaggattagatgtgtgatttaaatacattaaccagttggcaagtgcaattatgttcattacagtttctgaaattattmttataattacttagaaatcagtgcttagtactttataaaggytttctrtttgtcatctcactttaaatgtaaaacacataatacctagatagacctgagttgaaaaarttgttttatgaaaatcaagagcaactggtaatagagtgtgtttatttttcaaggtggaggatttrataagcgtgggtgaggaggagtcctttaacctgaagcagaaagtaacgtttcatgtgatcctgtctgtgctygtctcttgttgttcatctttaaaagaaacccactttccatttgcgataagagtcttcagtttgttgcagaaaaaaataaagaagcttgaaagtgtcattactgcagtggtaaggaaagcagaatctccagaaagtgggatgttgaataaaacaacagcctggcctattagtcacagcaaaactgaaaatcagaggcgagatgttgagtctgtggatagtagctggatgaaatgtgaagcagtcttgggtagcagtgagatagtcaactaggcactcccttgcttttgcggaaagtttagttgaattataaaattttagggttgcaatattttgtatctgatgcctgactctcctctcttttattgtctttattggataattacccaagctacacctaactacctctagcgatgaagaattcacttggygtgttagtgcttgaacaaaatactatttcattcaattgtttactaaaaatagatcttttaggctttaaataatkttaatattacatagatgtgtatccctccagcctactactrtctttcatagtattactaarggacatgtttcagctgtttacatttgacatgttttgaggtagcaagactttttttttaatatctgctatatgtaaggattttgtttttatttgtcctccaaattttagagggcttctcattataggatttactaaatgaattatatctttttcacatttacgtatacccgcaggattttataagttctgatcrtggccattgttagctaaaatgtgtaaactttaaaaagagtaaartcttcatattttgaaaaatagtccagataggcccttcttaacttttagtttcttggtgtcttttgtgaagtatgatgacctgaactatactggttctcagtgttaaaagtatggacaaatagagtgttttattatacatatgtagataacaggttattttatattgctttacttttaatacctttctcgaggtcatgagcatgttttcgcctgtagcagcaygttgasttaatcaaatccctcactggagacgttacattgtaaatctggctttggattattttccttctaagttattactctgtactgcttgtacagagtcayatttgtcattttcttacacctgttctgcattcttttggcacttacagtataatttctaaacacctaacattttgctgcttgtttaaaatcatctgcaggtttggagatttttgccatgtaccttattcagattagtggtaaaacagtgaaatsaaagaattccctttaactatgtcttggcaatccaactgtttatcttcctgttttgaaatatacctattttggccaggcacggtagctcacgcctataatcccagcattttgggaggccgaggcgggtggatcatctgaggacaggagttcgagaccaacctggccaaaatggtgaaacctaatctctactaaagatacaaaaattagccaggcatgatggcgggcacctgtaatccttcctactcsggaggctgaagcagtagaattgcttgaacctgggaagcggaggttgcagtgagctgagattgtgccgctgcactccagcctgggtgacagagcaagactccgtctcaaaaaaaaaaaaaaaaaaagaaatatgcctatttattcctaccctttattggataaacagttcatatgaataaagtttgtttttagagataatgtttcaaggtaagacatagataaaatttaactttgtctttccttgtgaatagtgataaacctctttaaaaatccgaccaaagcagttctgttaatcctttccccaccaaaatgcacacataaacaaaacttttgcatattatgcagaggaattcatataacccatgttcagaacccttagtttgtactagtttttgtttcctttaacatttcaggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatgcactgaaagctcctaaatcttttcctaaaggtaagatacaagctgtgaatcttttaaatgtgatactstgcaaaactgaatgattgactccacaatgactgtcttgaataaaaagctcccagcatgttcatgtaggatctagcatcatttctctttccatgtccttgtaggtgatatatggtggaatcctgaacaactgaaagaagacagcagggactatctgcacttgctcattgggctgtttgagatgatgctcaatggtgccgatgctgttcatttcagagttctgatgaaacttttcataaaggtacaagcctcctccttttcaggcgtactctacccttaaagaagatatggctggcctgcaatcccagcactttgggaggccgaggcaggcggatcacttgaggtcaggagttcaataccagcctggccaacatagtgaaactccatttctactaaaaatacaaaaattagccaggcatggtgatggggcctgtaatcccagccacttgggaggcagaggcaggagaattcgcttgaaccygggaggcagaggttgcagtgagccgagatcacaccaccgtactccagcctgggtgacaagagtgagactctgtctcaaaaaaaaaagatrggctgggcgcagtagctcacgcctataatccgagcactttgggaggccraggtgggtggatcacgaggtcaggagatcgagaccatcctggctaacatggtgaaacgccgtctctacgaaaaatacaaaaaaaattagccgggtgtggtggcgggctcctgaagtcccagctactcgggaggctgaggcaggagaatggcatgaacctgggaggtggagcttgcagtgagcggagatcgctccactgcactccagcctgggcgacagagcgagactccatctcaaaaaaaataataaataaataaaaagatactgtgggttatttgggtwatgacagtttataatgtaaacaaaagtagacttgtaaacagtgaagagtatataatadcacrggccctgtaaaagagtacaatcacaatactaatcggtaggttgaatagaaactaacattgctacactcctactaatatgttaggcccattactatatttaaaaataacaacagcccagtctttttgattggttaataccatttaaaaatgtgaatactggtgttcagagaggttatttagcacacgtgaagttactcaggaaatttcatccccagcaccagtgacctccatgttgccaggcccagtggtcagttcctgttcttgcctgacttgttctctctacagcatttgacatggagttggcattgctcagcacattgttgaagtattttcttaattaggcgtcccagatactgctcttgtcttggttctgtgttttcaagtgcaaggttatagtgaggcttctgaatatcactcttcattgacatcttcccagttcattaaaacatggaatatggaataatttgaaatgattagacaaagcaaaactttgccttaaattatttgtttctttataattgtacactagtgagaagaggatttggaaccagcttatttgagtaagaattaaaagtttgcttttttttttttttaattaggtkcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccaggtattaaaagtagcattgttatgttttgtcatgaccaactgttcatgctttctctatatggtttatgtagtttggaaaattataacttaaaaaaaaatagcagagggcaggcgcggtatctcacgcctgtaatcccagcactttgggaggccgaagcaggcagatcatgaggtcaggagatcaagaccatcctgggcaacatggtgaaacccygtctctactaaaaatacaaaaattagctgggcgtggtggcrtgtgcctgtaatcccagctacttgggaggctgaggctggagaattgcttgaaccagggagttggaggttgcagtgagccgagattgtgccactgcactccagcctggtgacacagcgagactccatctcaaaaaaaaaaaaaatcgataaaggccaggcgaggtggcttacacctatagtctcagcactttgggaggctaaggcaggaggatcacttgaggccaagagtwcaagaccagcttggacaacgtgatgagatcctgcctctacaaaaaatacaaaaattagctgggcgtgatggtrcgtgcctgtagtcccagctactcagttgcctgaggtaggcagatggcttgtgcctgggaggtcaaggctgcagtgagctgtgattgcaccactgcactccaaactgggcaacagagcaagaccctgkctcaaaaaaaaaaaaaaaagggctgtacatctrtacatatttctggtcacttctaagtattgcttttaagttactggcactagcaaaatctcaccaaacacaaaagtttaataatagaaatggcaggtgattatatgagttcttaataatcagctattcattttctgagctgtagcagcaatgggttagatatggaagtcagatcatcataatacaatttaataatgagctaacaaaaacaaaaccctcctgcatttatctcttttatcgggcataaatcatattcaggttcggcattctctaatgaaataactgaaagttaagtttttttataatgtagaattgcaaattttgcaaaagatgcagaatttcatgaaacaatgaatgcgatattgaaaagtgggttgacttacagagctattgacatgaggggatgtggcagaattagatcagagaagaatggttgaagatgaaaaaattgattagaataatggacatgattaatgcttcaaactgtaatgttattaatatcagaggcataggagtggccctggggaaatttgaagatgtccttggtttttttttgttttgtttcttgttgttttttttttaattccaaaattactctttgtaaatrttctgtgaaagcaagttagatgatcrtatacttttccctgaacaattcctcagtgtttattttttgttagttctttgaaagagcacataattacatttgtaaccaaattttgttacatttaaagtagwtatgtaatttcaagttttatttctaaaataaaattccacaaaagtaattttttattcgcttacaaaatttcggtctttattttaggtgagtttactgttaaggtttttctagttatatttggataagracaactctatacattttttaactttaatttttcaattaatatggacatctttccatattaataaatggaaaaatttatctttttacaactgcctgcagagtattccattgtatggagatagcaatttattaaaatagttattttctgctaaacttgtgggttttcaaaaaggtacatatattttatttagagataactatttctgttttccaatttggtrttaaatgtttactgtcctttgacagtggcctctgagtcatatatgtcattttgactgtaaatagcaagatggaagaacttcagttttccattggtattgccctttgtgggcatgcttgtgtggaagaatttgggctttgtgaaaaagatacattgcagctgcagggggctgggagggtctttttttctgtggggacactgaataaacagttgtatgcctgcattttcactgcagcccgtcacatgaggtcaggtgtggaattttccacttgtgtcatattggtgctccgaaaatttgagattttggaatttttggatcaaggttgctcaacctgtatgaacttcttaggcaggtttgaaaccttgtcaagctttatcttagtatttcagaaatggaaagtataatggaaaatttctagcaaaatataaatgaccgtagtttgctgcagtagatatgaaataaagcttaaataactaattactgtaaaaggaatttagatatctctttgttccaaagacatctttttaaaaaccctagcgcagttggtctcacagatgcattcctactagatctttgaagcagattttttcaatgttgttgaactgggcagggcatagagaagggaagcttccagattctttatttaaaactggcataacattgaaaattgagaaagcctacagacaaaaactataggtcatgttgctttgaataatattatgtaaaaatcctaaagaaaatattcgcaaataggctctagcagcatatttataaaaatcatttacctagctagagttcatgcccagaatataaaattggttcagtaaagggaactatgttaatataattgactgtatcagtgaaggacaaaacccataaagtgtccaaagatttgaaaaggcattagccaaaaatcagtaatcctgattgacagcagaataggagtaacatgatcaaaaattcctcaaatcaaaagctagcgttttcacttcataattgggaaaacaaaggcattcctgctgaaatcatcactctcattgaacatgattctagaagtactagccggcagaaatagacaagtttcaaatacttatggaatgtatgaatatartaaaggcaaaatcaaagatctgtgagatggttatgtggattgttaaatgggacatctggctatccatttggaaacattaggaagtttgactccaacctcattccttagatagaaatttcatgtgaactaaagatttaacataaacttagctctggcattagaagaaagcatgaggtacatatgatctctccctctaaatatagagagaggtactttctaaattcacttagagtgaggagggcctttctaagcaccagaaaaaaagtagaagaaaaacttgactctaacatttctctatcaaaaagtaaaatcaaaacacaccagtctgggaccaaatatttgtagagtacgatgcacaggtgggtaatttcccgtgcacgcttgtacaaggctgtatgtgcagcggtgtttgttgcagcattgttttgatgacaaaagaatagaaacaacctaaactttaccagtaaggtaccggtttttaaaatatggaaaatacattggagtatacaattaaaaaataatgatttggccgggtttgatggctcacacctataatcccagcactttgggaggccgaggtgggcggatcacctgaggttgggagttcgagaccagcctgaccaacatgaagaaaccccgtctctactaaaaatacaaaattagccggatgtggtggcgcgtgcctgtaatcccagctacttgggaggctgaggcaggagaatcgcttgaatccaggaggcagaggttgcagtgagccgagatcgtgccattgcactccagcctgggcaacaagaggaaaactccatctgaaaaaaaaaaaaaaaagaatgatgtaatttggatatgtatgtacttatggaaaacattcgcaagagtttagatgtgtctgtaatcccagcactttgggaggccaaggtgggtggctcacttgaggtcaggagttcgaaaccagcctggccaacatggtgaaacccagtctctactaacaataccaaaattagccaggcgtgtggcgtgcacctgtaatcccagctgctcaagaggctgaggcaggagaattgcttgaacccaggaggcggaggttgcagtgagccgagattgcaccattgmgcaatgtccagctcatatgtgatagcagttggtgtagaacagagtttatagtaygctcttgtgtattttcaaaagaatgcaccaggtaacatatgcctaacctttctctggaatattaaatattcaaacagtgaacagagaaggagtttgaattcgaagggaaactttttatcaagtacctttggtactatgtaaattttgtactgtttcagtttttaaaattgtttcttaaatttttttttcctttgattttagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggtaagctcgttagcaaagaagattgagtgtgttcatgcctstgtgtactggagcaattttctccattctcgacatttcactgtgtagggattttgatggactaagtcattggatttaggaactgataggtcaatatctgtacatctgtgtccccctacttttgaaaagatagcaatgtcatatttcaatttwgttcttttcattggataaaggwttagtgtgtagcttttcatagtaagccagctgtgtgtttttaataacgtttcttattaaggttttaaggagaaatggaaaattataaacaatgtcacatcatttgggtaagagtcttccgtaattaatatatttagcctttgtagtttcttaacccttttttatccaattttctttttggtatcttaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgaggtatgtgccatttaagtggattgtacattcctgtgatgttactaaagaattgttgtaactgcttgtgggtgaagaagacaattgtaagagttgcatgtgtgcrctcagaagagataaatgtaatattaatttgagagggggatgagttgaggtagagaaaamcagatacaagatacaaagacaagtactggtgagtttctttttattttaaaattaartgtgttgtccctgtctaatcattaagtttattttaaatgaacttaacagtctcgtgtctcatggggctgcactgctgaaagaagctgttgsttcatctctgtttttcaagtgaaaattctatacaaaggaatatatttggacacgagtctatgaaaattccaaaatcatttgctcgtttattatatatatttagagctttcattgtgttttcgaagaagcttgtgttacaaaagaaagcagttgtgaaacacttgttgatgtgatggcatgtgctgaccaacataaaaaaggttctttcatcccagtgttacagaaatgcctgtgtgcttcatcagtcctagactgactgtgggcttagagaactaaaatgagccaaatggattgaagaccatttgattacactttcttggtaggaacaaacaggttgcattcagcccttagttgtccctggtatagtttaaattaataattgacaaatttcttgggtaaaggaccagataggaaatattttatgctttyggggccacacagtctctgttgcagctactcatctctgcagttgtatcaggaaagcagccacagacagggtgtaaacaaatgagcatggctgtgtttcagtaaataaaatttacaaaaacaggtggtctgttgaatttgacctgcaagccataatttgctggcccctagtttagcagttaaagatttacatacataatttgaattaatattaattataccaagttggaaacattgaaggacacatacagtgttttagggaatcttaaactttatttttattctctaaagttttagtttgtgttttctgttctcaagtcttgaggaatgctcacagattatctttctgctcatctctgaagggtttagcacttttgagcattacacatgaactgtcagaaaggacctgagtgccttagtgtgaattaatagctgtctccatgtctaagaagttaccatcattgggttttttcctccaggctaaactcccatcttccagcaggctttgagtgtctctgtagagtgagcaaaaacatatcagtatacataactatttactactaagtctttggatctttagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaaggtcagtgatttctttcagaaactaaggcatagcatgttcaagcatttaaaggtagaaggcaacaggaacagcgttaaaaaaaaaaagattaatattttatttggagaagatagttacaggtggactagacgttttaaaggaaaatgatgtatttgacccatttttgaaaactgaacgttgtacatgggtcattaaaaagaattgcattttaactgacaaaattaagtgggaaacaattttgtattttgagagaggttgatataaaaattatttctggaatttaaacttgttcactgaactcagttgccttttttctaccccctytagattacaaaaccattttttgcagccatatcagatgaaaaagttcagcagaagcttttaagaatgttgtttgatttattggtgaactgtaaaaactcacattgtgctcagactgtcagcagtgtttttaaaggggtaagctgcaaacttcttgtaattttttttattaatgtttatagtctcttccaagggacaccatgtttaagagtcctgtattttatagtgcttgtaagaggtcagatgttaccattaacaaaaatcatggaaaagtaagtcagagagaggcataaaataaaaattttaaatctttaccattattttattttatgaagtatttgttgataattttaaccagataggatgtgtaggaatatgtgtgtgtgtgatctttctcatattagacggaatctacctattcctttatgcaaggaataggaatgagtcaatggctcagtattgaactgggtaacattattctacttaatttaaatagttgtttaatgacatataatggaattgaaattctgcttgttggttttatacgtatattgaaaccttgttattatcagaatagccacctggttattctcttttttgaatatagaataatacaaagttctagtatctagattcagcagttctcagaattttaacatattaatcttttttccttctttttctttgctgaaatattttaaagtaaatctcataatgtcatgcactttcatccctctgtacttcagtgtgcatcttttgaaaagtggatatgactacaatgccattagaagtaaaaaaaaaaataattccttggtattatctaatacctagttcataatcatatttccatggttatcacaaaagtattttttatagttgttttctttgwatcagaatccaaagatttagttgtgatgttagaaccttataaaaagagatatctggatcccaccccatatctaaagaatctctggggcagtaaatctgtttttgtgcawgtgtgtatatgtcttattccttcctagctgattagaatatacatatctgatccggcacttggaaacaatcggtatggwtgattctgtattgcattactagttgtccactctaagggatgagcgtgaaattgagtgactctggactggagaagtgatactgtatcataatcaagwmaagtgcagggctgtaacttgagactcccaagacaaattgtatagaaagcaagtgcatggtagtaggagagcttggttaaaatgaaaatctgaagttgaatttatgttggctagagcttttagtgtatactcttccctactttgctttcttctcattctggtttttcaagaagtctgtaacaaggtagtagcatccaatgctggggggggttcagatgcatatccagtaagtcattcttccctcttaattgaataaatccttcctaggggttaacatttattgctctaattttatcccaatggattatatcatcaactcttcttccttcaatatttcagatttccgttaatgctgaacaagtccgaatagaactggagccaccagataaagctaaacccttgggcacagttcagcaaaaaagaaggcaaaaaatgcagcagaagtaagagctacaaatgcattgagcacatgctgttgttccctgactctgaatgttatgaaaccattggaactttttgatactcatcratttgctataatcaggcacaatggtttttacttagcacatgatagagtttgcttttccaacgttttgtcttctccattttccagaaaatcacaagatctagaatctgttcaggaagttggaggttcttactggcaaagagtaactctcatcctggaattactgcagcacaaaaagaagctcagaagtcctcagatattggtgccaactctttttaacttgctatcaaggtaatgacacttggctttgatctgtgagagaataggactctaattcttgcccatcttatctaacattctcttttcaacatactcttctcttgtttagatagtctgtaaaataaagcaagtactataggtgaaattaaaagattggttttaggtatccattgctggtgccccaaactgaccttagtgtcctgtgtcatgtagtaaatggccactcactgtacagcctactttcctctgaacttttcagtagcgtgcctgggacgtcattacttgcatttcaagatatagtgttgaatttatatagatatagatatgtgtgtatatagtgtttgctatctaaatatattttcatatatatagatgtatatattctatatacgtagatttgtgtrtgtgtgtgtgtaaattgagtatgaattgtagcgtgtgctttcatgtgaaaggcaaagtaattctgaaggttgtcctgtaagattccagataggctaatggaaagtgcaatagagaggacgtggaatttgacatagcgcctgtctatatgagagaaaattagagttagaaatcttatatcttatttctagacttgatgtttaatgatagtattttagttattccttattgaatgagttccttattgaatgagttctggacaatggccrttaatgtaacaatgaattgtacaacttttacatttcccatcatttctcttttgggtgtcctgaagatgtttagaacccttgccacaagagcagggaaatatggaatacaccaaacaattaattcttagttgtctgctcaacatctgccaaaaactrtctccagatggtggcaaaatacccaaaggtaggtactttttggaaggaaargttagaaaaattatctactttgrgcgtgagtgtacctgccacttagggtttttgtctttctcaccattgtagatattttagatgaggagaagttcaacgtggagttgayagttcagtgcatccgcctttcggagatgccgcagacccatcaccatgcccttttacttttgggcactgttgctggaatatttccggtaagcgttaatgatataagattttagcagatatttcagatatttttcttccacagaaatgcactggcacctgttgattttaaatttaatcaattaggctttggaatcttccagcactggtgagactctcagccctgcctcttcatagctgggactgtataagccagttgatcttgctaagctttggtttccctttttatcaagtgggaataataaccttcttcactggattgttgggggaattcagttggataatttgtggttagtacttagcataatacctggcacactatctatctaataaaacagtaggtattggtgttaattgggaaaagttaatatctcatttatcctcaagtaatcctcaaagtaacctttaaccagtgacttcagaaaattaatttgatcataaactatgtcatttaaagaaatcaygtcccttttatgaaaaatatcatttaaacatttgtaaagagattgaagctattttcatattgaggatttgagtcaragctccttaacctggggttctccatgagctttaggggatcttaatctactgaaatcatatgcaaagttttatctgtatgggatttytttttttcttgtaagagagtctgtgcttctcaaaggggttgataatccagaaacagttaagaatcattaatattttttctgtttttattgaaatatagttcagatgccataaaattcacccatttaargtatacaattaagtgattttagtatattcacgaagtttctgtaatcaccaccacgatctacttgaagagtattttcatcaccccagaaaagaaaccctacacccattaactgtcactcttcctctccctcctccctgccgctgccaccgtcaccaccagcaccaccaccaccaccatgaccaccaccctgctcctggccactagtaatccattttctgtctctctcaatctgcctatgctggacatgtcatataaattgagtcatacaatatgtggccctctgtgtctggtttcttttgcttagcataatgtttttgtttgtttgtttgtttgttttgagacggagtctcgctctgttgccgaggctggagtgcagtggcgcgatctcagctcactgcaagctctgcctcttgggttcaygccattctcctgcctccgcctcccgagtagctrggactacaggcacccgccaccacgcccggctaatttttttgtatttttagtagagacggggtttcaccgtgttagccaggatggtctcgatctcctgatgtcatgatccgcccgcctcggcctcccaaagtgctggaactacaggcgtgagccacygtgcccggctgcttagcataatgtttttgaggttcattcttgttgaagcttgaatccgtattccttttatractgaataatattgttgtatgtgtatgccacattttgtttatctgttcatcggttgatggacatttgggttgtttcaactgtggggctattataaattatgttgctatgaatattgtagacatggttttgtgtggacatgttttcatatctcctgggtatatatacctaggagtggaattgttgggtcacacggaattttatgtttagctttggagtaacttgcaagactattttccatagtggccacaccattttgcttccaccagcagcctgtaaagttcccaatttcttcacatccttgccagtacttgttactgtcttttttatcgccattctagtgggtgtgaagtagtatttgtgcttatattcttttcgtatgaattttttctttgaagaaatgtcttttcaaatcctttgcctgttttttaatcaggttatttctctttttattggtgagttgtaatgaatygttgaaatggaaaatgttagcctgagcaggaatatcacttgtggccaggagttcaagaccagcctgggagttcaagaccagcctgggtaacatagtgagaccccacccttacaaaacagaaaaggaaaaaaaattagctgggcagggtagcatgcacctgtagtcctagctactcaggaggctgaggtggaaggattgcttgagcttaggagtccarggtttcagtgaactgtgatcacacaactgcactgcatcccagcctgaatgacggagcgagacgctatctcttgaaaaaaaaattagtagaaattaacagaaataaaaaatgttgatagttgtgttttctttyaggataaagttttacacaatatcatgtctatttttacatttatgggagccaatgtcatgcgcctagatgatacttacagttttcaagttattaacaagacagtgaaaatggttattcccgcacttattcaggtaaggtctctttataccatcgtggggtttctttttttaatttaaaaattttgcatataaatgacattaaaagccttttttttagttttttttttttgttttttttttttaatatcctcaacagttgtataaaagcctttctgaaatgctsaagtacattgcccttaagttttagaacattgaagctaagaagcagtcttggcaatgtctttctcaataatataaacaaacgtgttatagcyggttctgctgtgctgtgagtgtgtaactgtaagtgtcttaacatcattcgggtggggtaaattgacatccaccatctatttcaggacattgcatcagtttgataataccttcttacatgttgatgaggctaggaacttttagagctacagtgacaaatttgttaacatgcagtttagcaaatgtttaccaagcattctctaagagctaaactcagagagagaggtgagatgttctctctcccagtaaggaatgaacaattcaaaagttaaaagtagcctcaagagtaaaagagcttgttcatctacttgagttgtctatgtacccttcacttgttaattaatgtcttttctcatgctattgaccctctgagggatgaccatattcagcaccttcttttaaccttagtattagattggtgttctcagtgtccaccaagttggcaagtataggatatatacctaaaaagaaaaataataatatgcattcatatgatcagtgccagtcgaataagtaaatgctaaagagttcagaataggggaaagtctatatgggccaggatgaccagaaagttctataagaaatagaatttgtaccggtgtgaaagaaggatgggatttgttcagtgatggcagagccaatagtatgagaaaaggcatgatctaggaatgtgcacagcatgtttgaagaatgtaatggtgattgattgatggagagcagagggttgagacaggtagacrttggtttattcattcattcaagtgttttctgtcattctttctgtcatttattcaacaactatattttgatcaccaatacctggagtaaaatggttcaaactttattctgaaagcagcaggaagttgttggccttttctgtgctctgcttatcttcattcttcttgaggcacaacccaaatcctgtgtgatttgtgcagccttcccaggcagtctaagcagacttgctatcagtgtcacatatttggcatstgccattactgcctcctgttatcttttcacacatgtattgtttcttttgtttgtttgagacagagttttgctcttgttgcccaggctagagtgcaatggcatgatcttgggtcactgcyacctctgcctcctggtttcaagtgattctcctgcctcagcctcctgagtagctgggactacaggcacgcaccaccacgcccggctaattttgtatttttagtagagatgggtttaaccatgttggcctggctggtcttgaactcctgaccttaggtgatctgcccagcttggcctcccaaagtgttgggattacaggcgtgagccactgcgcccagccatgtatcctgtttcatacagaaaataaatctcctttggggcagggctcatatcgtacactttgtattccccttggggctaagtagcgcttgggacatgacaggtacttactgaatatttattgttaggcctttgattattaaaactcttgtggctgagtgtggtggcatgcacctgtaacaccagcactttgggaggctgaggtgggattatttgaggccaggagtttgagaacagccyggtcaacatagcaaaaccccrtctctacaaaaatttttaaaaagtggtggtggggtcctgggatgtcccagcttcttcggaggctggggcaggaggatctctttgagctcaggagatccaggctgcrgtgagatatgatcacatcactgcacttcagcctgggccayggagaaagaccctgtctctaaaaaaataaataaaattcttctggcaatttcttggggcccatctaaaagccttatcttgttcacctaaacttgttttgtggaagattacttgcacctactcattgtctctgcttgctgttttgcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggtcagaacctagggtgggaagataaggaaaatggtgatttctcacacagattttatgatattgtccagtttaaacatgrggctgatgatgcctaatgtgtgttatttagaayctttttgctcagaacctttttcaaaaaggtttttggcattttaaaaaattgcattcagagcccatagcactctgaatatcctcagttgcagcaaaacatctgaaggcgaattaacttttctgagaaacagttctgstgccacgcaagtggttctcttttaagcccagcagagtatggctgaagagtaatgaaacagtgtctcttcaaagcggttttgaaggcagtttgtggggaaatagaggagcgtccgtgtccctgaagtcagtaagacacaaacacaggtgattgtttggataaagccctgtttggataagtcgaggaccatttttaaatgacttcttagacatgggatctgggagtagatctcgacccactstaaataaagtagtatactctgttctgctagaaatcctaacgcacattatcctgaaattatgccttcacaattcctaagtacagatttgttacctttttctttttctacacaggatgctattttagaagcagacactgaattttggttttcagtctgttgtgagtttagtgtccagcatcagatacaaagcttgatgaatatcctccagtacttactaaagctgccagaggaaaaagaaggtaagcgtagatcgggtgtcacttactgttcaatctgaaagctaaagagaaacagaagagaatgcaggttatccttagtacatcttcagaaggatttttaaagtaagttaatcattttaatttgattgtgtagtttcttgaatccttatggaaaatagtcggaattccatttgccattcctcacacattgtcttttatacctctgtgctctgcgctgacgtcttggctgtggaatgttgctggtatccaggatgagttaggttcaaatgacagtaaatgatcaggacctcattagctgtctctcagcttctcattaaaatatctgaagacatttacatgaaaagaaaaaaagtaggtaccacaggagtggcagcaaaatattaaaattgtaccatgcagcagagccttgaagaaaatcccacgaacygcagcaccactgaggctggcttaggaaagggttgatgaagccaggtgtgatggtgttagcctgtggtcccagctacccaggagaatgagacaggaggatcactttagcgcagttcaagaccagcctgagcaacatagtaagacgccatctctaaaaaaaactttttttcattaagaaagggttgacgtgttgatagttcttagttctctacaattcgaagcagaacgacaaggcacgttagaaggaaggtactctaagagctccgcagagactgttttctgcgtggccagccattggccctgtcatcmctgtttggcgaggcagtaacttgtcccatcctgcagtcagctcaggtttggcagggacagacgagggaggtccctggacagtatgtggtgtatgtggtatatgtggtgatgtgggtaaggaagtgtcttagcagtaagtcattctataggmtagtggtttttaacactgcactgccaaccccatttacattagacacattgaataaagaaatctacacctgcagttggaagttcagagactccttccgtgatgtggtttcttccatttgattgtccagtttccctgttttgttttttgtcttaaacactcgcttctcagggccactgggtactytcttggcaaatacactcacgtttttcactaatttagaagaggagaaactggatgtaatagatgaacacatttctctgggaaaatgttatcccgttaattgtcctttacttgaaaggttatatctgttaattctgtatgaaggattcaggtgaaaatgagtaaggtcacttgttttattgctgtttcagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtaatgtgttctttaaatgtgtttataaaaaggtattctgctgtctccaaggaactgttctcaaccagtagaagtagcttggtaaatggctcatgaaaatgggaggcacgcctttaaagataatagaacaagaaagtacgtttcaccatgaaaagccgttcgtcatgatctactgagatggaacataatgtaaactctgtgactcagtggtttcattcttaagtgttgtgtacccatcagaagtttatgaacctgtacaccaaaaaaactacaagaatctttataatattcataacattcttcatggtagcacaaaactggtaacaactccagtgtctaccagcagagtagataaattgcctgtattttattttattttttgagacaggtctcactccatgtcccaggctgaagtgcagtagagcaatcatggctcactgcaacctgaaactcctgggctcaagcaatcctcttgcctcagcctcccaagtagctgggactacaggcgtgtgccacctacatctggctaattttaaaactttttttatagagacagggtctcgctctattacccaggctgatgtcaaattcctggcctcaagcgatcctcccaactcgagttcccatagtgctgggattacaggcatgagccaycatgcccagcctttctttacctggatatagtgagttctgcatgtatgatttgtatacatctctgtttgtgtattaaacttgtttaaacaatgagagaaaaggaaggaaagaaaggaatacgaccaggaatacaaaaatggtttgacattagagtactgtaaagtccattaggtcctataatgcgttaacagatgaagaagggaaaccatatgatcattttacatttcacagtgaaataattcagcagactcaatgcttattcacaacttaagagagaaaaatcctcgctcacacctgtaatcccagcactttgggaggccgaggcgggcggatcatgaggtcaggagatcgagaccatcctggctaacatggtctctactaaaaaatacaaaaaattagccgggcgtggtggygggcgcctgtagtcccagctactcgggaggctgaggaaggagaatggcgtgaacccgggaggcatagcttgcagtgagccaagatcgagccaatgcattccaccaacctgggtgacagagcgagattctgtctgaaaaaataaaaaaaataaaaaaaaggaaaaaactcctctcagcagtgcaggatagatgggaattactttggcctaataaaggtgacaatctgaagcttgtggtttatatcatacctaatgatgaaatattaatggtgtgcctgctacagtcagggacaagaatctcctctgtcattgtttctattcaggaaaagaaatgaagtgtaagaatcaggaaagaagagaatcagcaattagaactaataatgagttcagtaagcttgcttaagagagatcagtgtagacactatctagagatcagtgtaggttgtgatctgtatcaagcaggctggctgaactaattagtctcaccactgttatataatattgttattcctcaaattagaaaacagagtagaaaaaaagatttcctgtataatacaaacataaacttayaaggtaccaagaataagcctgacaaaaatatgtgcacaaatattacaggggaaatgtgcaagatatgaagggacacagaagaaaacttggaagaaatagaaagagagacactgtgtttacgcatgaagaagcctcactatttaaaggtggcagatctgcccagattggtctagaaactcagtgtgctttttcaattatatcattttaagaaatgatattgatacattgataccaaactgtaaggggccaaggacagtggtatggtgcaggagtaatcagatggatcaatgtgactgaacagtaggcccagaaacacatgcaggcataggtaagaggtgcagcaggtgattttacaaagcagttgggggagagaatggtccaagtgctggccctggcatgatttgtttcccatttggggaaaagtctgatgtcacaccttgtagaaaagacaactttagtcagagtaaaaacttcattgtaaaaaacaacagttcaaatgtttagaagaaaatcaaggagaacatgattgtgactggaggataggaaagaattcctttaaaattttgattcaatagaaagccacaggctgagagaagattattgctctgcataaatcaaaaagcctcagtttccattagaacaactggcaaagaatatgaattcactgaagaggaattacagatggccagttaatgtacaatgtcatttagcctccagtaagcaggaaatgtgattaaatgtgatacccatcaaattggcaaaactgttgaagtcgttagtaccagggatkgggtacgtagtggcagacagtgtgattgttccaaccactttagaaagcaattggcaggatcccatgaggttgaaagttccagtaattcctgtgatctggtcattcccttccttaggtatatatgctgtaaaaacttcccaagatgatcaaagggacataaaaatgttcttctctagcattattagtaaaaggggaaaaaatggacataaactaaacatctaacaacagaggcaaatggatagataagtggtatttatagaggaatatcatatgcagttaaaatgaaggaactagaacataagtcmccatgcatagatctcaaaaataygtttccagaaaaacatgttgttccgtgatatgtagtgtttgaaacatttggaagcagatttgggatgatggttktgtttgtggggcttggggtagagggagaataggaccaaggagcagtacttgggggattccagctgaatctgtaatgtttaacttctcaacaaaggatatgtgagctcaccagmtcagcatgtcatagaattcggtagtgctaattgagtgttgattgctgtatttttctgaaccattgtagtactttttagatactaccagtagaatrtaattaaaataaattaagagaaatagagttactacagtataatgaagatgmtatgaacctgattaaattgtaatgtcagaaaacagttgctgtggaaggtttcagtgaatggtccgagtttcattgaactgacttgaaatgacttttattattgacttccmtaccgttctaatgacgtcttctttaaaaattaggtagttgagagtggtggtcctgagattttaaaaggccttgaagagaggtatgtttccttttctttttytactttttatttggaaatgacttcaaacttatagaaaacctggaaaaacagtacagaaaattcatatactctttacaaccaggttcaccatttgataatactttctgccacatttgccttagcgttctccctatgtagggttttttctctgagccatttgaaagtaaatcatatacattatgtctctaagaataagagatgttcttataaaaccacagtacattgatcaaattcagaaaatttaacattgatccaatccagtgatgtaatctacagttcatactccagtctccctaattatcccaacactstcctttacaccgcatgtgtttctgcatcatgatccatgtcaagtctgtgtattgtattgagttgcagtatctgtttagtgtctyaatctggccctgatttctatgggctcatgaattctttattcygtggattctaatccatatgctgccattatatatttgggtgcaggaattttcctttctctcccwtgtcctcggggtttgcctcctggccttgctgtgtacctccttttcagatgcatggcattcccagggccactgtcctgccccttccactggaaagtgcctgccctgcagccaggaatgtgagctgctgagttccagtcctgtgggctgacttgtagcgctaygcgtaggactttcgtttttggagctgattttgtctgcgcccccttctcccctcctctgctgtgcggtgtcaacttctgtctccactcttccctctagctcccccctcaggctggcagcagtggggggatctccagtggcagctgtgttggaatttggtgtgtgcttttctaattacaagttatttgaagtttgtagtcttttttttttgtctcctaataatgtgaaagaagtgggttatatgttcatttctattaatatttctctttatataaatggtgtatggtgtgtgtgcatgtgtatgtgtgcgtgtgtgtgcctgtgtgtgtgtgcrcgcacacacctgccattaacctagggccataactccctgaacaccccacttggacagcccagtgagatccactgagcatgagctagatatgagtgagttccttaaacgctttcagcatctgttgcttattcagcacctcacagagtctgagcgaggtcgatgcttctgcacagaagcgcctagttacttcttgatgatctctgtctatggcaataatccctcatttcctttctttccgagtagtttttgaaayaatttagtacagaattatttaactcgtctttctacttgaaacatttagcataaggtagacatgaacaagttctctgagtkycttcagctgccgtttgctgagcgagcctctgtgtttcaggttgctggagaccgttctcggctatatcartgcagttgcacagtccatggaaaggaacgcagacaaactcaccgtgaagttctggcgcgcgctccttagtaaagcttacgacctgttagataaggtaggtgttcatttctccctggaattactgttytgttgctgttttttaaattattgtgaaattatgtaaagtttttaagaataaacttagcaattccttttatgaatataatgaagctcagatttttcttagaaaacaatctcttgatgactagaaatagatttgtctggaaaaaattgtttccttaccagttatgagaacatgtacctcgtatattttaataattaagtcatataatatatactgttctactttattcaagtggaataaaataaaagtatgaagtatattacatacatatcactggcctcgaagttaggattgctgattcaaatctagctcagtcatttagctgcatgcctttggcacttcctcctgacatcaggcttttgttttgttcgataatgtgtggttggtaatgcctacctgaaaggttattttaagaattaaataagaaaatgtgtgtggaagtgcctggtgcctggaggtgtgcagtggacagcagtctgtcttaattgaagttgrttttttttttaatttgtttttcttttcatgttaaatataaaatttctctttaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagtgagtgaagacccaggacacacccatttactgtacttygctttatcaaagagctgcatttaactcccttcaatttctctagtggtacaatttcaaattgaagtatattattwtctgaatataataccatgacatgttttaaaatgtgacgttaattctaacgggaatatatgtgtgttgtaagagctcttagaatggaatttcagcctagtggaattcttgcttactacagagcttacgtggccttagccttagcatagttctaagtcccttttactccagatcagtgggtgctttgtataagtgaaacastggctagaacatgcacatcgcttagcatgactgtgtgactcaggacccccgagtctgatttccatttagacaatctcaagctgtgacaatgggaaaatggacaaacattttttgcarctttaatgatttggggattctggctgtccccttcaggttacccgtttcctaaaactggttccagaccttttggccattgtgcagcgtaagaaaaaggaaggggaagaagaacaagcaatcaacagacagacagcrttgtataccttaaagcttttatgcaagaattttggtgcagaaaatccagatscttttgtcccagtgctgarcactgctgtgaaactgattgctccagagagaaaggaggagaagaatgtcytgggaagcgcgctgctgtgcatagcagaggtgacctccaccctggaggcgctggccatcccccagcttcccaggtatgcggccggagacttggaacaggagctgttaccgcctggcacacattgaaaaataacactttggtgactttttttttttttcctctgagtagacgttgcataaaattggaatttgttaaagaattgatcttgcagggtgtggtggctcacggctgtgatcccascactttgggaggccaaggcagggagatcrtttgagcccaggagtttgaggctgcagtgagctatgactgcaccactgcactgtagcctgggcaacagagtgagaccctgtctcttaaagaaataataataaaaataattaatcttcaaacagaaagatgcagccttcccgtttatcttcagatgcactrctttgcagtgttaatcgtcctccattcttccttccttttgtctagtatagtcaaaaagcagtgggtgaaggttcttggcagaggggcccacccagttaggcaaggccaaagctgccttctgctgccaaatttggaagttagaagctcctggctgtggtagttccttactgtacagccagtatgttccttaacctgttagagctttgctgtctataaaacagagacagtatctacctcataggatttctgtagggcagtgcttgcaaggagttttgcatagtgcctgacacatagtaagtgttcagttaatgaaagacattgttattttttaaattactgttgtgtccrtactgttagcactgggagatttcttgtgcttagccacataaaatgtatagacactgctttttaggctatgargcagatagcgatgtaataggcacagtttgctggtttttttcataatgccctctactccattccctagcctctgtttctgcttcaagttcttctaaagctcttactttgtttctagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgagccacgatagccacgacatgctaygcagggtggctggggaaggtaaaagatcacaaatgtagtgattttgttttttctttaagggttagtttccgtttgacagaaaggagtcttatttctgaagagatgtgcttgcttttattaaatgtgtactttttctcttccatcatccttgccacttaatcttgaaattgatatgggggtcactttttagcgagatgcttctcttctttaattgtgcggaatgtattctggcttttttttcttctgtgagatctttggagttgggctggtagagccgccttttattacttgtggaaattgatgggccctgtttctactgtgagaggtwtaatcctaaggcatcttgcaaagcagaatttttgtattgcacgtcagcggtttcctgtcaacacgctaggggccagtggtatttatgattgaagatgctcaagartgttgagacctggctgttccattgtgttgatcatttgccatttacaaggttaggagccttcattaccatggggcaaatgattaaaccgcttcacttacaccacagccagggtttaaaagtagccttctcagagaaaggggcctgtgctctgaggagctttctcagttttttagcaacttgactcttgccgtggtcccttgcattcctgtcctctaagaaaatcatctgtctgggtgctgtgtgtgcgtctgcgtctaccatcggccttcgtccctgatcgcaagttgggcaagaggtgtctgcccagttttatccactgacgtttagggctgactttaaaaggaaytctgtgtgtagttaaaaagtgctaagcattttccaaacactagtacctcatcatgaagcctctctgtaagtgtgtgtttgtcagcgaagatctgcagtggccctgatcactttttttatattcctgtaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaaggttagatcttattgggtattaagactttggagaagggagaggtggtactgcaatgtgtaaactttgacttaaagaagaagatttagtttttaaaaatacacaccgctgaactctaggaatcatttgaaaatggcacatctytttcctgtgttattggtagaatcacatgggtccgtttatgagcatcttgcaagagcatattggggygatgaagaaggaagagctcacctcccatcagtctcagctaaccgcctttttcctggargccctggacttccgagcccagcactctgaggtaagctcaggttcactcctccaaatcctaaagctgttatccacctattgaagagtccgagaacaatctagccgtgtaacagtggtacttgccaaaataatttacagtcaggtatcagcactctaataaatgggctcttctgttttcagaacgatctggaggaagttggaaaaacggaaaattgtatcattgactgtctagtagccatggttgtcaaactttccgaggtcacattcaggcccctgttcttcaaggtgacgctttcttcctcttcctctcttttgtgctcagatttaagtgacaagatgtcgaagaaactaatactgtcttatcctttcagctgtttgattgggctaaaacagaagatgccccaaaggacaggttgttgacattttacaacttggcagattgcattgctgaaaagctgaaagggctttttactctgtttgccggccacttagtgaagccttttgctgacaccttgraccaggtgaacatctccaaaacaggtgggtggtcgcttcagttcagctgtcacccttgycctgtgtgccttatacaaggtaccagtaagacacaasctagtgcttggaagcaagattttagaggttcttaagtcctaagctaaggagggtgaattttttacttcattgttgtcagacagtgaagtgttgttttagcatsatgagcgaatgttataagtcacctcacttgggagaaagaataaagtaaatggccgttactgtcagttactggaagtaactttaaaacgcaaaaattaagattagtttattctctaatgctaatacgtgacccacttgacagttgagggaatttaacttgccagagtgagtgttagaatcttaactctaaaagaaggaatcattcttcgagagaccatccattgtgttctgccttcgtcctgattatgatttctagatcattttagactcttctgatttagttattttaatagtgatttcaatgtaaacattggagattaaatggttaagttcagtgttttttcatttttactcttcccacrtctacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcaggtaaccaaacagaatcatctttcgttgctgaggaagccatcactgttcgagcttggcaggttttagatctgctcaaatgacagcttgctaggatttttctttgtaaggttgttttttctggtctttttaatgaaatgttttatttgaaaattgttttttcaaagatataacttcattgtggaatttgagttttgttttgttgttttgagacagggtcttgctctgtcacccaggctggagtgcagtggtgcaatctcggctcgctgcaacctccacctcccggkttcaagcaattcttgtgcctcagcctcccgaatagctgggatcacaggcgcccgcctccacacctggctaatttttgtatttttagtagggatgaggttttgccatgttggccaggctggtctcgaactcctgacctcaagtgatccacccaccttggcctcccaaactgctgggattacaggcgtgagccaccatgcctggccctgagttattttttattttttattttttaaactgctcaaaagacagacatgatataagctgtcatggttaatgtattcatttgttttaactgggcctcactgagaacgygtcagagcatggctgtcctctggagcaaagagctcctctgagatgttctgctggagagaaaggggcgatgataaagggtatgagattccatttgagttctagaaggcaatacatttgccctagagagtattagaataatgcctggtttttgaacctgctaatatcatgaaagatagtaaaatatttgtatgttggayattttttcaaacagaagaaagaaatgagacttgttgttcaaagtctttgtcttactcttcctagctggaaaacaggcttgggggagaagagaaattccaggaacgggtgacaaagcacctgataccatgcatcgcacagttttcrgtggccatggcggatgactctctttggaaaccactgaactaccagattctgctaaagacgagagactcctygcctaaggttaggaactgcgtgacaagtactgaaactgcatcttttcactgcatagcctaaacagcctgcaggtggtcacagatgtaggccccctagtaaactggcagggaagaacattgctatttgtcatccagtactagaggtcyggtcttttgtattaggcagaaatttgtgcctaagaaaattttgttttttacttayaggctatttgtaaagaatagcaatgccctatccccaccccaatggtgcgttgggcagaagtactaaaatactttctaaatacttttaaataacaaagatttgaagtaattccttcttttttaagtgcyattgaaatgtcattgtgctccagagagaaatgcattgaatttatccacactatagtcttttgagttagagcaatacattctgttgtttatagatactaggcttatgatcttgytgagyaagtggtggcagtggaaataaaacatgggtaggttgagtggaagtcaaaatttgacacccaagtgttacraatttcaaactgttttagcaatgagtcaccatttctcaaactaatgattgtattagaactttactggctataacagaccaaagcagaattttattaataggatttattagttcaaattctttattaggatatgctaacaatgagactattatgatgamcccccacattttaaaccataggtttttatacaagtagcagtatcaaatttattgtaatattttactttgcacaaatcaaggaaatcctgattgaatctaggtagttacaaatggttttttaataattcactttgtactgtccagatattctttaattaaaatatccaaaattagaagaccagtagggcttttgtttcaaaagctaacaatacccaactactgcttgctttccttattatagacaaggcatgtgaggaacacctagacgtttttaaagccccaaaactaggatattgtgacacagaatgttttttattcagtgctgagatgggagtttatcccaagcgaytgtcctggcccctcatacaaytatagtggtgaccagtcaggggctgtgggtgaggagacctgccagaggtggctggaggcactttattgccagcctggcgggctggcgagcgccaatgaagtaaaatctggtgacacacttgagtttgcatgyggcattttattttattggttttttttaaaggaagagattataaaaagacatttcacattaaagatttgcagtcctgggacacagtttggaaaacactatttataaggttgcacatattacaaacagctcccaaatggtgaaactggtattctaagatgaaagcttaatgaacataatgaagtgaataaacgcrtgtgaactaatgtttaaaaagttagagcytgtctcaagtcagtacagctcttaagataataaatacagtaacactactttttatttctttgctcttttatycctttcaggttcgatttgctgctttgattactgtgttagcactggctgaaaaactaaaggagaattatattgtcttgctaccagaatccattccyttcttagcagagttgatggaaggtaattcccaaactattcccaaccattaaacaattaaggaataattcagtaaaattctgtgaaaatgtgcccaatgataatgcagatttkgatataacgtgactagcagttgatccagtcctcatacaggcagctccagtctcaaatacaggcaggctcgagctcctgttttgagttgggtggagggagcaagttgcgaagtgaccacctcctgatcatttgagagtccgtttacagtgtaatcttcacgatcttttcttttgtggtggtttgtgatcatacaagcagattacagtagtgtttttaattaacctcatacatttatatgattgaagttttggtccccagattgtatggaaatgcctagtggcattaaggatgcrgtaggatgtccacttttagtagcaaccgatgttcattcactactccatgttaggtgctttacttggattatctcacttaaaaaccacaacattttatctctgttttacaaaggaagaaactagaggcttaaaagatttcagttatttgacaaagatcacaagctagtgrgtgtgacatggggagctgtgacagttctggaacatagagtcttaggcccaggaaataacagtaaatgttattattaagggaggggtggtggagcaagtagatcagtcctttactgattcattgcttatctaagctacaaaagtacattctcctttgtttcttagctcttggaggggggaggtgtgagctactaaaggggtggcatccctaggaagtttgagttttggggattcttattcagcttccagtgcaagcctgtgggcaaggaatgaaggcggaaggagcggtgtggagggaggcggtccgtggcgcctcctgctttgttaatgtgcttcatttcactcttttgattgaatgattgcyggaaagtgcaaggcattaagaattaaactaatgagaaccgaggcaggcrgactgactcagattttaattttgattttttttttttttttttagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaaatccccacctggcttgtgctgccacataagcctctcctgcctatcgtatagagctgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttayatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcayacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataatagaaaaatcacagaaatggaaccatttaacttgctgatacaggtttgattttaatcacgtaaagtggaagagtgctttgatctcagttgctaatgatgatggactaatctttagaagaacggaggccttgattggtgatttcatgggaacaaaacagatttctgcattacctctgcctgctttgtgggtcccttagttggcgtacactttctgatagtgcctgccttatgaatgcctgaagtctaatcctgaccttactttgttgcccataaatatctttcaaattgaatgcatcttgcctcttcctgaaactttctgtaggcgtctgtgtagactctgatttgccctaagttcaaatacacagaaatcagctgccttgggcttggcatcaagttaatttcagcaccatgtatttgttttgctttggttttttgccttaatttctgtgctcagatgtcatgccaattacttggtaaagcttgcagctaatagagccacatgtttattacgataaagaaaatgatgtcagtcaacatcagtcctcagtgatgggatacggtagagcactggttatgacagtgatcactggggaaggagttgtgtcttctgtaagttagtgtcttcgggtgatttaatatctgcataactaatcccagaggaccccttaggagttgatgtaatgcctgtagaaaaagcagtgcgcagcagtagcgcacagaagagtcgaagctcaagagaacagggaacatactggtttgtttcaccaagtatatatcctagctcttcacagttttaccaaaaaaaatctgtgctcaatacatgttagctactgtattatagtaggtactccataaatacttgttgaatggcattcttgaagagtcagccaaagtaggagagagggcagagtggctttaactggctataagtgttgctgcccccagtttccccattcagtgctagacaccaccatacttcatggcaaggactgagaacacccagcaggayctaatggtgcacaagctcattttaacaatataaacaatagaatgacagtgagatgcgtttcagcaaggccagtatcacagaagccattctgtattttggtttttgtagcagctgtgtaggtaggctaccagctccttacttccagtaagtggatgtctccattaatttccagcgtgtcaatactgctgagctctttaaatctgtgtttgtactccaggctgtgtacgccatttactgcaaccttgaattctctaacatcacartaaattatcatctgaaaggaaaggawacatgccattagtggttccccttagtttaaaattttgtgtttgttacatgctaacggtgtcagagtaaaccatttgattatacatagaaaagttccagcctgctgctgctgacttccttctgacttccaagaccctaatctaactaaagtgtccctggtggtggcactgtctgcctcatcccacccagggaagtgactcggacatgtttggagcctcacaccatccccagggcctgcggccctcctttcctcaacacagcccctctccctcggccgcatcctgccccttgctcctggaaagccagagtgctgcccctcctcgccgatgctggggactctcctaaagcaggaaaactcactcctaatatggttgctttagttcaccgagatgctgtttccagctgtagcctggaaccaagggacttggatcctgactgacttttctgcctcaaactctaggaccatgaacaaaccagacaattaatatgaaatttcagcagcttaaggcacttgctagggtttttacagctgcttggtgatcctgatcctgataagctcagcacatcttggcctcagtgtgtttgtccaaagccgtcaaagctgggtatcccgtaagttggaagtggtgcacatactacaaattcattgatccatcggcagtgttcgcccttcacagtcatctatgcccaaaactcaaacaatgaaaaaccaaaaaacctactagccttttacatcacctttacacctacacttcatacttctggtgccacgctgccagtgccaggctgggtttccacccactctgagaaggccactgggaggccctgcactgagctctccctgtgctcctcgcccccatgaaggcttcagaagaaagaggggcagctcagccttgctgctaacccggccccamcccgagaggccagaatgaagcacaaaacctgaatctgcaaagcagcaagttgagggtttccattcttttgataggagcagtggaaaggactgtcaaggaaaatcaggaaggggaggaaatttcagcccaagtcctgcactctgataacagctggccaagatgaagcttctgtggctacagaggattggggaaataggtgtaacctgagattctatccccacaagaatggtgggaatcccagttccaaccaggtagaagggaccccagatatatttaacaaaatctcaagaaaacacaaaacacacagcctgatgctatagctcagaaggaaaaccaagttggcagcagagggagtcaattagttacctgtactgtatcagagcaagtgcaaagccagtgaattacaagcaagtggcaaagaaatgacatgcttccgggtgagcagactactgcaaatgaaaagaaggcacatcctttgcctagaagaaaacagaacaacagaatccctcacaaccatctgatgctgccgaacagctggaacacggatttcatccagaggaagagcccacagatgaaattacaacactgaatgagattgtttttaaaaaactgtagatacaactaaagtgtatttgaaagagcaagaagatttaaaatgaaagtaatggcataatggaaagacctgagataatctcaatgcaagcatatttaaaaggcaagagatggaagcccccggaaaggacctatcagtatagaaaatcgtcagcagtgatcaacacaaggataattactgctcctgaattagaaaattaaatggaaaagacgattgttcaaaagcatataacattcatctattcattccttcagccagccatccctttcactgtctctgcaaaaaaatgcctggaatgtggttcacctaatcctaatggtatggtttgaattatgaagttggaggtattttcatcttagtatttttcagcattatttgaatgtatcattattatccttttttatattaatatagcagatccaaacttggggcccagataggtcaaaaacaagttacatcattggtttcctgtcacccaccacaaggctcaacttccttctagagcactcacctctgtttccctccagtgaaccccaagtcaccctttgcgccttgactcttgccaagctaacaaccctgtgctgcccttcccacctctaaggacttgttcaaatcatgccctaaatctagaaaagccaaccttcagccttccacatccttcccagctttctgaattccaaaccaatatccacaacttcagggaaccttccatgattagcccacatctgtctacactccacataccagggcactgcattagactggaacttagggataaatatgaatgtcacattgctatctattccgcctgatattcatgcttttagtaacgagttttgatgagtcctcaagaacccacatggtccagacaatgtgtcagtttaaaatgctgtagaatgataacctaaaccaatgaccctaagtgactgtgtgaggcagtggcacctgagctggtgattgaggctggccaaacacccggcatccgcatcacaaggagactattctctgctcagcatcccagaaacatatttcgggaaaggtatgtgttacaatattcacctatctggggactcaggactgcatgccttttagttccaagggactgatgtatttttccttgaatacatacaaacaagactaactccttaggagaaaggactgccacctgaaaccgtctaccctgatgggagatgatggccagtgcaagcaagcagttttagggtctccacgtcctcaagtctgcttatatgattaaatgtgtgactccagtcctgagacaagcttcctggttaaattcctatcaatatggggctacacaggaattttaatatgatgacaaatgtcaattccaatgtgcataatttgacactctactggctttgccatttatactgattgcccacgttataaaaaggggcaaattacaatctccaagtaaacaaaaaacatacacaacttccacatactgagttaggacttgatttaaatggaccacttatcccacccctgctcccaggattcttattgctgtcccattttcaaaaactgtaacctcacctcaaagtacatcccaggactaaatgggaaagaggtaatatttctctcttcttctccccaggactcctgaagaaaagaatttcttacaaatgctttaatattcaggcgtgggttcaagtgtagagcaatatcctttgattttcctgctagtaggtcaacattaaagcttttgagaaagraagaaaaaaaaaaaccttaattaaccaagtaggacagagtagtggcaatttcagcaatgttagtgaccagacttgaactatgattctaactctatgaaacacacgtatccacatggacatgggaatgcaggtgaagttgaaattttaaacccagtcagcattccactaattcgttacttgcaaaataaaaatacgaaaaaaaaaaccctttaaaatcagcgttgaggctgagatgtggttggacagaaatggaaggtttaacgctaaactgaatgactacttcaggctgcaggagcctgggatcctctcaagcaggtattctcttttcatcatctacccgtgttccttccttcttgaaagtatgccactttctaggaaatagctctaatttcaagctttcagaaggctggacgtctgtggaaaaagttgttaaagcagaaattttctaaatcacatgacaagaggggccctaaaaaatgttgcctgggctgggcgtggygactcacacctgtaatcccagcactgggagggcgaagtgggcggatcacttgaggtcaggagttccagaccagcctggccaacatggtgaacccctgtctctactaaaaatacaaaaattcaaaaagtagctgggcgtggtggtgcgcctgtaatcccagctactccagaggctgaggtaggagaatggcttgaacacccaggaagcggaggttgtggtgtgctgggattgtgacactgcactccagcctgggtgacacagtgaggctccatctcaaaaaaaaaaaagaaaagatgttgcctgatcttacggggctgctctggagttctacaaggcaaggataggcctcgtggacaaaaatgctactctcttgtctggccagaaaaagccgaggtcagaacacggccttagtcggctctgctgcccactggctgttcacaatctaaccacctcctgcttgaatcatctcactttggaaatgaagattctgacrctagcccttcttccagctcacaggaccgttcacgggtggaaggcggtaacaggcacggaagtatctgcactgtgactggtaccgaaggatactgaccttttggcatttgcattcacttctcctttaacgacgacagttcgtccagggcccatgggggtgttcaaccttgcagcgaatggcagsctctgaaaagaagscacagtcaggaccaagaggcctgcagaaagcgatctccagggaaaactcgtgtccaaagaacactacggaatgtttcagagccatgaccctgtaaatcccasgaggggagagacagtctgccttggtcccagctgggtcccctgcagcagcactgtccctggctcgaagcaaacacacatgattacattttagacgatgaaatgagtgacagggtgggacccgatgccctctgtatgagtgaaacacgccaggaaggccccctgtgcctggggtctgaggcagtactgtgttctgcctgaaggggaagcagccaagcagggaggtgctgaggaaatacacaggaatggctcagaggcaggcctggttgactctcgaatccgtccagggacggcacacaaatgcagagggggctgctttgggcctctattg

SEQ ID NO: 1675 - DNA, 158417 bp, Homo sapiens
  misc_feature (1)...(158417): n = A,T,C or G, or insertion/deletion polymorphism (see Tables 1-2)
actcaatcggcttcctacctcttgatacttagaggataaactgatacccaaagtaggtccatttttagggggaaaagtggagaaaaaatgagaaagcaggacaaatggctctttttttattccctgaaaaccaaaagcacttttgaacctttcaaatgtgtcttaaaccattaaaatcttaaaatgtaaatagtctaactcaaaactgttgaaattaccaagtgaaatctctctgaaattaaatgtcattattaatttcataggcgtttccaaactataaaaaataaaataaaatgttttcaaaaatagatgagtaaaaaaaaaaggagttatttcattcagtgcttttaaaagggtgttattatatttctttccattttaaaaaattacctagaggaaagctccacgttggtgtatcaagagaaaaattactaatttggctatattctccatggttttttttcttttctttctttctttttttttttttttttttttttttttggtgctatcgcacctctgtcccccaggctggagtgcagtggtgcgatcttggctcacagcaacttcccaggttcaagtgattctcctgcttcagcctcccaaatagctgggattacaggcacacaccaccacacccagctaatttttgtatttttagtagagagatggggtttcaccatgttggccagactgttcacaaactcctgacctcaagtgatccggccaccttggcctagtgctgggattataggcgtgagccactgcgcctggcctctcagtgggtttttcgaaccaatacatagctatattatattcttgacttgaatataatcaagattaatatttccattaaaatgtcccagaaatttttatttatttataggcaaccattcaaaatagaaatagaatgctgagtgaagcagagggatacagtatatgagaagatcaagcaattttaagttagaagaaaaggctgtaaatctggctttggtccttaagaccttgtaagagatgagcaagttattttgtgaagggcaacatcggaggaggcagaataaacagaggaggagaaaaggaccttaatgaaattcaaagtaaaattgggaggttgtgggtaaaatttcataactagacataaaaatcacaagtgggaacatgtcagagtcattcaaaaagtagatacatttgtggaagtgtgtgtgtgtgcatatgtgtatgtttaacctgcctggcatgttcaactggttatgatttttgaaattttaaattaagatcttctaaacctcctgggaatttataaggcttagagattgataaatggtgtctcagataaagagaaggagcaaatgtcagcgctatgatgatacacagctgctataaatgagtggcttgattgcttgacttcaaatacagcacactaactttcctaaactcagtctgcaaaatggtttacatgtcactattctcaatgcccagttttgccgaacactcggatgataatgaaaaagttttgctacaattttaaatttttcctttaagaagtagcataacactactataaaatatctgaggtctgtccagtgagaccagtttaaatatagctggagtaaaatggaaaacaattcagttatggtaaacttctatttctagacttgcactctcttcttaatataataaacatagtatgtaattataaacctgggaacaaagtcctctttattgaaagaaaagcaaatatgtatgcaaatctcaaatgagataatcaactaagcattaattgcaaaaaaaaaaaaaaaaaagaagtcccatgggaccatgggaccatgggaccaaacaccaatatttggaaggagtccttgtggtttggaaaaattgaaacgggcatagtctttcgtctctaggaaccccatatggatggcactgcctatgtgcaaagttgcagggtggggaccatgtgctgtttatcattttattccccgcacttagcagagggcctggcacaaaataagcactcaataaaatgtttgtggaaagaaagaattctacagctatagtttatacagtgtttttccaactttaaaagatatggcccacagtaaaaaccacattttataccaactcctggtacactcagatacacacacacatgcattacacaaaagttacgaagcagcactttctttaatacagtaggcatgttctgattatttctgtcctttttgcttgactaaaaaatactgattatgactgaataaattgatttcataacctactaaatcaagccttgcaatttgaaaaacagacatattatttcagtttacattacttaacctcttacatttatacacttcactacccataagtctccttaaaaaaaaaaatcacaaaatttttgatccagagggaatttagaaaatattcagctcaactctaaagttttgcaccacttacgaattcactgttgtggggttccccttagtcactgttgttgaattatgggaattttccgaccaaaaaaacagattggcccccatctcacatcatatacaaaatttaactcaacatgaatttaaaacctaaaggtaagaactaaacctataaaactcttaaaataaacattaggagcaaatttcatgactttgggttagtcactgacacgacaccaaaagaaaaaacaggtaaactggacttcatcaaaattaaaaactcaaatgacaacatcaagaaagtaaaaagaaccaagcatggtggcatctgcctgtaattccagctattcagaaggctgaggcaggaggatcacttgagccctaaagttcaagaccagcctaggcaacatagcaagacctcgtctttaaataaataaataaataataaataaataaataaataaataattattttaaaatgtaaaaagacaacttacagcctggaataatatattggcaaatcatgtatctgataagagactcggatatagactatataaataaataactctcacaactcaacaatagaaagaaaaataatccaatttaaaaacagggaaaggatttaagcagactttcttcaaaaaagataaatggccaatgaacacatgaaaagatgctcaacgggatagtcaccaaggcaatgcaaatcaaaaccatgagacaccggctcgggcaacatagtgagatcccatctctacaaaagaatacaaaaattagctggtgtggtggcatgcacctgttgtcccagccacttgggaggctgaggtgggaggattgctttagcccaggaattcgaggctgcagtgaactatgattgcaccactgcactccagcctgggtgagagagcaataccttgtctcaaaacaaacaaacaaacaaaaccccatgagatatcacttcataccctttaggttggctaaaataaaaaagactataacaagtgttgacaaggatgtggaaaaactggaaccctgacacattgctggtgggattgtaaaatggtgtgcccactttggaaaacagactggcagttcctcaaaaacaccgagttaccttatgatcctgcagttctgtccctaggtatatactcaagagaaataaaaatatatgtccacaagtaaccttgtacatgaatgctcacagcagcattattcataatagcccataaaagtagaaacaacctaaatattcatcaattcatgggatgaataaacaaaatgtggtatatgtgtataatggaatattgaccataaaaaggaatgaaatattaatataagctataacatggatgagcctcacaaatactatgctaagtgaaagaagaaagtcacaaaggacttcatattctatgattctatttatatgaattgtccagaataggtaaatctatagagaaagaatatctctatctagagttggtggaatgactgttaatggagagggggttcctttttggagtgatgaaaatgttctaagggtagatttggtgatgatggcacaactctgtcaataaactaaaactcattgaactgtacattttatttatttatttttgagatggagtcttgctctggggctgaagtgcagtggcgcaatctcggcttgtaacctctgcctcccagggtcaagcgattctactgcctcagccccccgagtagctgagattacaggcacgtgccaccacgcccagctaatttttgtatttcttagtagagatggagtttcaccatgttggccaggctggtcttgaactcccggcctcaagtgatccacctgcctcggcctcccaaagtgctgggattacaggcgtgagctgccatacccggcctgaattgtacattttacttctatggtatttacattttagattatattaattattcctcaataaagctgtgattttaaaaagcaggctaggcgcagtggctggtgcctataatcccagcactttggaaagctgaggcaggaggatcacttgagcccaggagtttcagactagtctaggcaacatgtcaagacacagtctctactaaacaattaaaattaaaaaaaaaaattagccaggcatggtggtgtgcacctgtagtcccagctacttgggagcctggggtgggaggattccttgagcccgggaagtcgaggctgaagtgagccgtgattgcgccacagcactccagcctgggcgacacagcaacaccctgtctcatggaagaaagaaagaaaagaaaggaagaaagaaaaaaaaaaagcagattggaactctggaattaacaagaagtaggacgcacggagcacttccgcctgagtggagactgtggatccgggtcaacctgactacctaaatcacaggccaataaatggtctttcagtggtcagtccctgtaagatccgtggctctcagcttcttatcttaggggctgtggaggaaggacatgattatgttgatttaagcgctgaatattttcccttgtgatacccatcctcgcaaaactttgcttcaaccacaaacgaggaccttctgtaccagaggggcaataaccacaatgaagctaggaagaaatgcagagcaccccagcatacagtccataagcttcctgaagtggggggcctcaggcatcgctgcctccccaaagaggatcaggcccagaacagtatgctccagaaataagactggaaaaagggaaagaggggcctcaagtccaggagaccagcggctttctgaacgcgcacctgccaacccactttggacaggtcacgatggacagcgtggcaggaaaagaaaaggtcactgtctacccaacacatgagaaactgtttctcgtgcctcacgtccccactccgtccccacccatgttgtctgagtccctcggtgtcagaaacactgctaagaaatttaagaaattctgttaatgagtttaagaaatgtttttaatgattaaaagtcagtgacttgtgaataaccatgtaacttacaaacgcaaggaactctgaaagtgtgcagcaccaccgatcagaagagaaaaccaagggacccgaaatatgctttaattaaattttcttttaaaatgtcactggaaagaacatcttgggaagacggcctggccgatcgccgtgtgaagggcaagccactctggccgagagggagccccacacctcggtctccccagaccggccctggccgggggcatccccctaaacttcggatccctcctcggaaatgggaccctctctgggccgcctcccagcggtggtggcgaggagcaaacgacaccaggtagctgccgcggggcagacagtggacgcgggaaagccggtggctcccgccgtgggccctactgtgcgcgggcggcggccgagcccgggccgctccctcccagtcgcgcgccgccgcccccgcccccgcccccgcccccgcccccacccccacccccacccccacccccagccggcgcccgcgcccgcccccgcgccgggcccggctcggcccgacccggctccgccgcgggcaggcggggcccagcgcactcggagcccgagcccgagccgcagccgccgcctggggcgcttgggtcggcctcgaggacaccggagaggggcgccacgccgccgtggccgcaggtcagagtacgggtgcccgcggcgctcgggaaccggctgctggctgggcggggagtgctcagggagggggcgcggagggctggggccgagggtctgggggctagggccgaggaaacgggaactgacggggtcccagacggatgagagctggggagaagggggtctcggctgaggggtccggggctgaggcagggtcatggtccggcaggacccggactgacgggtcgcgggcgggcggctcacgggtgaccgggtgaaggggtyttgggctgagggcacccgggctgagggtcgcgtctaccggagcgcgcactaggggcggagggcgcgggcacagagagccgcggccggtgccgactcgagtggacgcgagccggtgcgtcccggcttccaggacagcccccctcgggagagcgccgggtgggcgcggagccggggacacggggacctccgcgtccccggcggaggtgcgcaagcgtcgggagccgctccgggggaactttggagcagggtgtctggacccggggaagcgaagatccgcgtgcgtccgtcctgaggccgcgcggcacccctgctgaggaggaggtcccgttcgctgtccagagcccaggggcgaccgccgcktggggaccgggggaccgttcagcgaggggcgcgcttgtagctggccaggccctgtgccctgacgcgttgtgctggccctacgcccggcggaggggctggggacggggactgggtgcctccgtgcctccgcggatggagcgcgcagccaggacccccagccgcaccccggggggctggaaaggcgaagtcgctgctttgtgggctcctgcaagtgccaggcgctgaccactcctcctgggagcctaactgaggggggtagaggcagcaraggttaacagaaatctcaggtcccttggtggaaggtgggtgtgtagtcgtggtactttacgcctcggtgtttagggaggagcctaaggtaaggagtcagaaacggggagtaaccgagctgcggcttttatataaggtcagtggtaggtaaggaaggggccttwacctctgctggtgaccagaagcctgcatttctgcattctgcttaattccctttccttaggtgagttggctcactctcattgcattttgttggaatgtgttggtgataggtccgaaatttgcaaaattattgtattatccttatatcatttttttttgcagtgctcttgttttataagaagaatccaattcacttgggtcataggctaacggttgtaaaaatagtgtcattgttataaaagaaatcaagtcaaaaatagtcgtctgccatgaagaaactaaaatttttcttcttttccttgcaagattagggacaaaatgtaaagtttatttgtgtaaattatcatttggatataaaaccagacaatgataaactgagttgtataatacctattcctggaaaacctctgattttgaagtacattattttaaccccaactgtttctgtcattcgtgagacaaattgttaactggatttattaagagaacaatgaataacttaactctttaaaaggacctgggcaaatcttcgacaggtttcaggtattttatggcagtctttctgtctattgctaagtgatcgattgctgactgagaacagaaccaactgatggtgctagatgatttagaaaacctttctggtatagggactggcatggacattcactgtggcttttctcttaaagaaatacctttcactcctaggggagtttgacagaagacactcatagatgctaccagttagcatttggagtaatatatcaaaacattctgttcaagttttaaagtaagttttgtgtagtatattttcaatcagattcactttggaatcaaatacactttatttgattccaaataaagtgtatttgaatattcactttaatatacgaaactttaaaggtaatgtctcagccaaaaagtgaagtgtattacaaaactgtccatttttgtcttcttgtgtacttcacataatttttctccctgatttaaattatatgatatttgatagttaacttgctaataattatgtcttaagagatctttgaatcaactggtggccatctcagtcttttaaaactcacttgaaggaaaagagaaacactaatgatggttttttttaaaatcaaaaacttttttcatatttacaagtttgtttctagttcttaaacaataactgctgtaaaaccatggcatcagtgaggtataaagttttgtagaatcccaggctgaagactttttggatgtcgttttctcatttctttayattaaaaagaatataatttctttttaaaattaaaactaaaatgtccaccggcctcatattctttattgaacttaagtgctttgaaaatatttttgcgattgatatttttaatgataaaatataatattttctttgaaggactagtttcctaaatgttcatttttttgtatgtttcagaactacttttaaaaaaattctagattatgctttaaattgcaatatttctaaattcctatgacatttaaaatgtgtacaagagaaaaggtgtgacatgaggaatatgaattagaagtggattactaatggtcgtagtgaattgtttttaatcagtgttatataaatataaacaaatacttttttcttctgtaattttctgacaataaggatgttagccactaaccttaattatcaagataattatgtgcatgaaagctgtgtaaaaggcacaaccgtggaacatatacaagtattartaatacatttcatttagttttcaggttataaaatcgttattaataacaagaggctttcatgaagtaggaaaatatgttaaaatgacattttctgaatgtttcacacattctggcccacactttcacttctttcctagcatctatatattcccaatgcataggacagagttggtcattctaattgtgggtgtctttctgctggattcgttgtcacttggacttggaaatacagtatgtcattaggtgtggcaaatgtactggaagaagtttttggtctcataggattccactaaataaatattagctgtagaggatttttaaaaactcactaatagagaaaacttggtgaagtcactagtgtgtaagcgtaaacatatgcaccccccacaactgaatttctaatttgcttatttttcctggtagatctccactttgcttactctctcttaatatcccaaagcaacaaaaagcgcagtgattttaattgcttacaaaggtcctttgaaacggatctaatttgactccacaaaagaatagtaagagttgtgaacaaccatcttgcaagtgtagatatccccagcgtatcaacttcagttagtttcatagcgttctaaatcaaaaatttagatttaagattatttgaaatcttcttggaagttcttacttactgtttgcgttttctcaaaatacagaggtagattgggggagtaatatagtatatgttttaaagctgttatttaactaaaatgtcatgttttaaattttatttaatgcacttaaagtaggttcttgggataaaatctattcagatgcaataggccatgttttggggaaaacttttgtagatgtttagataatatctgtcatcaataatagtatatgtttaaattattttgtaaaaacagatttacatatttttaaaatttctcttcaacaataagtacacatcaatattttaatgccgagaatttcattcagagtatgactgtttacattttcaactgtttcaattattatggcttaggcaagtaccttatcctttctctcaattttgtcatctttgaaacggagaaagtgttgcagttattattgcttgctcttttgctatgattttaaggctttatgagcaaacccatgtactttaaatgatgtgaccatgaccctgaatttaattgagctgatattctgaaaagaaccttcatgaatatctatgtcatagctaactcttttaccaatgttaatagttcactgtagttcaaacctcaataactttgagattgttaagattgaagatgatgcttctcatgtggtgatcaatttataaactgtttctgggaatattttattatcattcaatttaaaattgtattttccattccctgatgactttggacaaaaatcagcatagtaattatttttattccagctttgcgagtcctgtgtagcccctcttatgttaatattatacatccgatgcatctagaaggcacagattgtgcgctttgatttgataaagctctagtctttgcatatctttatggcacaccttgtgaattcttaacgtatattccccaggagcaagttcgttttataatgaggcctaggatccatcagatcagaagacagtttagtgtcacaacttaaaagactaaatagtgacttgtgcttgtcattaaaaatgggtctctttcaacaagcactcaccaaaaaatagtgttttagtggcttgaaaggttcagatatctcctaataacccacctatttgctagtagggagtaagtggaaaaacatataattaactgtgcaccatccaaataataaattttaaattcttcgcgtgaattgttgatacatattgttgtgaagtgtctcctgcttaagaaagtaagggacttggactgaatatgccaaagaggaggcctctgcaagcggtgtcttggtgatgggaagttactggtaacagcacacggggtgatggggtgaagaggcttgtgtgcgtgggccccgggggctgaggattgtyggagaggacttctcccaccytctctgggccccaaactgcacactggactggcaagccactctgcccactgcagtgtggagctayaaagcccaagtagggacttcactaaaaggatgcagaggcgaaggcaaagaaaggctcatgctggtgcgtgtaggtgggctgagtgtccctgtccgggagtggggagccgtgttatcttccactgccttaatcctacagygtaggctttctcagagtcattgccataccttcaactgttccagtggccaggctgttctcaacttgaaaatcttttgtgggacagtgccatgaattttttttcctactgcgattttttagatataaaggaattgaatccattaagtggagattttaaaccctccagtcaggatttaaactagattgtgtaagttcagttcagttggattcaatatctgtttaggaagcatttttattccacttcattgattttagaaaataaattcattgcttggttttaactatgtcactattaaaaaaaaaccactttaatttgtggactcatctgggaggattatgtgtggatatgacatattgagtcagattatctgaccttctgagaagagttcagattagcaaaaacgtggggtgagaagtccttcgcagtttgccacagrtaaggagaaggtagatatgagggaggtagagaaatagggaaataccctgagtaggaatgtaccaggtctgtatatgctcaactcccacartcagcaggttgcatgattactgtgtatagtcttaaaatataaggttgatttctaagaatttaccctgcttcttggtgacattgtaggacatctcagtttgccacttagcactgttaytctttctggctctrtactaaaggagataatttgggcaagggaatggaaagaggttactttttcatcctgtatgtttaaggaataaattttccttcatatcgagggcagtggagaaatataactgtcaaactgttcgagtgcaatgatgaagttccggaaggaacttcctaaccttgaccacacccctctggctgtcatacacctcttaaaatgtctttgaatttgaatgtctttgaattgaaatttaaaatgtctttgaatttgaaagctttgggtctacttttaaaatgccaaagttcctggcagggttagttcactaaaccactatcagcaaaaatgtgaaaggctagttgcttgtttccttgctacctgaaaacaaggcctttaaggagtagaaaacagatttggagtttgaaagagggggttaggagagggaaaaataaagttawtgcatgtcccagtttcctcataagccagaaactttgaaacaaaataggaaaataaccatttggaatagcagtgataggaaaagatatatttacccatcattttttttctcttagtcaagacaagtcgcagatcttccttgaaccatttttgacctcaaaacagttattmtgaaacatcaattaaactaagaaatgtaatcacagttcaagttatgagctagtattatcttaatgtaattaaatatctgaatattatcacttcattatatcttgtatttcctctgtgatgttagacaaattatgtggtctcttcatgagtcaactcttccaggctttaaaagtagcttcctaatagattgaaatgagaggaacttttcaatcacttcagaaaatgatgtgccaaggtagtataaataatgcttaatcctttggcagatccacagatcataaaatatcatacatgcggccagtcgcagtggctcacgcctgtaatcccagcactttgggagacagaggcagaaggatcacctgaggtcaggagtttgagaccaacctaaccaacatggagaaaccccacctctactaaaaatacaaattagctcggcatggtggcacgtgcctttaatcccagctactcaggtggctgaggcaggagaatcggttgaacccgggaggcagaggttgcagtgagccgagatcacgctattgcactccagcctgggcaacaagagtgaaactctgtctcgaaatartaataattattattatacatacttaattttatttttgctgaaaatagtatggcaagccagtgcatctctgttagaaatagaaacttagtagccacctcaaaagcaagrtcataattctgtgaatcagctaataggtggtatttagcagttaggtatgggctaccctcgtgcctcatgactaatcacattgcttactcgtcatgcattttttacaaagtcttgctaaagtctgtgaatctaaaacagagaatctcaaagtgttccttactgaatgttatcctttccgtcagttgataattacctgtgtaaacaagcttttgactgcatctagaaaagcacctatataaattcttctgttttatatggtggataaagtttataaaggagaacaaacataagaatgatgtcaatataaatgaagtagaaacttcaaaaatcatttgcatatgtcaagtataatccagaagagtgaagaaaatacccaggcatttggcaatataggattactacatgttttcctaaagaatttggaactgattagaaacatcctgattttatttaaaagcaatataatgtatttttacagtttgttttcaagaaggttcaaaaaaaaatttttttttttttttgagatggagtttcgctcttgttgcccaggttggagtgcaatggcgccatcttggctcactgcaacctccgcctcccaggttcaagtgattctcctgcctcagcctcccgagtagctgggattacaggcgcccascaccacacctggctaattttttgcatttttattagagacggggtttcaccatgttggccagtctggtctcgaactcctgacctcaggagatccacctgcctcggcctcccaaagtgctgggattataggtgtgagccaccgtgcctggcaaagaaggctcaaatttrgtgacttttaggactagagcagtttgatgtctgcaaaaatctagacaccaatttcttgaaggcaggtactgactgaattctattccagcatatagcacaattcttagtaggcacttaaatgttttagaaagaagaaagagctggtcatggtggcacacacctgtaatcccagcactttgggcagctgaggtaggcagatcacttgaggccaggagtttgagaccagcctggccaacgtggcagaaccccgtctctacaataaatacaaaaattaactgggcgtggtggcacacacctgtaatcccagctactcgggtgactgagacaggagaatcacttgaacccggtaggtggaggttgcagtgagccgagaagattgtgccactgcactctagcctgggcaacagagcaacactttgtctcaaaaaaaaaaaaaaaaaaaaaaaaagaataaagaattagtctaaggcagtggttcttaaaatgtggtcctgggatcgtgagcatcctctggcagcttgttagaaatgcagtttcttggaccycatcccagacctgtggtgggcctagcaatctgtgttttagggactctgctttatacgctgtttgggaactcttggtccaagatgattcttgcaccccacctgatagagtggggcccatttgtcagtgtgctttggatgatttctagtaagccttacccttgcttatggttaagttctttgccctatctctctccactcataggatctcttggaaccatcctataaaactacccccattgrcctatcatttattacttagaaaagctcagtagtggtgtcaataagcttttgtcaagaggctagccggctcactaattagaccttgcaacactggttckttttagcttagcatggctgcttaggaatccctagtctccgcgtcaaagactacaacttcaaagactggattttataaaatcacagaagatgatcggccctagaggactggttcatgttaaacagatttacaagatatggatttgtaaacctcaattccagtttaataatagtagaaaatattcccttcctagtgattgttgataatagttttttttattttaaaattmtataatttmaaggattgaagagatttacactcatatatatctgatgtcactaagatttagttcaggttacttagaaagcattgggcaatgttttgtaacttttgggactttttccaaagggctggagaatataggaaaagccgtatacacgaagagtttcataaaagcattgttataagaacccatatttggaagtaacttaaatatccaacagtagggagatgtttaaataaattatggtataatcaatagttaaaatattgtacagttataatgacaatttagaaactactcrcaactctgaagaatatttaaaaagtaggataaaaaatgtgtgtgaactattgattggaaccttacaaaaatgtatgtatatgaaaaagtctggaagagaatatacaaaagtgrtaatagttatgttacagtagtgagatatggagggctttttgtttgtttttatatttttctctctttcccaaagtttattcagtagtataaaattacttctataatcaaaagcatacatttatagcttttttttctttttggtgtgtctgtgcttctgatagtaaagatcaaggcaatatatgatttttttcctattatacccaaaatttattttatactaaattttatttcacatattggacttccctgtacattttacttgcctagtctctatttggcatggggaaagaaacccatctctgttatggcctcttaatgttctcagccatacgtaaggtttaattttgttgatttgtttgggtccgtgatctacttgatctttagcatatgctggcaaatagagcttttaaaaaatagtttccagagttactttcttttaaagcccttctctctttatttttttctaatttttttctattatgttcctttttttctaaaattgaatgacctcatgatagagttacccagttttcctgctgctgacagaatgttgcacttataaatagcagctgatgcagatgcacagaaaggtaaatttctgttacaaatgttcattatgagcccttcatataatttgtgataataattttaaaaataaaaagaaatgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactctgtctcaaaaaaaaaaaaaaaaaaaaaaaaaaaaagaaatgtaaaatagcaagcgagtagaggtttcccaaaatcagtgtgaacattgtgaaagttatatatatgtatagacacacacacacacacacacacagtaatagcctttgaatgaattcttttttcatcttttctgttgcattgtcctagaaatcccaaaggagaaagttaagtggttttgcctttgacagcggttacagattacatttttcttgtcactttctttgggacttcttttgtgaaacttgtggcatgtcctagaataatctttatcttaaagttttaaaaactttttagaaatttcatatcagtgttataaatatttattctgtatgcctccccagtttgggatgatttcatccttaatgataagccaagacaaacttcagctaacaatatttagtttatagatcttagaatgtgtttatgggtaaaagaacctcgatgtgatgataccttagagaatagatctactgagactgatgcgttttattttcatttttgtattttatttatttatttattgagacagggtctcactctgtcacccaggctggagtgcagtggtgccatcatggctcactgcagcctcaacttcttgggtttaagtgatcctcccacctcagcctcccaagtagctgggactacaggtgtgagccactacacccagctaatttttatattttttgtagaaacaggggttcrccgtattgccaggctggtcttgaactcgtaggcccaagcagtcctctggcctctgcctcccaaagtgctgggattataggtgtgagccacgcgcccagcctgaagctttttttaaatgaagatttattcaacaaatgtctattgagccmcttatttgtgccacaagctgtttcagataaggaggataaagcaatgaacagacaaattccattcctccttgagtttacaattattgttatctagatttaacgagaacatttttcaatgggaatgacggtgactaagagggggtgaatgggcctgtgtcttgtaactagatggcattgctaggcaccgtggactcagggggctctctctgagattggtatagtgtatgggaaagaaaatctgtatccttgaatattttttcccagctctcttactatcctattatcttaggttatgttgcatgtattctatattgtatattatgcataatatatttataatttctgtctcagtaatgaagtgatttcagaggaggtaagaatgaatcctttgctaataagttattactttccttgaaaatccaaatgacaagaggattattcactttgcaaaaggattatttatttttataatgttttcacagtagatttaagtggttaactattcaagtgaatttaatttataaataaatcaattaatttaaaaaaattatttaaccctaagaaaatgtaaaacaaagttcatggagactgtcccattaacatcaaaaaaactttttttcttgggagataaagttggctactttctctttaaaaggccattacaaacttttacaagcttagaatataatatttgcgtaaaaggagacccagatcctattttaaaygaccaaattattttgatcaaattacttactatagctattttcaatgtctgtattcacaaactgtttactatttcagttctgttttcaagttgacagaaaatatcatattgaccacttagaaataaattctgaaccacatgaattttttgggaaaaaatgataaggaaaatcaattttgatggactttatataaagttaaatagaattaattctttcatatatacagggccgtgaaatgttacagtgtaactcaatacagatgtaaccaaaaccttcaaattttgcaaatttcaccagagttaatttgtttggttctacaaacatttaccaaatgaccactcattaaacctgcccacctatgaacatgaccttataaaatggtgagacatagcagtatctggcactgggcacacagattaccacrgctcaataaaagctgagaaaatgactcagtgattgaacacagcgcattgccatggttgtgtctttaagccattcatgtaattcatgctgtgtattcgacttagcctgctgtatgatctttgatcctaaccaagcacaatacagccacagttaatttctttttatcgtgaacattaaatttttaaatgtcaggttgactttctttgtcctataacttgtgtatgaaatatttatcctggtcccagcttttttttttttcattctcaaaggaggtgaaaccagcttttgaattcagaaaatgcagactaatattaatatcagccaaagtaaaacataattagaaggcagatctactctgaaatggaatctgatatattccatgttctgtgttacacatatttgctgattatttgatgtcatgtctgataattttcatgggaaaattccatgtaccaagcaaaattgttagttcctagagggtaagaatgtgtatagtagttctcattctctttaccttgctgtgcactgtataccttccctaattcccagccaaactgggtgcactatatacactttttaatacttttcaacttgattttattttgaggacaagtgtgtgctttttcagtatcacttgtataggattctccacaatcttagggaatttcctaaactactctttaaaatattaattcctattttatgtattgtttttgtgatacataatgatatgaaactaatgccaggagaaatttccatkttgttattctaaagcagacaaaatgggatatgaaagggaaaaatgttaattatagacttcaacattctatgttggacctcgtagttgttctggtcagaagaacaggttttttaatggcctaagggccagagcattgttttgcattcttgtttggagactttcaatggcaactgtaacaaactctgcttagtaccacagttggagaaaggtttacaataatgcccagtacaaaatgttattcagacttactactcatgcataaaataaaactkgttctcttcttaaacttcgttacatattagataaaacactatcaagttttggcctcatttgttcataatatgtaatttaattcagttgctcagctagttcatatatgaatcacaagtattatcatcacaattatttaacagttaatctccttttatagggtagatatgtgttaataagcaacttcaaaataccaaagaaactgctttacatatacaagcaaagcaaatagatggaccttgtgacatctctggacaaccagtcttcttggtaggccttcatctgtgggtgtagaacgaaggtaggagtctgctcactaaagatcaatgcaaggaacttccatgctctccactgctgggcaacctgccattctcctcctgccaccacacctgttcagctactagggcaaagaagtgccctgctagacacaagcagatgcttctcttaccaagagaagataatataaggaaggataaagaactgaaacaggtttgaggctttctcttattcatcatctagacttcagttttcttgatttattattccttcatgtcttgccagacacaacagttgcacatgtgttcaagttggttctaggcacaaagggagataccagagcttctgtagctacgagattatcatctgcgtgagccaagaaggggtagtgttgaaacaggtaactaacaattcacagcagtatgtgattaagggctaaaataagtaaagggagagaacaaatgctacagaaattcagagaaggctaagatcagtgtggagtggagggtacagccaggtaaagccttgtagagaaagtgggaattgaactaaactttggaagctcagggattgacaggatagcctcacgaaaaatactaaaaacaatacagaagaagaaacaagaagggaattaaaggatgattccatttgtacaaaatatcccgagtaggtacatccatagagataggaagcagatgagttgccaggggctgaagagaaaggaaagggggagtgactgcttaatgggtacaggatttcctttggaggtgatgaacatgttttggaactacacagaagtgatgattgcacagctttaagaattactaaataccattggattgtacacacttcataaatacattttaaattgtgaattttacctcaaattaagaaaaaaaaagttcctggtttgaggtaaccaaaagagaaaataatttccagtataagaaaacaaagcctggaatagcaaataagcatagagttaagggaaggtttgcagagattaaccagtttgaagtggagagtgcgtggatgtgagtagtgagaaacatggttggaagtgtagattttaggccagatgataaaaggtctggaatgcaggagaaggagtgtgggttttatctcaggagcggggagattccatatcgtaagaagaggggtgagatgattgaatcagaagattaatttggcagtagcatgcagggaaagcagtcaggaggctgctgcaaaatccggacataccatgaggagggcctgtaagagtgaagtggaagggcagatgtggacgatgctctgaagcagagartgatgctcaaagtgtggtccgtggcttgatgctgccccacaagtgttagttacagacctggcacacagtaagggtagatttgagggtaagtctttaaaactttaatattattatgatattcaagcgcatgattttgcatttcatagcaatatccacagtaggtgtaagagacaagaaaacttccttcatgccagrgttagaagaccgctgccctaaaggatgaatgagtggagttgatgactgactcctgtagggcagtctttttttttttggagatggagtctcactstgtcacccaggctagagtgcagtggcacgatcttgactcactgaaacctccgcttcctgggttcaagcgattctcctgccttaccctcctgagtagctgggattacaggcatgcaccaccacacccrgctagtttttaaaagtatttttagtagagatggggtttcgccatattagctaggctggtttcgaactcctgacctcaagtgatctgcccgcctcagcctcccaaagtgctgggattacaggtgtgagccactgtgcctggccaggcagtcatgttttatggctcctttacagtgttccaccccttgtgctagacactgggaccagagcagtaggcaagatggactggcactttcccttgtggagctcgctgtcacataaatagtccttctttgtcaaaggattgctaggaattaaagggaggtctggttcagctcagcataaggaaagcattctaataactacagctgtcccatagtgggaaaggatgatttgtgagaaagtgagtgcttcgtcattggacatattcatgcagagtctgaatcatctctcaagaagtcttgctttggtgggagaaatggagtgggtgacttatcaggtcttgtgtaactaaggtgccatgattccctattctctaatgtgaacttagtagaacatattttcttcataactggctgtattggaacaccagtacatatactaagtttctgtctgtttctattagcacttggaattacagttacctaaatttacatgtagattcaattttgaacttatctgtacagttagttccacaattctttttaaagcaagtactattctctaatgccttctcagacattcacttatttccaactttaatatttatagtaagttcctctttcacgtgatgtgtgtcacaagtcacgcaaatttctgcagaagtgagttacataaattgcagtcaagctgctgacctgtaaatcattcattcttgcccccgtgatgtcatattggggttgaataagaccaggcgtgactacccacttgaggatgtctttgggatgccattttaattgggtgaaataacttttattattcaacttatgtgaccagttactgcaaacgtcaaactgttacgtttaacagctagaatgatcataggttaattgcactttagaggatgtggaggacgtagactcctataggagtgatagccttactatattttgggggaaattctagaatgtttttaactcaaaggacattattttcatgaggatgattttaatgcttatggtatcaggtgaagaaaaatgttagctgcagaagaaaaaaatttgtttcacttcaagtctagtagaatattttgttaaaatagccaattttcattatgtattattaaaacaggttatacttttcattaagatgtatgtaaaaatttcacatgtgcctggtattacacagtatttacccaataaatatttattgaatattgttgaatgaatgtgaggtgagggcggagaaaatatttcaaatggaaaaatagtatgagcaaaggaaaacgtgaatacagaaagaagcaaagatagtttctttaaagtcgcatttatatgtaataacaatgggaaaactttttggctgagtaattttggtggctccttaatttcttaatatttaacaactaatgacgactctctctgatactgatatccaaagcaaatagctgaccttgaacatggaaaagttactgcctctgactaattggaatgtctgagcctttcttgtcttctatcttctttccttcctttcttcctctctttcctcctcttttcccctcaattgtagcactagctcttgttcttgttccctctacccttctcccctttttcgttcctggtgttccctatgttttcttctttccttcttttctgtctctgtttctctccctctgaatttctgcttcctttcctctctttcccarttgctactgtctctgcctttggttgtctctgagtgtaatmtggaagtgaagtatatttttatctactaaacacatgatcaaatagggattttttattctgaatttaacattaacagaaatgttatgttgctctttatgagacgaaataaarttggatgtcacttataaatggattttgattgatttttttaaagtattgactcactaatcttyaaattggtagaaggaggtcagtagactttgactcataaatttttgtaagcrtaatggcttgttgaataactcctaattgtctttaacaaccttggtttctgtcctcttttttccaaatgcagatatagcagatgtcttcagcatctaattttttattacactttcatatgtgcagtcatacaagagctggagtatttgttttgttaattctgtatctttattgtctagaacactgctaacaaatagcagatgctcaacaaataattgttgcttaatatttcaaatctgtagtgtcattctacctcctaatcccaaatagccatcataactttttagactaacattactcattaaggtaacttagtatacaatgaatttataaatgtaaccatacaatttcatgcttagagaacgttttctctccattctctctacctttagaccattctgcagtttaaatcttgaaccaaaatgtcatttaaccatccttctgaacgataactccataattaactcaagcaccaaataagtcatctagctcttgatggtaataattaatatttgttgaatgcttattctatatcaggctctgttttaagcacattatatacattatctcattttattctttcagcagctatgtacaccagcagtcccccacctttttggcaccagggactggtttcatggaagacagtttttcaacagactggtggcaggtggaaatggtttcaggatgaaactgttccaccttagatcatcaggcattagttagattctcataagaagcatgcaacatagatccctcacatgcacagttcacaatagggtttgcactcctttgagaatctaaggctgctactgatctgacaggaggcggagctcaggcaataatgttcgctcgcccaccactcatctcctgccacgtggcccagttcctaacaggccatggactgctactgcttcacggccttggggtgggggactcctaatatacagtattaaagtcagatgaagaaacaggaacagagaggtaaaataacctgccaggtgataaaaactaggatttgaacccagacaatctgaacccagccaccctgtcatgcacaggagcctactttgcaagtatttggccttccagggaatgagatgtccacatcccatcaccaccgccaccactattccacatttaacaattagacctatacaggtgtaaccatattcacatgtaacagtggattaaatttaaacttttagttgtgttaattcactgcaaatcagcttatgtgtcttgtaagtagtaagcaacttgaaagtacctgttgttgcttatgacaagataaattagatcaccaaatctttatatttagtaacttcatcatcacttagaaatcaaccgctgggccgggcgcggtggctcacgcctgtaatcccccagcactttgggaggccgaggctggtggatcacgaggtcaggagatcgagaccatcctggctaacacggtgtaaccccatctctactaaaaatacaaaaaattagccgggcgtggtggtgggcgcctgtagtcccagccattagggaggctgaggcaggagaatggcgtgaacccgggaggcagagattgcagtgagccgagatcgcgccactgcactccagcctgggcgacagwgcaagactccgtctcaaaaaaaaaaaaaaaaaaaatcaaccgctgttaggaaattctttttttttttttgtctctcttaaattcctcttaatctaaataaagacattttattttgtctcaggatacagaggtcaattgaatatagcaaattttgtcagtgttgtaaaaaatctggagaggaatgtaaacggctcatcttgtgtctggcctctaattgaatcagtcagctatggtggggttaggggacagatccgtgtatttacttgcataggacaaaaattagtcatttgtgagtgttcacatacttccacctctcccaacccaccaaagagaattgtaatttgacagtacaataatcccttcccctactcttaaaaaagttgatcttacaaggtcagtcctatgtttttatgaaaaagaattagagaatgagtagaaaggaactagtcaagaaaagcagaagatttgggttgatagacataaagtgctgggaatgagaggaagagagagagatcgtgaaattcctgggctgggaataaagactgtgtgtaggtaggacagcctttggtgaaggagacactttggagagcatggtgtgtgaaaacacttaaaggaaaattaaagggaattaagaggaaattgaagggaaggagtatatgagaagggttgctttgtggttataagctgaattttctttaatgtattttgaaagaccccggtaaagaaaggaatttcttttaattttgcagagaatgaggagttgtccaattaggtgttgaattgttcttccttggaactctcaagagaggagttgtgtttagagatagatttgggagctgtaagcaagtagatgtgttatgagtcacagtgctgagggcaagaatataaagaagagatgaaggccaagaggaaacttagagaacacaaaatagaaaagctcagaaagcaggggtaccaggaaaagggactaaaatagtcatcataaggtaggataataggaggccgtgcacagtgactcacacctgtaatcccagcactttgggaggccaaggcgggttagagatcagcatggacaacataaggagatctcgcctctacaaaaaaatgaaaaattagccaggtgtgatggcgcacacatgtagtcccagctacttgggaggccgaggtgagagcatcacttgagcctgggtggttgaggctacagtgaaccatgatcacaccactgtactctaacctggatgacagagcaagaccctgtctcaaaaaaaaaaaaaaaaaaaaaaaaaaagggagaaactgatttcaaggagccaagaaaagagacagattcaatagtggaggaygggcaaaatatcaaatgctgcagaggcagagaccgtggtgtgctggagccacattgttaaattttcacaattttattgagccaatcgttatgcatgctattattaaaacttaaattgaatacagttaaacaaattatattaaaaataaaagtaataaatacacaaagcataccacttccttattactttacattgctgagatgattcatgcccatggtatctgagtagtggaaatacactgtaatatttgtgctgcttttaaatcagtcatggtgggagtatttacaccacaaaaattggcaaacactaccaatcagggcatttttctctgcaaagagagccagttaaatatttaccagcatgccactgagaaaatagaattgaagtcaagaaaagtctaatggatttagcaagaaggagatgacatatacttaagtttcagtagaaaggtaggtgacaaaaaccacagtaaagtgggttgaggagtgaaataataaaaaattaaaaacatgtgttcaagtaagtttgagaaccattgaattaaaccgagaagcagattgttattgttgatgatggttttgttttttaaattacaaggtttgcagagtacatactatgctaatgtactttattaatctccaaaaatgaagaccatatgcaaatttattttatggtagaaccttttctgttggaaaatcttagggaacaagttatctatagaatacattttgggaaatgctgctcttgtatttcacaattaagatgatactgattgtaaagtttgagattaatattcttgtttttaaagtttcatgctttttaaaagaaattttgtcaagaatggatgttgaattttactgagtactgtttttgtcgtttttgtagtaatcatacggttttttgacctagtgctgtgacacattttaatagattttcaaatattaaatcctctttgcctttctgagataaatgtaacttgattatggtggttcattattttaatagaggatttaatttgttaattarcattttatttattatttaaaatcaatattgataagtgggactgatatttttctctgttgtcaggttttaatatcagtgttatgacactccagaaaagttaattatgtcactatattttttcctactgagaaacagcttatgtagtaagaaaatcatctcttccttgaaagctttaaaaaatcaactataaaactaatagcttttggaggaagtaattctttgataagttttcaattatttccatygttaattatttttctgtatcttaagtcracttcaccatttatttcatttcagacaagttagtctgagtaaactgcccttggcctgccttattatttacttaggttctggtaaaaatcccatcccagatgtaaaatcattgtgtgagtagagatgaacagcccctgtctaacgtgggctgtgtttaagtgtgaggcaattgtctgctgtcttcacagcccagttctctggcttctagggatgatgggtagggtgtttataatcgaatgaatataaactaatcttgagttaaatgaccagatggcagaggtgaaagaacggcaatccktggtgtctactccccccagaatggatcttgtctctgccctactgtgtttcacrtctggggaygattccttctaagatacagtgcagttctgaatgggttcagaaggaagaggactggtagcaggagggggtctgggggaaaggttacctaaatctgcctgactctgacagtagtaagaaccagccaagtgttctgtttgatccgacacttggggctacacactaagaatagataccagtttctagaaatctttactttttgcccatctacttctgaagaaatacctatgtatttcaaaggaaaattggcacaagtatcaaggaaagctggtacaacttaatcttaacctggaatcaactcctttaatttttacatacagatttggttccgttttttagattaaaatttttacctttgttttcacgtatttgagccctttttttttttttttttttttttgagacagagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccattttagccgggatggtctcgatctccagacctcgtgatccgcccgcctcggcctcccaaagtgctgggattacaggcgtgagccaccgtgcccggccgagccctttttaatagttgccttaaatgtaaaaaaaaaaaaaaaaaaaaaaaaaaaaaaaaacccaagtggtaatctgtcatagataaagtgtttctcatctctcatgtgttttgcctgttgtgtgtaatgagcggtttcgctgtgggtgctcctttcatttctggctaacacattagagtgtgtttatgtaaattgctgtgatacyggtcagcagtcacagccagaaaacataaaacatgtgggcattacacactgacacattagctctttctaaagaagaacatgtcccattctgaaaagaaaattattgctttgtttttgatattgagtctgtattaaaawwttttttttatttttgagacagggtctcactctgttgcccaggctggagtgcagtggtgtgatcatagctcactgcagccttsaactctgggactcaagagttcctcctgcctcagcctcttgagtagctgggactacaggcacatgccaccatgcccagctaatttttctgttttttgtagagacaggatttcgctgtggtgctcaggctggtctccaactcctgggctcaagcaatccgcctgcctcagccttccaaagtgaaaaggttttctctcatttttcaaatagaagtactaaacaatgccagagaaataaataaacaggcaaaatacgttggctatagtttatattatttcctgctasagttaacaaaatgggaaaacattttatcttcatggtctactacatttatgccatgtgttaagtaataaaatagcttttgtaaattataaattaaaaggtacagatttaaaagagaaaatactgtagagtttcatgtaggtaagactgtgtagaatgtcgggtctcgatgttggcgctattcaagccctgatgataaggcttttggcattagatgctgttttgtcttsatggaaaatacagctattctaggatccttgagcctttcataagagataaggttgtgaatcctaagaccctaggaccatttacttagatgatctgctctctggttygtcctctgaaaagtctgcttcgygaggggtgtgctgcatttgccttgcctaagtggtgtggcacacaactgtactgtcaccttaggcttaataaccatgtgtcatctagaatgaagttatattttactaaggatcgtttttgccatgtataacttctcaaacattaactttcagggttattaatccttttaaggtctagtttttcttaagtctgtgcagtaatagaggtatcgtcattcatgtgacataaaagatggaaaggggcttcattcatgttagtgatggaaataggaaagtaggtgaagtgawtctaatagatgtttcttttatgaaataatttttaaaagattctccagccctgcatgatttatgatgaatcattttgtggtctgttagttacttctagagaatagaaagcattgtaggctcagggaaagcaaacattcagaatgaaatccaatagagaaggtaaatttatttgggcatgtacattttggcagcctaggctgtgtacatgtgtacacattctgaacatgtgtgtatattgaaaatcttgtctcttttttattgttaagatttgaaagaagccaacactaaaccacaaatatacaacaaggccattttctcaaacgagagtcagcctttaacggtaagtaaaatcagaatttatactgcatttgtattgaaaartatcccttttaaagaatatgtaaattatacattgtattttattgtaaaatttcctagagagtgatttttgactattataatactttctgctatataattttccagtcagttggactatgcagtgtaacatatttgtctaacacaaaacaaaggtaagataggaaaatgacctagaagttgagaaataactcaaatccttaaaaatgaatctctaattaaagtcttttatattcatgttatttttctacttaagtaataattacattattttagattcttatgatacttttaattaaattgagataaaaattaagatttctttcatggttccctattggccatgcagtcataatctgtggtcacaaaggagaaagtagcttcgtataagccaaatgtgctccattctaggaggaagaattgctaagttatacccggcattaaaactacttccttcctggaactgactagatgggggtaggatttcagaggctccaggggctcccaaagtttcgggatatccaccatggataatttatccttccgaggcctaactatagggttccaagacagttcttagtccccaacttttttgggaaggaaaaggagacctgtcactttaaggttttatgtagttttaggactattgattttggtaaatcatgagctatcacagaatagctcattttcctgaaatctgcaaataaatgaaatccacaacattgaataaagaatcatcagatagatagatacagaaattaatatagagatgtgtatatatgtgggttattatacatatatatgtttgctaactctgtctgcttctagaggacctagaagcagtgactccccagtagcaaactagatcgtggtttccaaatacaggctgagcatcccaaatctgaaaatctgaacttcaaaatgctttcagattccaaactttttgggcatataggtgatgctcaaataaaatactcttggagcattttggattttggatttttggatttgggatgctcaacaagtaagtgttaagcaaatattccaaaatccaaaaaaattcaaaatccgagatatttctggtcccaaacattttggataagagatactcaatctataccatttttccttaaaggaaaccagagctctttggagaagtggttaattctaaggctggggcagggaaaatacaggctgagcctggaggatgttgtggtcagcctgaaagagctcccagtggccaaagctggaacaatttcatcaataaaataactacgtataatattgaattataatctgatttataaataaaatgtatacacatgagtccaaattgatatacataaatgactgaataagtaaataaatggggggagaagaactctttcttgtagaagactttaataaatgtaaaaggaatgagggaaatagaaaattgttgtcacaaagccacagcagtaattgctgcatgcaacttccactaatactaaaattagtgaggtgggccaggcatggtggctcacgcctgtaatcccagaactttgggatgctgaggtgggcggatcatttgaggtcaggagttcgagaccagactggccaacatggtgaaaccccatctctactaaaaatataaaaattagctgggtgtgatggcggatgcccataatcccagctacttgggaggctgaggcatgagaatcagttgaacccaagaggtggaggttgcagtgagctgagatcgcaccactgtactacagcctgagcaacagcaagactccctctcaaaaaattaattaattaattaattaattaattgagtgaaagtttaaggtgaaacagaatatttgcataacctcaaagtatctgcccccacttactcagtaattacaaaaggaaaaatagtaactttacagtggagaatcctgatggacaccaccttaaccacatgatcaaggtcaatatcaaggatagtaagacatagtgagctcataygcccctgatagaatgtcctgaaaaggacagatcatgcctttcgaattcttcccaaacatccttaatctcatttgactatgagaaagctttaacctaaatacaaacacattcttcaaaatatctgaccctcgccgttcaacagtgtcagaggcataaaagacacatctttgctaagraatcactacagattaggaggagaatattgcatgacaaytaaatgcaatgtgggatcctggattggatcctagagctgaaaagggacgttagtaggaaaactggtgaaatccaaatagttatagtattgtgccattctcaatttattaggtctttttttgcttttattattatttttaattaacatataattgtacatatttatgtggtacagtgtgacatttcaatacstgcatacaatgtgtaatgatcaaatcagggtaagtagcatatccatcacctcagacacttatcatttttttgtattgggagcattcaaaatctgctcttctagctattggaaaatatacgataggttgctgttaattatatttaccccacagtgctatagatcattagaactattccttgtatctaactgtagttttgtgtctggtaaccaatctctygctatccccagcccttcccagcctctagtagcaactattctactgtccacttttatgagatcaactttttaaacttcgcatatgagtgagaacatgtggtatctgtctgcttatttcacttaacataatcaccaccaagctcatccatgttgtcatgaatgacaggatttcattctgttttatggctgaatggtattccatcgtgtatgtgagccacattttctttatccattcatctgttgctggaactcaggtggatgctgtatgttggcttcagtgtatcaacactgataattgtgctgggactgcactgtggtaactggggggaagctggctgaaaggtatgtaggaactccctccactatctttgcaacctttctgtaagcctcagattatttcaagttaagtagttttttaaggtcacaatggagtcactaaataatcattctcattagattttcgctaatttatagaggaagattctgcatttgcaaatcttagaacagagtaatgcaggggcattcttttcatcaagactatttcttgagctattttctaatccttctcatacacactcccatccctacctctacaagtctggtctctatttagtgtacttaatactttagccagttgcttacagccctctagaaacctgtgagtgggaataactccacaaagctctgcctcctcgggaaccacatcttagcagtgttttttgttggtgacagtgagggtctaatttgaatgttcacaccagaactgtcaaagtatttcatgcaatactttgaaaaaaatctcttgatccaccaatcatcattacccaagacaggatttgaacaagaatttagaactcgtagtcttatatttgtttgaatgggaagaggagagaagcagaccgtattgtttctaggcaaaatgtctgggaattcagtgaatacaagtagtactacgggaactttcattcttaaaggaaatcaatgacagcattaagttgtctagaaaatcagtttaactttagaaaagcataaagccgtttaaaatcaaaagagcaaactcttaaaagacaaagttaggagcaggtacgtactttggcgtctgaaaatgagcggtctaaattcaagcattttgacatgaaaaatgaaatgtgaagtatttggaattcaaccctgaatttttttgccggtaactcttgtgtatgttcaactaatttagcaaactgcactrgttcacattttttaggtgaaacaagaaataacagaagttgcacctaaagtagtcaaatttcgtagagacagaaagtggaatggtgcttaccaggggctgsggcactggaaaggaacggggagttrgtgtttaatggggacagtttcagttttgcaagatgaaagcatcctggagaatggttacacaacattgtgagtgtacttaatgccattgaatgcacacttaaaatggttaaaatggtaaattttatattgtgtatattttatacagttttaaaaactaaaaaaaaaaagtaacaagtcttcagcagttatattccacttcattgccagggtgtctggctctaaggggaatctctgcttagaggaccattaatccttaggaacctttttttttwwaaaaaatctaaagatggttcctggacatcatttaccaactggcagtttaaatggcctgtgtaccataaattgtgaggttaaaaaaaatctggtacacaggaaacagtagagctgggtggctgggagagttgcttttggggttaatttataactaagacaaatgaatctatgaaaagaagaaaagccccgtaagaaatatgctaactgatggtgagggagaaaagggtttagataaaagatatctgaacttgtttggtctcartgattttatgactgaggaattcaattatagatgtactggatggagcaaatcacaattctgtaaattactaataggacacaacgatctttatcattttctgtatgtgctcacatgcaaagttcagtcctgccctctgtaaataaactctctgcctagctatacccatgctatgaattcagggcttgagtgttgaaacataggcaatgcttactgccccaaccttaaaggcaggtggaactgagattaggaacgaagacaaattacttttgcttttgaattttggccttcgggtttgtttcatttttgttcatttcttttcatttttattactaaaaagctgattttttaaaataaaaagatcacaaccacacaaaaaaactattcttctgtagtttcttccagttttgttcacatgtgtatgctttttatttactgacagttaccgtatatacatcacttggccctcagcctctttcactgttaggtcctataaatttttcatttctacctggctttcagagttttcataatggcaacataatcttagtgatagcacrtaatttrctaagccagtttttaggtggcttctggtgtttttattattgtataattatgttttattcttataccattacataccatgaatatctttatgtaaatatttcactcaattaaaaaaatattttcttcagataaattgccaagagaggaatttctttgttaaagtgtttgagcaattaattaccttactcttgcattattaattttatgacatttcaaattgcttggaggatatattaatagcaaatgaacaaaacatacaaagcataaatatattttggaaatacatttaaatgatttctgttaatttaaatgaattatcatttacttaaggctttgggtgtatgatagtggtgggaggctggagagtgaagcgcttcaatagttgtttagagattagaacgatgtgagtggtttatttttatttttattctttagaggcagggccttcctctgttgctcaggctggagtgcagtggtgcaatcatagctcactgcaacttcaaattcctggactcaagtgaccctcttgcctcagccaccggagtagctgggactacaggcacacaccaccgcacctggctaattgctaaattattttcagagatgaggccttgctatgttgctcagactggtctcaaacgtctggcctcaagcaatcctcctgccttggcctcccaaatggtgtttttttaaaaaacccagcttaatagcaaagaagttacagattatttcctgaggctatgtcaaatttaaataaaatgtaaagactgtgctgtgggtcccttaccacctttaagtctaagttgctagttattaggaagaaatgattgcttttgaaaatgcagatttaacaaagtaggactttcatagagataagttcaaatcagtttttaaaaaatattcatttaaaaccaaatatttttaaatttgtggtttgaatatttgagaaacaaatttaagaataaagatacaataagaattttaagatacaaaactatatgtttacaatatattaaaatgaataggaaaaagattatgggtgaaactctctcctttttattctcaactttctgtttgggggttcagtgtctccttccacagttttctttgcctcaaataaataaagccaattatgagctctacagtctgagttatagyattcttggttctttgggtaccgccaataacttatatatcacaaataatacatatacagtgttacatagtaagtgctcaataattggaagctagttccatggggcaaaaggaaagcaactgtgttctctttcatactgttctagttttttttttcctttaagcttgtgacttcttgttcttcagtccagatcctgtgatctgaaataatttaaattattaaaagttagatatttttaaccttttatactcccactagacaggacataggaaatttagtgaygtaagcatctttaataatccttaaaagtcataagacttggtggctgggacaagaaacaattaggtataaatttcagggaaataccataatggcatgacttttgttttcttttgttaacaagccacatggctttcctctcaagcccaaggaatacatagtgtgctctccttttaagatttcagttttgtctgcatcacagagatgtatgtttccctaagtttgctcactataatttgtgattgctatttttcttatctgcgaaggaagtacagcarctcccactggggaaataccatgttaagttgatcctaaaataagaaatctaagggaaaggtcacatcctaataacttgtgcaaatctaaattcccatggagctttgcaatcattttgtaggagtataaaaaatctattattgaacttcttccagatagcgtcgtaaaattgaagtacttttatatacagaagtaaccactaaattataaatacaattgacaagacctaattttttaagcaatctattatgaatacgtagagaaatctggcatgactaataaaccacaaaatctttcttgtcactttcactggaaatataaagtatattactcatgaagtattgtgataattacatacaatagtaatttcctattactatagagatatttaatactcaatttttactttttttttttttaactgatgctgaccttttagttatactttggaagaaccttaaccatgttgttccagggaaattcactgctttgggagccaggtcactgagttactactgtctttcctcytctgttctttggccatcgtttaagtttccttacctgttaagtaagaaaggtttatgttaaggatcaagtaagatcaaatatataaagggyttagaaataatttacggcgtatatttatggtattactgtaataattgccttgacttttttatcttttccaaatgaataaatcaaaatagaaagaggttgagtaacttactcgagctaacagtcaccggtacacgctaatcagtgccccactcactggtcaaatctaagtaattcttcaagggatggaatgtaaatggaaactgctcccttatgctgcatacagaggtattacattttgcagtaaggattgattgtttcctagcacgtagtaactaacctgttttgaggatgcgttgttagaaatgcatcttggacatttatgtatatatacgtgcatatatatatgtatgtatgtatgcatgtatgtatcgctagaggaatgtgcgtccttgctttcttactacaaattaaagctgaacagaatgtggtgtttgtcttttggtattgtctgaataaataccaatatctactagtatttatttccttgctggtaataatgtgttttcattaatttaagatttataggaacatacttgggtgctcygcctgctagaaactgatctgtagcatgagccatttgttgaaagtacttagatatttctgcatttatttatttctgtttcagaccccacaataactatattactataagaaatataggccagacacagtgggtgggtcacacctgtaatcccaggagtttgggaggccaggtgggtgggttacacctgtaatcccagcagtttgggaggcccaggtgggaggatggcttgaggccaagagttggagaccagcgtaagcaacatagtgagaccctgtctctgcaaaaattaaaataaaaaaattagccaagcatggtggcgcccgccagtaatcccaactactcaggtggctgaagcaggaggatcacttgagcagggaggtcaaggctgcagtgagccataattgcaccactgcactccagcctgagggacagagtgagaccctgtcaaagaaaaagaaaagagaagagaagactaaattgttttttacatgcttatctatgtgatgtgagttcaaagaatctctgcaatgattcaatatctttttaatatttttgtttgggaaaagcattaagctccttcattgtgttaattaattcagttttctcttttatgttatacaccagcatgaaaagtgtgagatgttagaggcccacatcagtaccctaccacatatttaccaggaaaagctgactttatgcttaatggcagcagtcacccctttaaaatgtgtggcctctgtgtccgatggcgtggactcacttcctttaagttcatggccttctgaagatcagctgggctgggatgagtggtggctggcatgtggtggagtgtcttgcttccctctgatacatggaagttataaaaagtctcactaatgaatgttcttaatatatatggggtaactaatttatgcatcagactttggaataaaagtaatagcaacagcaaatgagagtctaagaataattcatttttttgatacacttctgcccccaggtgccaaatgctacagggtggaggcggagggagacagaaaatctttctgtataggaacctactgatcgctgctactataaatttttctaaccattttatttccattgattattgttttagttcaggttttccttattcctcatttgggttattgcagattaactctctgaccaagcaatccatcgtttccatcatcctccagtccatagttatatttcatcccctttcagagagcattacagactctgtggtcggcccagcctacctcttcgatgtcatcacctccacctgctcccacaaatcttatgggtcagacacaccaggctgctcagtgtcctctcacagtgctgagtttatgactgggrtggattgattttcatactattgttgattcaacattttttatagtatacttcttgagaacagagaccrtgttcagggatccctagtgcttaatacaattcctaccaaatattatgcaagtaataaaattgcagtgtcattgaacattttcagatatgcatttatttctactaattaatcttagtagtattagcagccttgactaaatattatttctaaattgatcaacatgcgatgcaaagcatgctacagaattgaattaagaaaagaatttccatgagagatatgcatttacaattttgtagatttaatctttgcatagacttttttgttgcagatactgaaaakgaatccataaaaatacatagatccctttactagccacttttaatttacggatgaggaatattcagttcacagactggctagcgctttttagctttctttagcgtttgaagcagggcttctaagtcacatgaaagactagactagttattggcatttaaattttttggctcctacttgtatgtattatttattaaacaagtagttattgcactacctttatgtatgcagcactgttttagacaaaatagaattgtgacatattccttgctcatggtcttgtttcaaagacaatacctacaactgaaagaattaaataatagagccaggcaatatctgattgaggaaaagcatgcagtaaaagttcagagaagaagatacacgtgcagaactggaatggtcagtagttgcttcatgagatggttgcactgagctgaacccttaagtaaggatgtggatacatgagaaggaagaagctggaaattttaaacatgaggagcttcatggggaaagaatttcaagctatcaaaagatatcaaagattgaggaatttggacttggtctgggaggtattggggatcttgaagatttgggggtagggaagtgatatgacaaaagctgtgtttggaaggcacaagtgaaacagagttgggtttttttgtttgtttgtttgtttgtttttttcagacagggtctcactctgttgctcaggctggagtgcagtggtaccatcttggctcactgcaacctcaacctcccaggctggagtgatcctcccacctcagcctcccaattagctgggactataggcatacaacaccatgcctagctaatttttgtatttttttttaatagaggtggaatctcgctatgttggccagcctggtcttgaactcctgagctcaagccatcctcccacctcagcctcccaaagtgttgagattatgggcgtgagccactgtgcccagctaaaagagagattttgatagcttatatgatttgatgactgaataaaaaataaagaggatgaaaaaagtgaaaaatgaatttttggctgataaatagagaaatggaggtattaaaagaaattgggaagagagactctgtttcaggaggaagagggattagcttgatttttggatttgatgaagatgtgaagttaggtgaccagacctcgattcagattttagaatcagactctttgatttggtgtcattaacattgattgaagaatgttttgaaagctgaggtattaagaaacaacacaaaggtggagtttaaaagaggaagttgagcgtttggagagagtgccatgccaaaggaggggacttttaagaaaaggaagacaacacttagtacttctgtgtacccagccttgtaggaataactttacctgtgtaatcttattttattctcacagtaccatgtaaagtatgaattatcattgtccctatttgacaggtgaattaagtgaagtttattgtggttaaataacttgcctgaatgtcgtgctgctggtgcaaggttaatctggatttaaactgagatctgtctgtctaacccccaagcccacatatttttttaattgaaatgctgcaaaatggtaatgaaaggtcaagaagaataaaaaaaaaaagagtaaggccattagaatgttcaaggagaagatcattgtttaagattataaaagcgtagtggtaggaatatttcagcatttagaaggtaatagtaaattaatggaggaagtgaccctagaccattgctaatttgggcagcgagtaggacagttctcttctgaggcagctgagtcaagtacagcagagaagagtgctcatcagtggagaaggtgggaatagtgttggagaggtctcagaataaacattaagtaatcccagcactttgagaggctaaagcgtgtgaatcacctgaagtcaggagttcaagagcagcctggccaacatggtgaaatcccgtttccactaaaaatacaaaaattagccacgtgtgttggcactcacctgtaatccccgttacttgggaggctgaggcaggaaaatctcttgaacccaggaggtggaggttgtagtgaaccgagatcgtgccactgcactccaggctgggcaacagagcaagactctgtctcaaaagaaaaaaaaaagaatagacattaaaaagacacagacgatgtgagaaaaaagactgttcccaccaagtttagaagaaaggataatgaggttgatgtgcctgctgtgccggggggataagagaaaggtgtcaggcaagaatagatgtataaaagcactagttacaactatactttgaaagtcatattttacctggaagaaatctcaaaaaacaaagactacatggcagttaagtgacccaaatcaagtcactttccctcttcaggcctcagttttcccatatgttagacaggttaaattaggtgagacaaactgatcttttaggaccattctataatactgtgcttaactttctaagcattctggaatggagcagccttgatcttttcacagatacgtcaaccatatagctttatttataaaacgaacatgttgagataactaaaattagagttaatatcttcataggtacaaagaaacttttagaacttaagtccacaagtcagaatttctggatgaattcctttttcctcttattaaaaattgttaagatgtctgattagactagttgtaaattcccttgaaagcaaggatgatatcctgctctctactgtgtcctcagcatcaaggacagtgcctaacacagaacaactaccaatgaatatttatgaaatgaatgaaagtttgaattgcaaaattaaatgccaccaataaagaggctttgtgagcgagcgtggtggctcaagcctgtaattccagcactttgggaggctgaggcgggcggatcacttgagctcaggaggtcaagaccagcctggccaatatggtgagaccccgtctctactaaaaatacaaaacattgtctgggcgcagtggctcacacctgtaatcccaacactgggaggctgaggtgggcagatcgcctgaggtcaggagttcaagaccagcctggccaacatggtaaaaccccgtctctactaaagatacaaaaattagccaggtgtggtggcaggcacctataatcctagctacttgggaggctgaggcaggagaatcacttcaacccaagaggcggaggttgcagtgagccaagatcacgccgttgcactctagcctgggcgacaagagcgagactttgtctctaaataaataaataaataaaagtataaaaaacgagccagtgtcgtggtgtgcacctgtagtcccagatactcgggaggctgaggcaggagaatcgcttgaacccaggaggtggaggttgcagtgagccgagattgcaccactrcactccagcctgggggacagagcaagactctgtctcaaaaawaaataaataaataaataaaggcttagtatagaactcttcccagtcttttttctccactttgattttttttttttttctcaatctcttccatgacaattcagggacacattaattgtgcaaaaggcagtcacttgtctgtattgtctatttttatatcacttaaattggtttttcatttggttgctatgttgacattttatgaaaagggaactaaacttgtgaattgactgacagtggaaatcataggattttcaaaaataagttttgtagttacttaaaaattagtattccagttttcggtcgttcattagtttaaatgttaccaataatattttctttataaaaagaaattatgttttatattgtagaggaaaaatgatttagaaaaacagaaatctatttctgaacaaatttagtgatgctgatgtaagaaaaagaaaaccacaagaagtcatcccaaatttagtaatgcttcctatcttaaacacatgatttcacttgtcttctggctagctaaaggttacaaaatgtcaccataataccttttacttccttatgagttcttgctactccaccccctacccccaaatatggtagatcgagttgtaaaaaccctgaagtatgacaatatagtttattgcacttatagttagaattattctgccaagatgagctgagaaatggaggaaatggatttaaatttacagcagtccagtgatacacaatatgcgttttccagaccactgaaacagcaagccaacttttaactttaatacttcatacagtggaaaagttacagctgtaataaaatcaacagatacatctctggttaatgttctcaaatgagaaaattgactgcaagaacatttgtccaaatacatgtttttatatattttatgctactttccagaatattaacagttttacatagcrctgttttggaagtcactcattgttttcatctttctgattaagaaatagggccaaagttgtacattgcactagtagtagacttttaaagatgtctttgtctctttttcagtactaagcttcaagttcatagattatccttgatctttcctttccctaggtagagatttagagtatttgtttatgtgagatatatataaaaaaaaaggagattttaacaaatgactgtttgattcttgggtagaaactaatactgatcaagaccaaccaagtattcagacaagatcgggcgtgttcagggtggtacggccatagacgacaaccaagtattcaaacattgagtgttcagtggaggctgtacagatatcctgggttttgattcaagatagtgagatagccatcctatgagaatgtgaacttgaaataagattttgattacttttttttcctcctttaaaggtttgttcaattttaactattttttttcaaaatctgcattatcacagtatattttaaaagaatgactaatttactgtgatatatttgggagttaccttgaaagagattatcttgtaatttaaaataccagaggtagagtgaagagtcaggtggtaaaagagaaggagactggatgtttgtacccggtttgcttcttcccctttgttctgctgctggttttattttagctgttctgtttgcctcaccgcaggcagcgtcaccactccggttccaatcttctggacgtagagttttcaaaccatctataaattagcagtctaagtggaactttggcaaatgaggttgccaacaagcattttctttatatttagataatttgagctcatggcctcygggcatttggtaagaagtccagtaaagagaagcctaaagaacagaatctttattatgagtagtcgcctttttccactcagcagtttgattccaagcaccctgagaaaaactagagacatagtctagttggcaggttttttgaagagaatgagaagcccaaaccaaaagataatgaagaccacagcagagaactaccgaggcagctggcgcagatgcttttttggcactgttgagaaaggcttcagacccacagtctgaagagatggagaacccctcctccaggagcaaggaataagaatgacaattgttctgtaggacagttgacttagattcaggaaagttcttcagaaaatatattcagatcacaaaaaaggtgttaaaatcccaggatttttcagccaaggatggcacttgcttctttcagcatcactcatcaagttgaaatttatgagtgtcctttgttatcacaaacaaagcaagcaaactgaacaaatgagaatgcttctttagtatytacatagcactttaaaagctctgttttctttacaaaatgtgtgtatggaaaggtaaaatgggaataaatagtattaaattctgttcttagaacctactgtatagtgattgaacagctaaacagaacgaaaaagcatgcacatcttacagatacagagatcatgactttggtagatgagactaacatgtatgaaggtgtaggaagaakgtttatttttcagtccaaggaagcaattcacaatcaactgttagagaagcagcaaatagcgaagaaaaaattaaagaactagaacagaaaaagtcctacctggagcggrgcgttaaggaagctgagaacaacatccgggagatgctgatggcacgaagggcccagtagggagcctctctgggaagctcttcctcctgcccctctcattcctggtgggggcagaggagtctctgcagggaaacagcttctcctctgccctgatggatgctttatttggatggcctggcaacgtcacattttctgcatcaccctgagccccatttgcttcccagccctggagtttttaccctggctttgcctgccacctctgcccaggacactcttccctcttggggtgtgtgatgaactcccaggagaggaaagatgggagccagggcaagataggaagctctgcctgagctttccactaggcacrccagccagaccaataaaaagcatctgtcccactctgctaagcctgcttttcttgagcagagggtgagagaggcagtggccatctccacctcagctcctgctccctctgcatcagagcccttcctttcttgggggatgggctcttgccctcttctcttttcccttcctgtatctttgactaacgcctcagctttcaggcctacatgtagcagacagaagaggaagaaagaacagacgttcacagctgaatctcagtgaacagaatagcagtccctggatggcagtctgcctaaagattcctttccctgccttctcccatacattccaaaaggaagttcaacagtcagcagcacctccaagactgtctccttttggccaatatcataagatggacgccgtaatcctgaggcctcctagaggctgagggggcaatggtgtgctccagctggctcatcccagcccaggtgggccaattattcaattttcaagaattttgttgcaagccagttgttaaacacagccattataattatgtaaatttgcaaattatgttaaaaacaaggacaataaatactcaaaatgcaaaaaaaaaaaaaaaaacctactgcatagtgtaatagtgctctcacttttctctccttgattctgatgtcaatcactcattgtcacctccactagagggggataaaaaggataataggaaatcagaatattttgatttgtagttcaactgttgatcaattatctttgagacttttaacattcatgactaaggaggattaataattaacatgagctgtagaattaaggtttgtrtggcatgataagtataaaccagttttgggaccgctataattctaaaaaagcaggtagactagatgattagttgtacacttattactgctaattcttgattgtagaacaaattttcctatgaaaaccatgttgtgtattttatatctctattagttcgttaaaagtttagcagttttagatgtcsaaccagtaaaaaacaagttgcccattctatcatttttttttattgtggtaaaatatatttaagataaaatttacgattttaaccatcttaagtgtacattggtacagtggcattggttacgttcacaatgttgtacaactgtcatccctatctatttccaaagctttttcatcacccaaacagctctatacccactaaacaacaactccacatcacccactccccagccctggttatctctgttctactttctgtctctatgaattcggatattccagttgtttcatataagtggactcatataatatttgtcctttttgtatggcttatttcatttagcacagtgtcttcaaggtgcatccatgttgtagcatgtatcagaatgccattcctttttatggctgagtaatattcccttgcatggatatataccacattgtgtttctccattcatctactgatggatacttgggttgtttttgccttttgctattgcagataatgcttcagtaaacattggtgttcaagtatctgttttagtccccrcttttagttcttttgggtatatacccaggagtgaaatgctgggtcacatggtaattctgttttgctttttaagcaactgccaaactgcttttcacagctgctataccattctgcattcccactgcaatatatatgggttctaatatctctacattgctacaacaccttttttwaaaaaaaaaaaaaaaaaaaaagctgtcctattaggtgtcaagtgttatctcattgtggttttgatttgcattttcctaatggctgctgatgttaagcatcttttcatgtgcttattggtcatttgtatgggttctttggagaaatgtgtattcaagacttttgtccatttttaaattgggttgtttgccttttgcctttctattcttctctcacttttaaattgattttctcccatatttctccacaaagtcaaaaagatgatttcatttgaacacagataaatgctgtcagccttccattgccatatacattgaattaaggtcaaatgctttttgtgctgttgctaaaatcacttgagaatctgtctctcttcaactgaaagaattgttctggatgcgttgatgctgtggaattccttgtactctctcccaaatctcatttaacaagctcacatttagggtgtgattcactgtgaagtattccagaaaataaaatccattttctcagaatgatgagaaattttacaccttgaagagaccatctcttttccaaactgagatccacagattcttggagatccacaratatattcttgggctctgagagttttagaattttaaaataatctgtttttatatcaataatctaaaaggtcattagaaagcccacatttcacaatacaaggacattttcctggaatgagactgttttcttacattagtaagatggaagtgacttgcctaagataacacagcaagttaaaaccaacactaaaactcatctttggaagcttttctcagtgttctttgttactagtgtggagatcttgcaatgattctgtcttcattaagtctacaggtagtggggaaagcagaaaaagaacaagtattaactaaaatgatgagtgctgtaagggagagaaatggcagtatgagttgtgtagaatgagagcagttgcataggatgagttaagttactgtgagagtttgaggaggtggtttttatgccgatagttgaagagtgaattggagttaccttaagggggttgtgagaagaaccatgttacagatggaggaaatragatgtgaaggctgtgatgtgggaaacagcttagtttactccctgatttaaatggagaaaaggaatccagtgaggcttcagagagaagcaagaactaggttattcagggtttaagacaatcaaaagtcaaaatagagtttaaacaggggagtgacataacctgatttgcatcatgctggctgtagtatgcagaattgattggagaggcaagratggcagacaggacgccaggtgggaagctatggaaaggtgcatatggaagaagagagtgtctttggattccagttggtaagtggaagagactgaagcatgtggctgaatgtaaatgtttaataagtagaattaaaaggacatggcgattggtttgatggggatgtctgggccttcaattatgactccctgtttttggcaatgatcagctgggagattggtggcagcatttactaagacagggctcattgaaggaggaccagttttagggaatagaggatgaatggagtttttaacctgttgagtttcagttgcctgtgagatatttcaatggagttaccaaatagatatttctatgtagtgtcaaggttcagactagaggactgaggcagagatataaatttggtcttaatatatccatagtgcttgaaactatatgtgtggagatagttatatactaatggttgtcaaattaagcattttttccaattcctttcccagaatctagtcatgtgaaatgatgaggaactggaatgtacagtgtatacattgttcttggcaaaactaaatttaaatttctgcttaacctaatcaaccaaaaagccctttttatttctgcctgtgtaaaatctttcttcaacatattaagccatttttctgtcttggtaaatatgatagggtgaaataaaatttaaattgaatttagatagccctgaattgatgattcaagaacttttagaatcttagttttatttttgagtagcaaataacattatactgtagatataaaaaatgttgaagattatcccaggragtgctctggaagctgcttttaaaaataaataacttttaaactgccttttctcccttagcatttgcccatttgttctaaaggtagaagaacaactttcagtgtgttaagggtttttaatagttaatcacagttatatggcatttgtttttgtttaatatgtggatttttatgtaatgccacccagaggcctaggtatatcagtacattcctcagcattattaatgtcatccaaatagattgtctttgattactgatcactgactccatatatagggcagtgatttcaaaattattctactaccattgcaagtagacatgtatacagtaaagaaccatccaaaggccaggagcagtgactcaggcctatagtcccagcactttgggagaccaaggtgggaggatcgtttgagcccaggagttcaagactagcctgggaaacatagtgagaccccatctctacaaaaaattttaaaaattggctgggcatggtgggatgcatacttgtagtcccagctacttgggaggctgagggaggatcgcttgagcccgggaggtccaggctccagtgagccatgttcacaccactgcactccaacctaggcaacagagtgagatcctgtctctaaaaataaaaattctgaaaagttacatctaaattaggtttgagtaaatgaagtcatgagccaactgcataggtgatctttctagtggtagcaataccaaagtgggccttgtaaaaacaaacaaacaaacaaacaaaaacacccttttaaatgtagttcagggagaaggaagctagtatttcaacttactgtatgccaagcacttctaagtgctttacattattctctttaatattatttcttatattcatcaccacaatcctcatttacaactgaggaaacagaaggaggttaaatagctttgcccaaagttacaccactggcatgtggtaatgtagggcttccagcttgagtatatctaattttatagccatcattctttctctttccatctctgtatctctctgggagtcaggagacctatattcctgtgtttttgttgttgtcgttttgagacagagtctcactctgttgctcaggctggagtgcagtggtgccatcgtggctcactgcaacctcaacctaccgggctcgagtgatcctcagctgtgccatctcgctatggaaccttggctaagccacgttctgagctatggtaaagcacagtaataggttcacattcactctcccccatcatgcttatgccccctacctcgtctagaaggctccacacttcctttctgtgtgctcgttcattcagtcgtcagtcatttcgtcagttagtcagacaacagactttgttcatacgacattagtgactgaggttctgttgagtgacgcagataggaaataacctagctgcatggttgctgtctttcaaaaggccgtactcttaggatccacatacaggcccccatcttcygtgaagccattgtccccagccatcccattttgacgagtttttttgagtccctgtgaaactttggcttttttacatttatctggcagttaactaggtgctgctttgtgacagttcttctattattggatgcaattcttaattcaaatcatgtatcattacttaacttttcacctctttgcagcttctttctcccagaagattacaagttccttaagagcaggcttatacttctttgtataatatttcccacagtgtctcttaaatagcaaagttttttgacctgatttactaaaaaaaagtttgttgacttggcttaaattttattttcttttctttttttctttttttttttytttgagacagagtcttgctctgtgaccctggctggagtgcagtggtacgattttggctcactgcaacctctgcctcccgggttcaaacaattctcgtgcctcagtctcccaagtagccaggattacaggtgcccaccaccatgcccaaccaatttttatatttttagtagagatgggttttcgccatgttgtccaggctggtctcgaactcytgacctcaagtggtccaccctcctcggcctcccaaagtgttgggattacaggtgtggaagccaccgtgcctggctgacttgggttaaatttttaagtttagagtttactccctggttgaatgatttgggccaagttacatagcttctgtgaacctcctcagttttcaacaaaatgggaataattcctacttctcaagatgaaatatataatatatgcaaaagtgctctgtgaactctaaaagactatacaaatattactgattattttatactttttagtcaaagcccccctgtcctgcattgttccagtagacactttatgtaccaacatgtacttcagctgttcacattatatacttttatctctgttatcctaccatctaggtcaatacattttaacatctttatttgctgtaagtttatttctaattttttattctttattttgtttattcccrtacttaacttttacttacgactacggatttaagtagcatgaactgtcttcagactggcctcctgtgatgagtcacaaggcccatcataatggatccagattgcaaaattgggagtaatagaaattactgttaattttcttgtaaggtagtttaatgcatttacttgcagtttcagatgggtagaaatggtacgttgttaggaattcactattgagatgatttttagtctgtattagagctctgaatactctgcaaataatatgtgagcactggtaccatcaaagcatgtgttgccttaggtggtgtttacagaccttgtcagagttggtastaattccagaatataatcatttcaatagctaaggcttatggttaagacttccaaagtgttcagaatttactaaattgaattatttgaggttttgttactgtgttacttgtagtcatcaaatcaagctttattttactgccttcattgaaataagcagttttgaccatttaaaaatatttttaataggatacttattttctctagcatttttagagtgtggttcctgtgtggtgaatgtctgtcacctcttggaagccttgaaatacacaaattgactattgttgtttatgttgaaagatattaaaatgagatttgtaattgaaacgggcattacttatttcacatctggttgcttgaaaagtggccagatgcaacaattcttaatgcaagagagcctacggcaaaaactttgcaattctcaccctctacaaaacagctgccctgtgtgaaccttcagtggaaaaagaagaagaaaagcaaagcaaagaaaattcaccccaccacgttctaattacagatttccaataaaagtattaatatgattcctacatcaatgagctaatcattagaagtagaaggcaatgtggggaaaaaaaaamaaaacaagaatggcagcactgacctagtttctagttgccaggaccaaagacgtcgtgacaccactgtcctttctaaatctccttaccttgcttaatcttaaagtgatggtatgtcctggtttgcctgacagtcctggtttatgcctgttgtcctagtgtgattttttgatagtgccctctttcactcttaaaagtgtcccagtttgggtaaggaggtatatgcccatcttaatttaatctctttatctcagagacattaattaggaagggtaagaagtgggagttatgagaatgtatcaaagggaaaatgatactccagttgagacagtgctggaaccaaaatgctgctgatctgaattctccgtaataagatgagaattggtttgcgaacacattctaaacatcacaagatacatcagattaatgctggttgctcttggggagttgtggggaggaggataaccaggtcaggagtttgtggtatcttttatgcaacactaacgttaagcttcctgtctgaggttttccatgttgtgagttttcacctcttgatactctttgaggactagtgatgctgacatctactagaaacacttcagagaaaaaaaaagatggaagataatagttctttagaaaaatggaaacatttacattattcttgataactttgttcttctttgaaaaagattagctgaacatccctgctgattaccttaataatctactctgaaattaattttatctactctagaaggtttgctgtggatagattctcctttagagtcctccagatttgatagctattattttttaataatagttaagtgcctttattttgtttaaagtactgaaaactgaatcaggtctcaggaactagttatgagcaactgattatttagctgggaaaagaaggtaaggaagaagaatatttgaacaaaggcctttaggtttttataaagacattatgcaaagagtgataaccatctttcttacaacctcttctcaaagtaaagcaagggggctgagcttcttgtggacatttaagtttgaatagggtactctcctgaaggcctttaaaaatacagtagcttgtctgtttggagtttagcaatcaatcaatcaagtcttgaacacctaatgctgcgctaagaattataaatgaactagaaggcatactcttttcatgtcttcaaatgacttaataatatacttggggaaataaaacaaatatacgtgaaacagatcaggtctaaattatgtggtattgactctatgagttactaggatgaattggcattcaaagagcatttaatttgtgccaaccaatagaaatatctcattgtgttacagcataagaaagatcaggaagccagaaacaagtcttagtggatggcagaaaataagaatatatacattcatttctacactaatgcatctattcagtatttcttgaggacttactgtatactataggcacataggagtgagtaggtacattgttctgagtagaacttatgtgttaggaaatagggaacaaaaaagtgggaggacaggtgggtgtgtgggcagagtatagcaataatattgttaacctatgcaaaggttaggctgattctgaatagagcaagagtttataatggaagattccttttaacacttaaaattcatgaaacgaagagctcaaagaaaatcttagaagccatctaatctactctcctttccctatctccacttgaaaaatggggacttaagagcagagctgttgcgacttgcctgaattcataaaccgagttagtggcggagctgaaagtcgagcctggctcttctgtttttaccatttgcagttgctcccacccctgcccccattcatgggttccacatccatggattcaaccaactatggatcaaaagtattttttaaaaataaataaaaatagcaatacaataattaaaaatagaaaatgtaaaatacggtataaacaactatttacatagcattacattgtrttagttattatacataatctagagatgatttaaagtatatgggagaatgtgcataggttatgttcaaatactatgctattttagattagggacttgagcatcttggatttttgtatccacaacgtcctggaaccaatccttcatgaatamggaaggacaaataaatatatccttctgcctcttcagtcttaaagttagctaaaacatttcacttccccatgccaactctgtgaataccagatcttagatcctaaactaaaggtttggaaggcaatcattattcaggcataggtaggaaagtatgacttagaaaatgaatctgtttcgtgtctcaattttaataaaagtcttgtttataaaatgatgaaaggctcaatgagattaacaacatacaacttgtaataaatgttttgtaaccatgacactgatgagctgtgttttagacctagctgtcactaattggctgtgtgatttttgcacaaattatgtctcctcttttgtctttatttatattatgacagaatttaaattgtttcagttattttattactatatagatatctctctcttaaaattgcttgagtacagcacagacttcaaggaaaaaatttcttatgattctcagtgttcacataatttgtattaaatgtaacttaaatatgtgtaaaacaagttgtaaactatgtttatagctcttatatatttacacaaccaaaataaattttaaaataagttgtaaagcccttaacattaaaggtacaaatatggaaattactgctatagcatatacttttggggattcaacaccttttgctgcttaatgccatatctgattaaatttttccaagacttttttctttttcaactcttctgtgaaacattcctttctacagtattactggatctagtttgaacttcagttaactcagatgaatcatttacatattaaaagtttacctttgttcttctttcactaaccttagacaactaaagttgtgatattgggcaccagtgaaatcacaggtagaaactgtggcactgaaactgcttgtctgtattcagttataaaatcatacatataatctaaaatatgaattcttatacattttatgtcattaaaattaaggtaaaattgaaaacagagttaaaaacttttcctcagaaatcggaaacaatctaaatgtccatcagctgaatggatagacaaaatgtgctgtatcaatacacagcctaatctaggcagttcagcagtaaacaggcatgaactgctgacacatgccacaacctgaacctccagactcaacctcggaacctccaaaacattatgctaagtgaaaaaaaaccaaacacatgagaccatatatcatatgattccatttatctgaaatgtctaataaaagaagcaaatctatagaggcagaaaagtataatagattaacagttgtctgggattgggggtagtaattggcgtttgattgtaaatcagcatgacagatcttactaggtgatgaaaatgttctaaaactgatttatggtgatggttgcaaagcttggtaaatttactaaaattcgttgaattgcacattcaaaatggtgaactttatgctatgtaaaatatgcatcaataacgctgttttaaaagctttttatgaagacttctagatctcctaagaatatttaggtatcagatattttcgcccttgacccttccaaggtcagaagacacagctgaaaaaatacttttagtggaaccaaagaatggatccagtaactacagtatcgtggattctagctttgactttgtcactgactgyacttgggcaaggcctgggcaagtcacttaacctctttttgctttggtttccccatctgtaaagagggtgttagtttaaatgttctccaggatttcttgcacacatgagagtcgcatcctcacatttctgttatctgtgaatctctacctcctaatgattccccctccctcaaatactctaacaaagcccctttattcagcatggcatatgtggcatattgcttgtctgactaattcttgctcacrcaagcttcctgaccttactgcataggtctttcaggtacacagttctcaaagtgttgatctgaaagttccgtacaagactggctccccatcactcattaatctcccagaggctaccttctcatcctatgtaactctcttatggaagctctcccatagataacaatatacttccccttcaggcagtacatggaagaaacaatgggctatacaatggaaccatcctatgagattacacagaatgagaacctggcccattgttttctcctgctgcctaaggaaggagttgtgctctttggatccctgtacagattttggcttgtccacctccctgaattcccaagtaacaattaagcaatctgcctccttccgtcttctcatttcaatgtgtaggatatttgtcaacttgcccagagttgctgtaggcattttgagctattcatctgactgtgtgcaatagataacaaaaatataattaggaggaggactgaattaagtctgaattttatttttatttttattgcgggggagaggtgcttactttagagtggtaaaagttacttcttgtccaagttttcatcatcccctccttccctctgtgtttcaataaaatgtttccaaagtttcaaataaaaagtttattaaaatagaggccgtgtttttaaaaataaaaatgtaacatcttacttcctagaggtatctgaagaaaagcactccaggagtataaagaataaactagatggttggaatgtggtttattagtccacaaacctgtcaggaatcttggactcttttcctaaagctatgcagacatacaacataactttggaagaaccagttaagtttgtattctaactatgccctgtaatttaggaataactacctgctaaacactgaaaatctgttggtggaaatcatcgggtaaaaccaaagcataagttatattattaggggttggtaagtggttttgtatatgcaataaaaaggattagatggctgggcgtggtggctcacacctataatcccagcactttgggaggccaaggcgggcggatcacaaggtcaggagttcaagaccagtctggccaatatggtgaaacctagtgtctactaaaaatgcaaaaattagccaggcatggtggcacatgcctgtagtcccagctacttgggaggctgaggcagaagaatcgcttgaacctgggaggtggaggttgcagtgagctgagatcacgccactgcactccagcctgggcaacagagcgagactccgtctcaaaaaaaaaaaaagattagatatttgaagaaccatgggatgggtgtcccgttaactgtccatagggccaaggaaaatggagaaagatgaatttgaaataaaattctctaaaaatagctgaaaaagaaaaacttagatatgtaagtgttttatgatgtgaacattcaatgaacagaggaaagagatgtgcctaggaatgtttggtgttgaagatatttacctttttaataaaagagaacaaattaaacaagcagtcttcctttcttgtaggaactgtatttcagggtaattacatggctttagttgctgaaggaaagatcttccttatagaaaaatgcctgctgtctgggtacagtggctcatgcctgtaatcccagaactttgggaggccaaggtggacagatcacttgatcccagaaattcaacaccagccttggcaacatggtgaaaccccatctctacaaaaacatacaaaagttagttgggcattgtggcacgcgcctgtggtctcagctactcaggaggctgaggtaggaggatcgcttgagcctgggagtcagaggttgcggtgagctatgatcgcrctgctgcactccagcctgggtaacagagcaagaccctgtctcaaaaaaagaaaaaaaatttcctactaataaatgtggaaagagtggtggaattagaaaaacatttcataaactccaagtattgattcaggaaaagatgataaagtttgttacacctttaggtgaatgattaatgaaactgaacatccttgtaataccaaagtaacattgcactgatgactgtctaattgaaggagaaaaagtaactgtacaatggagagatgagacatatcaccattctaacttagtggtagattttaccatggctgatggtcagtcatatattttgccttctgatgtgatggaataggaagtacacatcccctatggtatattcaagcctaaaatgtttaacttgaatccagaaatccttggatatagtgtccagtttataagaaacacaggggatrgagaatcaagctaaatgatacaacaagaaaacaaccagacaaattcagaggttgagacattctatctgataactggcctgacctcttcaattagtcagtggccttaaaattaaggggaaggagtagtcatgctagatttaaaacagcttaggaacatacagccaaatgcatttcatcatactggattagattagggttggagcaaaccaactataaagaacatttggggtcagctggggaaatgtgactatgggctgggtattgtttgaaatgaaaatgtaattaaatgaaaagatggagattattgacttgaaaaagcagaggactaccaggaagtaccatatctcattttgattaaaaaatacacatgctgtatgtatgtgtatatgtgtatgtgcttatgtatctgtatatacatatgatcatacatatgcccagaaaaagacccagatgcataaactttaagagttcaacattggttatatctggtagtggaagtataatcattttgtttttaccagtctgtattttctaatttttaacaatgaacgcggattggttctataataatgaaaggtggttttttttttttaaacaaaaaaacccctaccttttcagatagaaaagcagcagtgtattctttccttcaaggaaaatgaaaatgtttccttggaggaaagaagatataaagactagaaaacactctagtatctttaaaaaccaccaagctttcaaatacaaagatttaacatatgtaaactgtattgtacttcatttgaaattcagtatctttactaaagagatttcttttatcctatcctacacacrtacagtattatttaatgatgtgcacacagaactctgccagcctgaaacagtaggtctaagacacgtttgttgtttttggctcccctgtgttgatctaaatcactgcctagtagcccttggaaatttctatcccaaaacgtcccacaggtgcccaataccatggattctcattccccaagttcattctcactcttctctcttggttgagtcttgcctttcttcactctgttccctttccttgttcctgccatccaaagcttctctgtctttcaggctcatctcagatttcctctctttcctgaaggctttttggattccttccatctccatgcacagtcagaagggctctgttcatctctgaatatctttcgcactccattgcatctggtttaaatcccttctctgcctcttattagctatgtgatctcaaaactcaatttctttatctgtaaaatggtgataataaatgacttcgcagggttgagggcctcaagtcagtggcgagtactgcagtagaggcagaatacatagctcaacagaaattactctagtaatggtcatgattgtttgcacttctctcaaaccacctactcgtatattagagtgcattgtgcttgtcttatcctctttactaaaagtaggaaaatggcttgagaattgatgctcagtcttatttatattattctatccctagttatgtgatacttaactgtattgctcggtatttagcagcccattatctaatcatwacatcaccctcattctttctgagcttgtttcctttttgtgaaatggggctaccattcaatctcacmgaattttttttttttttttttgagacagaatcttgctctatcacccaggctggagtgcagtggggcaaactcggctcactacaacctctgcctcccaagttcaagtacttatcgtgcctcagcctcctgagtacctgggaatacaagcatgtgccatcacacccagctcatttttgtatttttggtagagacagggtttcgccatgttggccaggctggtctcaaactcctgacctcaggtgatccacccacctcggcttcccaaagtcctgggattacaggtgtgagccaccacgcccagccaatctcacagaatttttataaagtctagacaaatttttattttaaaagacttagcacagcccctgacagcgtaggcactcaataaatgtggaatctgaatcttacttaaagctagtttatattttcaagtcttcttacttttactaatgctgctttaagatatattctrtaagttcaaatgtaaagttctagattgggaaagaatttataatgtgtctaataaagattgttagagacaaacttttagactgaaccaatctactattaatggactgatgaatcttaccggaaaataaacataaaatatactctgtgttgcctgtggtttaattgccatcaaaattaagtttattatgtactgatttcacagttacattttattttcagtcaaatatctatttgttggtgtgaagaaaatatgtctacttccgctaagtgaactttaaaaatttgtacttgcttttgaagattccatactctatataccgtctcttcctgaagcgtatttatgtagctcctgttaacataagagcgataagagtgttgcttgatgactgctcttattgctttattaaagtgtcatgtaagatttaaatatttgattataagaattcataatataattttgaaagcctactctgttccagacgctgatttatttaaatcatctctaattctyacaactccgaaaagataagaaaacagagatgtgacaaggcttgaatgcaaacccaggtctgtttgactctttgttcattttgaataaagacaaattactcaaagctttactgccaaaaactattatctggttccacattgaaaccctattcaatagttgttattattttcttcttttgctttgaataacctcccagcattgttgtgagtttcaaacgaaataaaaacactatacagatccaaggtgtttttttttagagtattgttacctcaaagtagaaattttcaaatagtaatgttatcattttcttaagagcaaggaactttgtcaatagaaacaaaaacatcataccagaagaaccccagaatgctgggatgactcatgaagaatctgtgaatgaggcaagagaacattcgtcagcaaaatgactccgtgaactgatgttcaaatattatcaaattttaattaccgagtcataattgagtacttactttgtagagagcaccatatctaaaccctgtggtgaatgatgacattttcataggtaattcctccacattaagtgattcatcatagaaaaatgctttcatgctgatgacttccaccatgactgttggcattaaggatcattgacctgaagaactgatttgaacgtcttactgcatcattttaatgagatagagcatcgtttggagctttggactgggaatcaagaaacctggtttctagctcaaactctgctgctaatttatctaggtcatgctttgggcaaatcatttcattcctctggaacccattttccttatatcaaaaattaagagttggaatatgctaatctccctcctattaagtttcgtgagcccgtgatttcaacagtacgtaaatttcctttagtacagtcacagaactggtaagtgacaccagctgaaactgagtgcagctcygcggctctacgcttgctgtagaacctttgtgaattcccactgtgcttcaccagtgacaggatgtgctacccaataaatctccatataactgatcttgaaaaattcattgataaaatctgaaaactgaaaaagatacatgttttagaggtttaggtttcccacaacatgaaaatgtgtcagttgataatatagttcatggtattttactatgctagaaaacagcttactagagaatttcagatattacatgcaacgacaagttaacatagtttaggtgggacgtctttggttcaaagttacagtaatttcaaaagtgtttagttgatccctagaaagtggttaaacaggttagtctctttttcaggtattagagggaagttaacttttgaagctgggcagaaaaggaagttttcagttggttttttccttttgagacttttaatttatcatcagacactattttttcagatgaaagtgccttttatactgtcacctaggtatgagtcaagtatgaaaaggaaatagtaactcaggatcagaacatgaataagtatgcaatatggagaatttccattaaattttaaataaatgaattacagtcatattattcagtatctcaacattaaaactcaaaaagaccttaaggattattctgttttgtggaaagggctttttctgattctagagatgagaaatgtggacccaaagagttgacacagtaggtttgtggctgagccaagacaaaaacgtaaaacctaggctttctggctccaatgtcagtgttcttttctactgcttctgagttaagaagacctttttttttttgataccaaagatacatttactggagttattggcttctttttttttaagacagggtctcactctgtcacccaggctagagtgcagtgatgcgattacagctcactgcagcctcggtctcctgggctcaagcatccctcctgcctcagcctctcaagtagctgacactacaggtacatgccaccatgcctggccaattattttatttttttatagaggcagggtctcactctgttgcccaggctggtctccaactcctgggctcaagggatcctcttgccttagccacccaaagtgctgggattrcaggtgtgagccattgcacctagcagcattattttcctttaaatcaaaataatataattgtttaatataattatgtccataaaatatattacttttgaaaatctgaacaaaattacagtttttggttaaagaagaatggatttgcctttcaaaaaaatgatacacgagagactgaggcaggagaatttcttgaatctgggaggtggaggtaggttgcaatgagcctagattgtgccactgcactccagcctgagggacagagtgagaccctgtctcaaaaaaaaaaagacacagctgagtgtggtggcgagcaactgaaatcctagctgctctggaggctgaggcaggggggtcacttgagcccaggagttggagactagcctgggcaacatagcaagaccccggtcaaaaatttttttaatttaaaaaattttccaaaaggggcacagatacattgaacattgaccttcctttgtctgcttttatgggactatccggcttgttgtgatggttgtggtgaaatttacatccaggatacaggattatttgttcttctcaaaggagtgtcccattggcccagcatttctctcatgttgtctctcccctgggactatgaagaaaccctgaactgatgcaaccaccacttgaaaataaagttccaagccaatctgaattgcactaggaaaaggcagccattcttttgggtagggggagaagtgagcttggctggtcattctggttgttagcaattatctggcttccgtgggagcatcatccagaaatttacatcttattgaaacaagaagaaaatggatgctattatcagttcgttaggtctctaaactccttcttgaatgatacatgtgatatggatgtgctgttctttcattactctcatcatcarcaaaaacaatatgtgtgttttaatgccaaccagggactctgctaggttctagggatgcaatgagatctaaatgcttaaccttttagaagctagcataaatgttagtagcacttacagcattaaatgaagcagatttttaaatgaggttatagcaaaagaaaaaaatactgtacatacaattttataccaatactaacatagcttatttcacacaaaagaaaaagctatttaagcaattttaaaaattcatattcattctagagaataaattccaaatttatagcaaaaaaagagtgaagttttcattagctttcaagaataatgcaggctccaaagtatttaatattctatattatgggaatattttatgtaagtcatcccaacaccaagtaatgctaaaaataactttatataggttcaataccatgattttattaactatagatttttagaccttttcttactttttgttattgaatcattcacagcttttattggttgaattgccttctcctaaaagtaccaaagtgtgaagagtttttatggctgagtaatattcagattcttgtagccaaagacaggttctgtgaagtaatattgaagactaaatgttgaagagtagctttctctaataccaagcggtcaattttttcaaatatcatgaactggggtagagttaagttttcatcctcctcattatagaatcattcctcattatccccattctttctcctgctgaggatgtggtggtgtactcaaagtcacatccatacccttctgtctccaaagtcctaggagagatggccctcttctcaacctctrcattgcacagaaccttacatccctcaacagaaggagtacatagtgcataaggaaagtggtcttttaccactcctcctcactctgtaacattaccaaggactatcctgcaaggggaccatccataggatgaatagcaatagactgctgcattgacgtgcaaagtgctgacaacccattggtgtacaaagcaccctaagcaagatctaaagttctaagatcttatcatgtaaatcaccagcatgctgttttatgtatcttattgtaatatccttccaatcagtattataaagggcaggacactgggggaatcttaaggctttgaagatagggatagtcacgtgcatgtcttataaattctctgatgatcatatactgtttactggtagtaatgactgtacttaaacaaatatattgtttctcatatcattgcatgccaattgaccttcaagtttaagccaatgaaaagatcactcttttaagtatatttggataattttgatatagttacatgtgaactcattaagtatagaaaccttggcttattatttaccacctaagcctaggtcagtacctggtgcttagtaggtatttgatgaatgatgggatgaataaatgtggaaataagtcttttcagtatctaaagacaaaacagatacataataagatacaaatgagattggctcatctatctttattttcattcatttgaatgtccatgtaagcaagttatttcttaagtgacccagcactgcagtgcaactatcattaacataaaatatgattaaataatccacattgtataactgttttgttagtaatgtagggatgctttgcgtgttgcttggtttgtgtatgctgccaaaagtgtaagcaacatttactgagctgctatgtggcaggccctgtgtttattaaaattgtagtttttgctaattgactgttttttgacacatccgtcttgttcatcattgtctacctagcacctagctttaggcttgccacatattatattggcaatgaatatttgttgaacaaacaaatgcatgaaatgtaatgagtaagacaggttttygctttcaagtaaaacatagtctgggggaagacggaatgtcagaatgtggtgggtgctataggagtaggtgttatcagattctgatgctatggaataataaattgttaaaatatgtaatcttatgtttcagaagctaaagcacagtatgggaactattagaggcttagaaggcctcactacccactagactcagaagttgaatagtgtctgagaaaaaagagaatagaagtaacagtagatgaagagtccagaagtgagaccctttgaggacatgaggacaggtggaaggactgcatctgtgtgttgccaaagagtaacagagactggtataggacttgagttcaattcagtcatatccttaagtattgtgccatcrtgtctggattactttgtagtataagtaaatttccaagcatggggaggaaaggagaagctcctttattgagaattcaactgaatatagagaaaactaattttacacaactgtaatcactgtagtcatttggacaaattagcaaacccaagttttgctttaacttggattgccttaataaagatgttttggggcttaatggcacagttgctcaactcccccactttaktccrtgatgttcagacccagccagcatttccccatcaggctcttgcaccatgattgacagggacacttttactagtccccttgaagaatgaatagttactcaatggagattaaccagatatatatttattttactcagaatatcacgataagtataattcagagaattattgccttctaatatactgccctgtgtgggggcgtctttgaaagtccgcaaagtcactgcaattctaataggccactcatgtgacaagacctgctcccacatcggtaatttggcacagctagtatttctccttgccaaaaagggcaaaggccttgagcaagaagccagctttttcctgattacaaaactgaccacaattcctcgccaacctaacagcgtaagtctatttttttctggtggtgtgttattcttctcatagagaactccattttttcattatgacatagcacttatygtttaaacatcaattgatgttcaracatcagctggtgtaacattgctgcagttgctattgatggataagctgaagtttttaagaaagcaaacccgatgtataaaattgaaaccatatcaaacccttcttcattctctcagctatttaattttacagaatttagatagcagtcagtatcattttgggcttcacaaatcagtagagtaagtaccttaggaatataacatttcagtagcatgctgataccaacgtttaaactatggatacatatttgaattccaaatttttcttcaaataatgtgattagagattcaaccaggaatagacaccgaaagaaaactttgcccaaataagctttctggtatttcataagcaagagatttaagttttccatttaagaagcaattgtgaattttacaacaataaaaaatgcaagtggatattgaacagtctctgctctgataattctaaatacagtacagttcacgcccctcacaagacactgaacatgtgggtcaccggcgagacagtgtggcaatattttccctgtaatgtaccaagtcttgccaaagcagtgaacattatgacacaactttttgtcacagctggctcctaataggacagtgccagccaattcaagcccagtcctttctgtgtttattcccatctctcccaaatatttggaaactgatgtcttgactcatgggtgtattcacaaattctgttacttcaagtctttttcttttaacggattgatcttttgctagatagagacaaaatatcagtgtgaattacagcaaacccctattccatgctgttatgggtgaaactctgggagattctcctattgacscagaaagcgattccttcactgatacactgtctgcaaacatatcacaaggtaaagttccttccagatacggctattggggacgtgggggcatttatgtaagggtaaaattgctcttgtagtttgtcttccaggttgtgtttgttttaatactatcatgtgtacactccagtattttaatgcttagctcgttgctatcgcgttcatttaaaaacatgttcagaaccttaaaaaaggaaacctaacctaatctattttatctctgtgcatggctcccatttcctgaattttaagcattaaaggtatagttatatccaaaaacaatcctgttcatttttatttcctgagtttgcatagatttcccaagaatacataagggctttttagacttgaagggtcactttttcctcttttcatctcatatgttagagatctctcataactgtttttatccctcttgcagcacttttattcctcttgaagtactctcagctcttttctgttctattttgaaatctaggtattgtgtgtgcacttcagctctcccaaagaattgtaaattcccagagtgtaggaccaagtggtgctctttattagatttcttaggatacttcctagcatagtgcctaatgcattgcagaatagattgtcggaaccttgaaaaatatctgttccaagcatcacattttatgcataaagaaaatgaggtccctaaaacagtaaatgcctattgcaagtgactacctattaacttctcttcagatgtgtcagaatcagatacctccttttcaatatttctttcttggccattgcaaaatataagttctccatttctatagctccttctactggagtttcttagcacagccttttctgttttgtattgtctcgtattgatgtctatatttctattcattttatttttctcttctcagattctgtgtaaaaatagattgttagctagtgtgattcatgttttataatataagtgctaaagcattaaaattaagtcacttaattgctgaaatggatggctttacattttaaccttttaattttcctggaagcctgaagtttgaacatattagtcaccgtttttaaaatataaagctttttaaaaatgagtaagaaaatgtttcctgaagtactgttttattttattacagtaatttgattcaacatgtatttctatcatctaagcctcttaactaggagttttgttttattccataaattgttgttattctgtttttctgcaagccataaaaattgttgctatctttcttcagttattaatttagcctgcctcagggcagaatgtcctggctatactgtgaaatagttcttgagtcaaaatttgatagttttgtctattttgaaagaacatgtctagaatgcagtgcaacaaatatcaacaaataggttaactgagaggcaagtactgtttgtggtaagggatggttatgtgattcaagttarttttcattctgtgctaatctctaattttatgctttgaatttactctgagtttaatttttttgagtctcaatttcctctaaaagaatgatccagtacttttcttcctaattaacatagtgcagaatgaaattattagcaattaaaacattatattttgtaccaataatttaacccttgtcttatagggtctctggctactacttcttcataagcactgtttctctgttaaaaatgtgagytcctaaaggcccaagacctatgattgttactcctattgcattttgtaaatgacctttaaataattactccacctcttccaaaacagacagacttaaaaataaattagctatatgatcatcattagccgaggccagcagagttgaacactgtggagttgaggtatttggcatgggtacagtagtcctcttaggtgctccttcttcctcatcataggcaaagtgaaattgggggtgttgcaaatggttgggtactgctatttaagaaaaagtggcacatttagtgtgaatgactcagatatccaggtagattggtcatattcatgagattaaaaatctcgactacacttagccactatgcccaaagaggacttccatactttttccaaggctccatcattgctgtgacccctttatattattcccctttctctttttatcaagagctcctcaagcaaccccaagtaacctcatgctggctctgaaaccatttccactagtaaaaattggcaagattgaagggaagcttccacaagctcaagctgaatatgcctcctgcttttagtgccagacttagtcctgtgtgaattctacaattttaagtcgttgcaccagagccttgaaagatgatgacacacttgtcctttggagctgattgagcaatggaaatatgccttagagacatgataaatgctgcaatagacaatccttcaaaacgagtctctcctgagataggagtgagtgattgattgcatgccatttttattgagggatacttaatctgtggttacatatctccaggcaactrtatattcagaaacatttagataactgaccaaagttttcacctttccagaagtttaaagggacccatgtagtaccagggaatataaggaccagtcctttgttggccacatatttgctgtgtgaatttaagcacgccatttttcttctctggccttctgtttccacatatattaacagaatacacaggattaatgggaggattaaatgacacaatacttgtgcaagtagatctaaagccctatatggaatttattgctttagccttgtagcgttaatcacttgtggctagaatagaaggctccgtttaaaaaaaraaaaggctgggtacagtggctcacatctgtaatcccacaactttgggaggccgaggcgggcagatcacgaggtcaggaggtcaagaggtcaagaccatcctggctaacacgatgaaaccctgtctctactaaaaatacaaaaaattagccaggcgtggtggtgggcgcctgtagtcccagctactcaggaggctgaggtaggagaatggcgtgaacccaggaggcagaggttgcagtgaggctgagattgcgccactgcactccagcctgggcgacagagcgagactccatctcaaaaaaaaaaaaaaaaagaaaagaaacctacattttaaacactttatggatatggaaaaacaaaaaccgcagaactctttattgcacaagagtaagtggcagttatatgaatgaagcggggcatccgcatgatctcctgtgagtgttttgagaagatgatcaaacttagagaaagcatctttgtgtctaatttttttaaatgatgaaattatttcccactttcattaatattttcctgtgaagaaattgaagttattctttgggcctaaataaaagtgacaattacatgttttcttctcagaggcattgagaaacttggattataatgtttttcgtacactgaagtagaagtccagaaaagatttgagttattgacacagatcttcttttttttttgagacagagcctcactctgtcacccaggctagagtgcagaggcctgatatcatatttcaccacagcctcaacctccctgggcttcggtgatcctcccacctcagcctcactagtagctgggactacaggcgtaccttaccacacccagcaaatttttgtaatttttatagagacaggatttcaccatgttgtccargctggtcttgaactcctgggctcaaggaattctcccgcctcgacctcccaaagtgctgggattacagrcgtgagccatcgcagcctgcccctgaattccataatttcacrtgtaattagaattcaagacctttttcttgaatattactcttgtccatattaatttttttctgagtatggctctagctttatcatttttttctgacttaactctgattaacctcttttttcatcaccagtacttggcagattttgtagatttctaaactctgaaaatcactgtttttctgaaaactgtcatttgtctcatactttcctccaaaattatgaattataggaaacaccccaaagaagtatcatttacattagctgtttacaagaaaatacagggtttcatttttaattttattttcccctactatctctaaggaatacaacttgtcttgaaagctccctgacagcagctatccatttaatctgccaattgcagtataaaaattggttattaaatgaaaaacaattgtatacctctcacagaggttgtcatrtattactatttttgtcagcattctcacttataactctgttaggataatcctgggaaaatttctaaaatcttcatagctctttcgttaggtacatattccttgagacagaggaaatctgagcaaagtaaatttcttcattatcttagatcaacaaaagtgatacagagcttctgtcctgttagctccctttggacgcttaaaataggcactagaggttgtccagtaaatgcttcatatccatctactagtgctgaatatttgtgaaaatataggtgataatgaattagactcgtttgaatggaattaagtttctgtaaagttttaccagattgtcttttttttgttttttgttttttgttttggtaaaagcagttttgcacctgtaactaatttaaagacgaagaaattgcacatgtaactgatagcaactgccatccaactcttataacctcagaatcaagatcacgtggctatttgagtacacagtgttttaaaccgtgtaatttttatttgagcaagggattgccaacacaagatcgaggttcccacaagtggtgaatggcacttgtggttaacactgtaaagcagatttaaaacagtcaactgtcaattgcctacaagggaattattcctcatcacctcatgccaggtttttatatggccttttagctgaccttctaaatgagaaactttgccatccagtgcaaactgccaatagtcctaaaatgcctatctttattatcagtctaataatatttattgagtgccgattttcaaggcaccatagtgaatgctgtgaaatctagacactttttccctggctttcaaagctctttataatccaggcatattttatatattttaccttatttctcaccacattccaggcattggcctgtcttgctctgttcacactaatctctttgtcccaagagtaaggccgacccacccttgctccaagcctagtatgtcttgaaatgcctttcctaattcttccatcttttcaaatcgtccctgtccttcaaggtcagcttcaagtaacctctactccgtgaagcattctctgaattcattgctgttcattgctccctctctcctctaaactgaaaatgtgttcagaatatctctcttctgccgcttccactgccttcagcccagtccaggacaccgtctgtgcctggctgctagtctcttgatggggttttcagcttccatcctaacctcacaacagcctagtctcaacyggtcacccacagagatgatgctcaaatgtgagtcagatccgtcactccacccatagccctgcagtggttccccatttcacttgtaacaaaagtccaagtctggcccctacctcctgccctaccccagctgacccctctggtcttctctctctcttccacccactctgctccaagcacgccggcctccttgctgttccttccacattccagatgctctcctgccttcgtgcacctgccccagctcttgttcctgtccaggaccctcttcctctggcattctctgggccacctctgtcaattccctataatcttggctcaaatcttaccttagagtgagggtgaccttggccttccctatcctaggacaggggaattacatatcctccccattgcccttcctcctctactctacaatttcctatttaaaaagcatttatcgtcttctaacatgccatgtaatttattggtggattctatgtattgcttactgtctgcttcacctccctggaatgttaaccgcatgaaggcagagatctttgtctagtttgttcacccactgatgtattccaaatacctgaatagtattgctcattaatacttgctaaatgaaagaatagaatcctctaacacttayggcttctatcacacaatttagccctgagttcaaactgtctggtattatttcctgttttatgtattccctaagccaaatcatatagtcactgaagaaaagatccatgttttattctatattccacaaatgccaaacayataataagtataatcaggtcttgttgacttattaataccaagctgatctcctaaggtcagagactggaatatatttagcaaataaatacaaaattttagtgtatgttaaatattattctaaaaccaatgctaatataaacaaaccaagtactggatatgctacaaaccaggcacaaatatgttttgaattatctgttagttaatttgcaccgtgtccctccattagtttgagtagcattcattgaatatcatttgaatattaatttaaacatcatttgtttgtgagttacccaaatccctggcttcttctgcaaatctacccaccttttgatacttccattatttatttgaacatccaaaacacttatttgctagcaatgtttaaaaaagagtagcttatttaattagctaatatctaatatatgaagcacttaaagtattaattgcctgatatgtaataggtgccaaacacgtcagttctgtcttcttctcatctttaaaatggaagttaatacagacataatgtctccccttgggtcttttaagtcagatctttaggaaaaagtaaaatattctcattattcttattattttgcttgcattagcaataaagtatgcctgatttaagttcactggacattatcttactattatctatactttacctaaagccctgcctttagttttgtaaataaaattatagacctattagatagattgagcaagtttgcttagtggattaaaatatgatgctaataagagccaaagtgagtttgataatgggttggccagatttacacagaagtctttgccatttacaaagagttctgtttgccattgatacagtcacatttctagccacaattacccaagatatgtaaacagttaactcaggagaaaccaactcaattttcaggtatatgccatatacaaaatctcatcacctttgctattatatacacttagtattatttcttaagcaatatcatgtaatataaggggcacgttgatgacagggacatgtacctttttcttgggatttcaatatgaatgaccatccaaatcttgatcatcccaatggctccacataatttggacaccatgtctaccagaaagctatccctgattatttcaggacatgttagtatctttcttttccacatttctaaagtacttactatctctatcacgagtctggtctctgtacttccttctgctactaaacatctctcaccttggtaagcttctcaagaaccacaatactatgtgtttcttgtaaggcctgaaaaacaccttgcacgtagtattaggtgattagctatcttgatttaaggttttagattactgattgaacatttactgagctgaagatatagagaaagaaaaatgccaaagaaaataaaatgaggaagtttggaaaagagaaacacactagtaaaatatgatggtaacttctaagaagcaaggtttataaaatagattgttgatacaaagaaaacattataaaaaaatgggtagcttgaatggatttaacccccaactttatttaatttaaatggaatgcctcaaaagactactcagctgatccaaacatagtaacttcccaaacacaagactcttgacgtaggcctcagaatttggggaaaaaaattcctgcattgtttaaaaatacagtgtccttgtaaagcagaataggccttatatacaagccaaatatatcagttctaaagcaaaaacaaaacttttcctacttactcttttatttcttttttttttttttttttgagacagagtctcactctgtcacccaggctgaagtgcagtggcgccgtctcagctcactgcaacctctgccccctgggttcacacaatcctcctgcctcagcctcccgagtaactgggattasaggcacccaccaccacgcctggctaattttgtatttttagtagagayggggtttcaccatgttggcagggtggtctcaaactcctgatctcaagtgatccgactgcctgcacttttcaaagtgctggattgcagatgtgagccactatgcccagcctgcttcactcttttagataaaatgtacaccctttgaatttttacttccgccatttacactgatttgaagtccttggttgaatatgtatttagccttcactgtgcaaggaagctggttacaaaaacagatagtttattaaaatacttgtgttggtttttaaaaaagaataattttaatacagtttttctcttctttctttttgctctttttgttattttttaatagagacacggtctggctatgttgttcagactggtttcgaactctggcctcaagtggtcctcccatcttggcttcccaaagtgctgggattacagatgtgagccaccatggctggccttaatactgttttatgagttctgaattgaataatttttaagtgaatgtcctaaaattctatgacaatccttttaacacaactggaagagtttttgttggcttacttggtttgtctgcatgtttccttctgtcatcccccactcctaggacccatatggaacattctctcttaattaactcttttattgaagtataatrtacttagaggaaaaatgtccaaatcattttcacaagtgaacatacttgcgaaattagcacccagacaaaaaaaaaaaaaaacagaacaataccagcactccagaagccctctgactattctaatttctaactcattgttaagttttgcccagttttgaattttatataaataaaattacacattgtttactcttttgtgtctggattcttttgcttagcatttattcgtgagattaatcacactattgaatgtaattgtacttcattctcattactgtatagtgtttcattgtataaatatatcacaacatatttatcctactgttgatgggcattcagatggttttcagtattgcaaatagtactgctatgaacattgtcctgtaggtctcttagtgaaggagcgtatgcatttctggtagctatatgcttcagccaataatagagtatgttgagcttcaggagaygttgccaacagttctgaacaggactctagaaatctatacttctactagaagtgcatgagtgttctagctcttctacaccatcactggtacttggcattctctgtctttttcacgttagccattctgrtgggtgtgttggtatcatattctaattttaatctccccttttctgatgtctaaaaagttaaacactttaaaaagcgtttgttgtccatttggctatcctttcttgtaaagtacctgttcaagtctttcacccatttttatattgagtactttaggtaaacgttctaaagcataccttgtcagatacatgtattgtaaatatctcctcttactctgtgtgctttttcgtttacttaataaacagatatttctaatcaatatagtctgatatactagatttttcttttacagtaagtgctttttatatcctttggaagaaagctttgcctactccaaggttgataaagtgtgtttttattttaaaagttttctggttttatatttcacatttagatccataatccacacagaattgacttttgtgtatgttgtaaggcaagggtttatctctttcatggggatatccagttgacctgcttcgtttattgaaaagatcatcctttgcccactccccagcaktgacatttctgtcataaaccaggtgaccatataggtctgggatttattctggacttactcttctattgcattgtatttttgcaccaattaagattgccttaagtactgtaactttataaatagtttgatatctggtagtataaatcctccagcgttgctcttccccttcaagatttccttgccacttggcctcttgaatttccttataaattttagactcagcatatcaattaccacacaaaagtgccgagattttgattggaattgttctgaatctatagataaattgggagataattgaaagctttacaatattgagtccttcaatccatgaacatgaactatcctttcacttatttattctttaatttttttaaatagtatatttgagttttcattatggagatcttacacatattttgttagattttttcccctgggtatttgattgttttaatgctgttgcaaaaataatttttaaatttcattttctacttgttgctggcttatagaaatataattggtttttgaatattgaccttgtacccagcaactttgctaaattattttattaactataatgagtttttttgtggatttttaaaaacacagtctgcctaacatggtggctcatgcctgtaatcccagaactttgggaggctgaggtgggtggatcactttgagctcaggagttcgagaccagcctggccarcatagtgaaaccctgtctctactaaaaatacgaaaaattagccaggcatggtggcatgcccctgtaatcccagctacttgggaggctgaggcaggagaattgccctaatgccagaggtggacgttggagtgagctaagataatgccactgtactccagcctgggcaacagagtgagacttcgtctcaaaaataaataaataaataaataaataaataaataaaacgaacaacaacaacaaaatacagtcatgtcatctgtaagtaatgttagttttagttttatttcttcttttccaattattctttgtctttttcctttgttgcattggatggatttccagtacagtggtgagtagaagtaatgatagtatcattaccttgttgctgatctcaagaggaaggctttaaatatttcaccatcaggtatgatggctactctaggatttttgtttgtttatttgtttgttttttatagattttctttagcagactaatgaagttccctttccttcctaagaggttttttatttaaaaaaaaaattatgagtgaatgttgaattatatcaaatgctttcatagtttgttgtggtggtggttgtttttgagacagggtctcactttgtctccaagctggatcatggygcattgcagcctcaacctcctgggctcaagtgatcctcccacctcagcctcttccagtagctgggaccacagcacatcaccacacccagctaatttttaaaaaattgttatagagacagggtctcactgtgttgtctaggctggtcttgaactcttargctcaagtaatcctcccaccttggcctcccaaagtgctgggattacaggtgtgagccactgtatctagcctagaatattttttatagtgctcaggagaaagattaaaagtatgaaaagtgtctactatgtatactttaatatcatattgtaatacatttgaagatactatatggtataactaatgaaaatcttcaaatcagctcataaccactagagatctggctgtatctgttttgacacttttgttctcagtatctgtttagcttaagacccttgtcttctcattaagagtgcttgacacagtaagttgaaaacataatttcaaaagagcatagagtgtcacatggttttgccagactaaacaactctgagtaagaaagtggctttccccctatggtaatgccaagctactagaggaccttcagtggtaaagtatgatttaaaaccctgaccccatctgtcttttcccatttgcagtaagtcctttatagtgtttgaaggtgggcacagcagggaaacagtactctggcagatctgcggtggctccctcctttctgagtcattacacactcttctggatcattcctttcatttttccttttcctctcctctcccctattttcattcccctatcactgcaaagccaaaaccaaaacgtggaaggggacctagccgaggaaaacattccagcttcttttttctgatctaaacaccgttcttcttcttttttattttttaattaataactttatttttagggcagttttagtttcagagcagaattgagtaggaagtacaaagagttcccatatacttcctgtcccccaccacgcacaatctcccccactatcaacatcctgcacccaagtggtacacttgttacagtcaataaacccccactgacacatcattatcactcaaagtccatagtctacattaagattcactcttcgtgttatattctctgggtttgtacaaatgtataaggacacatatccaccattgtagtgtcatacagaatattttcactgacctaaaaatcctctgggatccacctgttcattccgttctcccccaaacttctgactaccactgatctttttcctgttttgatagttttgcgcttcccagaatatcatatagttggaaccatacagtatgtggccttttcagtttgacttctttcacttaccaatatgcacttaaggttcttccatgtctttccatggcttgatagctcatttctttgcagaactgagtaatatttcattgtttggatgagccatagtttatccactcagctactgaagggtgtcttggtgcttccaagttttggcaattatgaatagagatgctataaacacctgtgtgtgggttttttgtggacttaagttttcaattgatttgtgtacctaccaaggagtgtgattactggattgtatggtaagaatatgtttagttttataagaaatggccacactgtcttccaaagtggctgtaccattcatcagcaacgaatgagagtttctgttgctccacatcctcatcagcatttggtggtgttagtgttttagattttagccattctatttgtagtggtatcttcttgttttagtttgcagtgctctcgtgacatatgatgttgaagatcttttcacatgttcacatgccatctatatatcttcttggatgaagtgtctattcagatattttgctcatttttaaaacagggttattcactttcttattattgagttttaagcgttctttgtatattttggataacagtcctttatcacagtagtccctgacctttttggcaccagggaccagtttcatggaagacagtttttccatggactggggtgggcaggaatggtttcaggtgaaactggtccacctcagatcatcaggtattagattctcatacggagtgtgcaacctagatcccttgcgtgcacagttcacaatagggtttgtggtcctatgagaatctaatgcagccactgatctgacaggaggtggagctcaggctataatgcttgcccatcagcagttcacctgctgtgcagcctgattcctcccaggccatggactggtactggtctggacctggaggttgggaacccctgctttatcagatgtgttttgtacagatacattctccccatctgtggcttgtttactcattctcttgacactgttttgcacagagcagactttttttattttaatgaagtccagataatcagttatttcatggttcatgtctctggtggtgtatctaaaaagtcctatccgtgctcaaggtcatctaggttttctcctatattgtcttcagggagttttatagttttgtactttacatttagatctatgttccattttgagttaatttttatgaagagaataagctctgtgtctaaattattattattattattgttattattatatttttttgcatgtggatgtccagttgctccagtcccagttgttgaaaagactgtctttgctccagtgtattaccctggtttcttcatcaaagatcagctgactacatttatgtggtcctatttctgggctctgtattctgttcctttgatctatttgtctattcttttgccagtaccgtactatcttaattactttaactttctagtaaggcttgaagtcaggtaatgtcagtccttcgactttattcttcttctttaatattgagttggctattacgggtcttttgcttctccatataaactgcagaaccagtttgccaatatccacaaaataacttgctgggattgttattgtgattgcattgaatctatagatcaagttgggatgaatgacatcttgacaatactgagtcttcctatccatgagcatgcagtgtctctccatttatttcattctttgatatctttcatcagagttttgtagttttcctatataggtttcatatatattttattaaatttatacttaagtattttacttttcggggtgctaatgtaaaacaaaacagacattatgaggaaaatgtaatgtctgtttgggggtaatgtgtttttaatattaaatttcgcttgttcattgctggtatataggaaagcattatgacttttgtatattaaccttgtatcctgcaaccttgctataatcacttactaggtccaggagattttttttttttctgttcttttggatttttttatgtagaagtcatgtcatttgcaaacaaagacagttttatttttaccttcccaatctgtatcccttttatttccttttcttgtcttgttacgttagctaagacttctagtatgatgttgaaaagcagtagtgagagaagatatccttgccttattcctaatcttagtgggaaagcttgagtttctcaccattacttaygatgttaactatatgttttgtttgtagatgttcctaagtttaggaagttttcttattttgtcaaattctttttctgcatttattgatatgatcatgtgatttttcttctttaggctatgggtgtgatggattacattaatttgttttctaatgttgaaccaaccccacataccttagctaaatctcacttggccatggtgtataattcttttcatacrttatcggattcaatttgctgatattttgttaaagatttctgcatgtctgtccatgagagattggtctatagggtttattttccttgtaatgtctgttttgttttagtattagggtaattctagcctcattgaatgagttaggaagtattccctctgcttttatattctgaaagagatttcagagaattggtataatttcttccttaaatgtttggtagaattcaccagtgaacccagtccggtgccttctgtttcagaaggttattagttattgattcaatttcattaataaatgtaggcctattccatttctctatttcatcttgtatgagttttggaaaattatgtctttcaaggaatgagttcatttcacctagattatcaaatttgtgagcatagagcctattatcctttaatgtcaatgagatctgtaatgatacccctctttcatttctgaataactttcattcattcttcacgtactagacaaagtagaatttcaactaaaccaaagcaactgttcaacagatttagccttagtcctaatcagattattagtaatatctccctttagaaatatatgaaggtacttttagcagaggaaccaagcttgagctagtttgaccataatgaatttttgctgaggaagcagaagaaatgtttatattggtgagggcataatcctgtaatcttttctgtgtcctgatacctcaggaccagcgtaagcaaactccctagacaagatgtggctcatgcaagaggaaatatgcttttgaaaatgaacatgggccaagcatagtgactcatgcctgtaatcccaacactttgggaggctgaggcgggaggattgcttgagtccgggagtttgagaatagcctgggcaacataatgataccttgcctctacaaaaaaaaaaataaaaataaaaaaataaaaataaaaaaattagatgaatgtggtggtgaatgcctgtggtcccagctacttggaaggctgaagtggaaggatcacttcagcacagggaggtcgaggcttcagtgaaccataattgtgccactgcactccagcctgcatgacagagtgagaccctgcctcaaaaaataatagtaaaattaaataaaatataataaaaaacatggtctttctaataccctttgttgatctgaatttgaaaatttcctgtgagaccttctggcttattataaagaaatttgcatctaaagatacatattggaatgtttcaatctcaaagctatcaatgggaaatcaaacttcagaaacattgaatttggttttgaatatagtctaagtagacaataaaatgaaaatacatttgtttatattgaagaagcaaatgacacaccaaatagttaatttctaatagttttcatttttttctttttctttttttttttttttttgagacagtgtcttgttctgttgcccaggctggagtgcactggcatgaactcggctcactgcaacctccatctcccgagttcaagtgattctcctgcctcagtctcccaagtagctgggactacaggcctgcgccaccacgcccggctaatttttgtatttttggtagagacagggtttcaccatgtaggccaggctggtctcgaactcctgacctcaggtgatcctcccaccttgtcttcccaaagtgctgggattacaaacgtgagccaccacgcccagcctctaatcattttcttaattcatggtgcccaaaataaaagattctatattcagagaaaccatgacagaatttaaactctagccccaatacctatttaacattgggcaagtcacttaacctttttatgtctaatatttttaatctgttaggtggtaataatacttgtgtataacaacataggactgtttacaacaagcacttaataattgttagctattgttactaaattgtatttctgctgatgggttccagagtcttttcctccttcactaaacaaaactcaggatactatgtgaaggaaaagaagtgagttggtagaatttattttttaaatgcttgagtcaaaaggagagccatttgtggctgaagcatcaaaaccattttctgattttctttcattctacttgaaactacattaaaattttctccaattttccagatgattgcatgataattccttttaagaggactttaacacatgtaagaaatagagttactccctctgttaggagaaatcatggaaagatattrtaattaaaagatagtgaattttagcttaatttttacctttatctaaataacactcgtacacagctacagctttcagtgaagaagagatactcattcccacagctaaatcccgctcctcataggcagtgattttacctctttcacatatttcttctggcatttaccttcctatctctagaataacatacttamattaatggccaggcatagtgactcacgcctgtaatcccaacactttggtaggtcaagatgggcacatcgcttgagcccaggagtttgagatcagcctgggcaacatggtgaaacctcatcagtacagaaaatacaaaaattagccagcagtggtggtgcatgcctgtggtcccagctacttgggaggctkaagttggaggatttctcgagcccgggagtttgaggctacagtgagctgtgattgcrttacagcacgacagcctgggccacagagagagaccttgtctcaaaaataattataataataataacttatactattatttttaaaattgtattcttatccattgacttcttactgtgggagataataatttagtccttttactaccatattcccttttccaaaacacatacttctccctcccctccatcttcacaatgtagttacttgtaatttggggttaaatcagttgtctgtgcttacattgtagtaactgaaagtgctgcttaaggttgagccaagcagtgtgctmtgattctgtttcctctcctgcttagctatttacttttctggagttaatttttgtcacttagtcattgctcattttgttgtcatttcttgctatgtactcatcactaattcatcctcaaactctctgacagagtaataaaaactcctctgaaagtggtcagacatatcgggcattctggtttctcaggtgatcccacctggccttcttcctcctgcattttctctaggctgctctgtatctgtagcctgggactaccttccacctctctcctgtctttcagatcctttgtttcctggtcccatcttttctcttcttggttctggtggagaactctgggaaagagtacgtgggaggtaacttttctggatgccttatcattctgaaaatgtctttactctcatacttgatggacgatttggatgagtctaaaattctaggttggaaatttttttttctcttgaattttggcaacattgttctattgattttctagcttccagtgttactgttgagaagttcagtgtcattctgattcctgatcctttctatggtactttttttttttcctgtcaggaagtacttatgatcatctctatagaaggggtattaatcttgacagtgttcctttctgtgtggtttaagaaatcctttctctcttgggttttgttactgttttataaatccttgatcttagtcattctaaggttaaagaaaaactgaggaacaactcaggaatacgtttcaagtacatgtgataaaaggcaaatatgcagaggatgataactatatgtttaaaaaatgggaaaaaagagatagtcgcaaacttcaacataggttagatcatcatttctcaaaccatattccatcacatattaarctcctcaaatattgcacactgtgcttttttctctcttttgtgtattctcgtgaacattagcctgttagtttaagaagtctcacagtaaacctatttaaccttgcttaacctagcattgcctaaatttacttgatcaccagattttttttgttttgtttttaattatttttaaaggaacattattaacatatgtataacacagttggggaaatgccagataagacatagactttcctggctgctaaagagcaattaagcattggaatgagtaaccaagaggagctgtggactctccttttccagaggcctttaaaacaggacatctgttttaggcgtagtcctgtttaaacaatagggctttgctggcggttcttcctcttcctgtcccctagtggtagtgttggaggcttttagcccaccttttatatgactgtagtactctggtgactaatgtgtacacaaattactgttatactattaatattaattatatttattgagaacttattaagtatccagccctatggtaagtgctctacatacattatctaatttaatcctcacaacaactctaggagggagacaatattaatattctacagatggagattagatatgaagagatacgaacttccagcaatagggttggattggaacctcgggcatctgacatggagctgtgcccatccttcttcaccgttaatgttcaaaacagcaaacggcacaaagcaagcaaacaacatttgtatatctgtacttactatgtaaaaacaaaccaagataatgcttactttattagactattcaagactattccctacgccttttgattaattcagrgttcatgacttttgttagaaacaaattctgttacagatttagttcttcgcattttattctgtgataatttgccatccaggaaatggttccttacatgagactttttccctcataaatttgatgacattcatatacattcactaaagacccccaaaaaataaatctggatctgtgaaaagtggcaaaggttaaaagtcccattttcagcatatttacatgtagtaacaacttgataacacagcgctgagaatgccaggctcagaggagccaagctgggctccygtccagtcagcctctagctcaccaggaaaccctgagcaggtcactttgcctcattttctttatctgtcaaatgagaactcagatgatctcaaaacagccttktctgctgtagtgtttcaggatgattcttgtctctggatgtcgctgtcatgatgggagaggaattagtaaattcccaggtcagtttacactgcagagtgatcttgatctgcatgaatcagtaaggatgggctggataaacaagttggaaccacagttatgagtaccatgacattaactgaaacaaatgagaagggatkgaaaaatcggcggttaagtgtcttttaaggtcatttccaacaaaactacaaaggacctatgaaaggcttttcaggcacgtactcttgttgcctagctgaacacatttctccaataaagctttcatttgagagttactcttcatagtacatcccctgcccccctgcctgcctggcacattataggtattcatgaagatttgttggaactgttaaataattgtttaatatagaactggaagatcaggaagaaataatgtttttctaaccagtatccagtgtaaagtcacaagtgtgggctatggagcttcagaccatctggattcaatgccagttctactgcttagttactgcgtacttttaggcaagttacttacttccaggtccatgcctcagttttcccatctttaaagtaaattataaatgcacctacttcctcgggctggttgtgaggattaaatgacacaatccgggcacaatatttggcgtagtactttgcacagatttagtgtcctgttagtattagctaatgtaaatatgaagaagatgtaacattttaccagctattctaatcatagcttttcttttcttttcgtaagggacaacataaaaccccaaaggtaaagcatatatttctggtgttcaattttacaatttagcatcttttccaacccacttccatactcccaaataataatgcctatcagattaaagaagttactttatttttgcatgaaattggttgtatttttgttgcactacttcatcctttgagtattgtgaaaagtctgygcattgactataatagcatttaaagccaagtttgaaggtctaagataatggcacacatccatgtcctttgctcacaagttctgcctaaagacttyagcctgcttgaaacactctaaaggttgtgaaattaatggatataccactgatgcaacacaactcagtgtcaccagctagggagttaagacatgttcttgttactgagaagggctgttgttcatgcaaatattttgttcatttgttctttcatgggtaattgcacggagtaacaaaaaacacctcctcaacttacagcttggcagaaacagtagcttatgttttctagagacaaaattagaagcaggctttctggacccatctctaagtcaaaataaaataaaatgtctagggaaccactgtgcctcccagtaactatggtccatggaataatattgtttaggtcaaggtgtcccagagtaaaagggaagggagaagggcaggggggaaggggaaaagtgtgtttgggcaatgttttcatagagatgaagaggcaagctgtttttctttcttactttgtcctttcaacttagaaaaataagaaaaccatctaggaccacaaccttcctcttgtaatcagcaaaagagaaaaaactgaatatacatcgttaaggggaatggttatggcttaagttgtattttattgataatgttgaagattaacattttttggagagaacttaagtcttaacaaaactaaactattgagaaagtattgttatttttccatctttagtagcaaaatgaaaatttactctactcttctgcataaaatatgatcatcaattggcaagaatttggttaaaaaaaaaaactgtgcatagaatatgcacatgggaagatagaataataagatgctgtccttttactccagactggaagtctaatggtggagatagttatccagataattatatctgagttaaaggaggaggtacaaagtgctgtgggaacacagagaatggagtgtttttaagttggaggattcatagatggttttacagagaaagtagcatttggactgggttttgaaagacaaacaggcttgtggcatgaagaggtgaggagtaggaagaagatacagcagcctcagtaacctgtatgactaaaagaggcagggcatgtttaacctgggcagatagtatgatatgcccagccaccagatatgccaagaatgggagcgaggtctgggataaccagtggaaataagactgaaaaagtaagttagggctgagacatagagggccttgaatgccaagctaaaaggccagtgtttctcctgcttttccaccagtatgcccttactagtagaggacagcaaaaccataccattcttgggtggaggaagggaggaatgaataggtggagtatggggtatgtttggggcagtgaaactattctgtgtgatcctctaatgaatgcatgatattatgtctttgtcaaaacccatagaacttggctgggcatggtggctcacaccrgtaatcccagcactttgggaggcagaggcaggtagatccattgaggtcaggagttcaagaccagcctggccaacatagtgaaaccccttctctactaaaaatacaaaaattagcagggcatggtggcacacgcctgtaatcccagctactcaggaggctggggcaggagaatcatatgaacctgggaggtggaggttgcagtgagccaagatcgtgccactgcattccagcctgggtgacagagcgagactccaccaaaaacaaaaacaaaacaaaacaaaaatgtagaactatgcaacagaaagagcaaaccttgatgtaaatcatggactttaggtggtaataatgtgtcaatattggttcatcagttatagcaggtatactacactgtgcaaggtgttagtaataggggaaaaccatgctttgtagagaggggacaggaggctggggaagggctattttaagagctctgtactttctgctcaatttttatgtaaccctaaaactgctctcacaaaagtaaaggctactatgaaaagcaaaacaaaacgaaaacagaaaacagcatccttttagccatgagatgtactacaagtacagagttttctaggaatttcatataatatttttaaaaattacatgaacttttccttctttccttaacacatagatggctattttcacattaaaaattttcccaaaatttccacaatgtaatacacgacccctagggatatgacttttgtaataagaagcatgactttggctgggcacagtggctcacgcctatattcccggaagtttgggaggctgagccaggaggaccacttgaacgcaggagtttgagaccagcctgggcaacacagtgagatgctgtctctttaaaagtgaggttggggaggtgggagagagagagagagagagagagaggaaagaaagcagcatggctgtgattgataggaagtcactgaaattgtatgttaaaaatgaaacaaagcaaaattaaaccagtaaaatcatgagcaaccaatttctctcccaccccagatatttgtgcatccttattttcatttcccagtattcatacaaaagcatatccactacctttaactcactttgtcagcctttattctgtatgcagaaaactttgcaatagcatagtgagaaataggtgataaacccacctttgtggatattacagtgtagacaagggaaatatactttaatatgaaaataagttatactaagaaaagtagatacagaaatgaaaattaagcctgccaaggagacagacaaagtaaatggaatgacctgggttagacaggtttggacgaattttgaaacaaaggacacagttggatgggtgccctgtccttargagcacagacttttttctggatgtcattgagacctagaatgacctttaactatcaccagtacacattcccctttttggtgtgcagtgttgacactgaaacacagataacttaaggttgtttgggtacttatttatgtagatagacatgtgaacccatacggtacctaattagtcctcttgaaaccacaaacgcgcattcacaggaccagtcttgtttatattttcaaggctttttttttttttcttttgagttggagtttcactcttgttgcccaggctggagtgcagtggcgtgatctcagctcaccgcaacctctctctcctgggttcaagtgattctcctgcctcagcttcccgagtagctgggatcacaggcatgcaccaccatgaccagctaattttgtatttttagcagagatggggtttctccatgttgatcaggctggtctcgaactcctgacctcaggtgatccaccctctttggcctcccaaagtgctggaattacaggtgtgagccaccgcacccggcctcagggcattttttcttatgaagatgacagccgaaatcttcaatcttcaactcatgcaaaagtttgcctttggagtgaatttcttggcaatctgcttggtaagaaaaagcaagtggtgttaaagtgagagcattaaaataaaattgctccaaaaaaatgataaataaataaaagaaaagaaaaaggaaaagcaagaggcccatgcacagatacacagaggagagtggcccctcctccataagcctgtttcatcaatgagagaatcaagagagtatgtatatacagaagagagtttcagggtcagtcttgagtttgcatcttctacttcctagctagaggaccttgaacaattcactttacttctttggtcctagcttgcttatctataaagtgggaataatatttcagattatgcagaagaaaaggtaggatgtaccgggcacatgggaagtgcttgatcaataccaatttgcttccctccttccctgccccttctgctgaaacttcacagctatctcattaagtcatcaatgtatttagtatttaataaataaatatttaacgagcacctactatgagacaagccctttgttagccagtggggatatgactgcaaacaagaaagatacgcctatgatttgatgaatcctggagtttatgagcagctcatctctgtctcccgtgtgagcagtcctaaatttacacagctctccactggtgtttttgaccacagagttaacatttaaaatacctatgactgcttttttggcaccactttgaataatgaactggtgtcaggtaaacagagtccaggtacctattgcagaaagttttccagtctgcaccctcggtggctcacaagttyacatgaagtgaaccaaaagagttttgttgcacttactgtgacaataaatcatgtttagaaaaatgcatgtggcatacatgatattgggcaaatgattcatgaaacttgctattctgtggccttagaatccatgtaagcatttttcctttgtcttttatgtgttttcttgtttctatctctgttttgttttgtttttgttttggggatggtttaaaattaatgctgggctagagtctgattttgacactctcgggtgtgatcaaatgtttccacatatctctctaacctttctattctcaatgtggggaaaactttctccgctttaagaaaaggtgtatccacagaaaagattattgagtaatttttcatagtacagaagtaataattgagtgatttttccctttaaaatttttttatttttgtattattttaagaacaaaattattttaggatgcaattaaagaagaagttcatttacctaaatttaatttgccaacttttctattacacaaaagcattataaatacaagtagaatagcaaaaatttcatcctaaagagaaaaatattttgggcttctaatttcaagagagtaaaattgtcctggaaccctgtgcacactttaaaaacaatcattaacagattgcatcaaactagaaacttcttcaccacaaaggaaataatcaataaagtgaaaagccagcctacagaataggggaatctgtacatctgatatgaagttatggattgcaaatcgtacatctgatatggaattaatattccaaaatatgtaagaaactcaacaaactcaattgcaagaaaacaaataacccagttaaaaaatgataaaggaatatccatttcyagaaagaagacatacaagtggccaacagatatatgaaaaggtactcaccatcactaatcatcagggaaatgcaaatcaaaaccacggtgagatatcatctcacacccattagaatggctgttatcaaaaacacagaagataagaagtgttggcaaggatgtggataagagggaacccttgtacactgttggcaggaatgtaaattggtatagtcattatggaaaacagaatggactgcctcaaaaaattaaaaatagaactagcatatgatctagcaatcctacttctgggtatatatccaagggaaatggaatcagtatgttgaagagctatctgctctcccatgttcactgcagcattattcgcaatagccaagatatgaaatcaacctaagtgtcaatggatgaatggatttttgaaaacacagtatatatctgtatatatatacacacatacatatatacacatacagatgtatatgtacacacccaatagaatattattcagccttaaaaagagaaggaaatcctgtcatttgcgacaacagagatgaacctagaggacgttatgctaagagaattaaactgggtggtatttgacacagaaagacaaataccacatgatccacgtggaatctaaaaaagtcgaactcataaaagcagtgagtaaaatggtggttgccaggagctggagggtgagagcaatggggagatatcagccagagtttcagttatgcaggataagctctggtcaccttctaaggtgatcatctgctaagtataggtcaccttcagcatggtgactatagttagtgatactgtatggtatatttgaaatttgctaagacagtagatgttaagtgttctcactacacatattcatactcaaaaaggtaactgtgaagtgatgaatatgttcattaccttgattatgataatcatttcatagtaaatacgtatattaaaacatcacattgaataccttaagtgttttgtttgttttttggttttttgggtttttttgttttgttttggtttaggttttttttgaggtggagtcttgctctgtcacccaggctggagtgcagtggtgtgatctcgccttactgctacctctgcctcccaggttcaagtgattctcctgtctcagtctcccaagtagctgggattacaggcgtgctaccacacccggccaatttttgtatttttagtagagatgaggtttcaccatgttggccaggctggtctcgaactcctgacctcaggtgatcctcctgcctccgcctcccaaagtgctgggattacaggtgtgagccactgtgcctggcctgtataccttaagtttaaaaatttttgtctattatactcaataaagctggacaaaattttaaataaataacagcagtcattaacagactcaattgatgacctaatgtagaagttaatgagagcaggcctgttggcaaaaaggcatttatatggatacactgtatgtatctgcactgtttcaggatcctctattatgatacctgggtaaagggtgacttcctttctatcataaaacagcctagacagcactaagaaggtggttatgttcttttctgttgttgtgagygcccagatgagattactttgccaaagactcttttcatttctctttctgaaactctgtgagattgctgtgttctctaggacttaacttcacagctagtctatttttcctttcagaaatgaccatggttgacacagagatgccattctggsccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtatgatgtttattttcacttttcagactactaggactagaattggactcatctctcagtaaccctgtaataaataatgctccagagactagaaatctaatagagaaggcattcaccattcatttattcacccatttatccatgaaatattaggtatctatgaaatgccaggaagggagctggcacgaggtcaatcttgccttccccgccccctccttccttcctctcttctttcctttcttgcttacttccttcttagggacattttctaccttgattacactgtcagttgtatctcaggctaagagtccatcatccaaactttgaattattttggccccttataagttaataagtaacaattccaagtcactttgtattatataacttatcttcactatattactgctactacagtacattttttctagtatgtcctttcaggagtttatactgaaacctacttttaagcacaaatttgttttaacattgtagcctattgataaattttcatgccattaactaaatcaacatcaaaacatcagactcaagaaaaactagaactgcactttttgagataaaatgtatttctgtgatgctatttccttgatttttatcatgtgtgggctgacatgctggttttccaaagccaccactatgtaattggcaatcattacttgacaagtaagaacttcctgtatttctagtggcttttaaagataaataatatgcttagttatatttatctatgcggttttcagttagagcctaatatggaaatttagtagccctgagcccaactagtaaaaggtagggcttacttccataagttccgccacgctctgtcaaagattatttcacaaaccacctcctttgactgaacactaatggtaacctgggctcatatttttcatgcacctcaagctaggcataccatgaccttttcacagtggtgttccttctgtggttcttttgcaagttgtttcaaagtacttataaaatggaatatttaaataaaatgtataatttaatattgtgatgaataccaaagacagaacatttcctagcaaaataagcttccttgtctcaaatcctctatgttgtctgttacagctgtagtattgcaggctactgggggtcatagaaccacagacttaattctcattcccattttatatttacaggtgaggcttagagatgttataacttgcctgtgattacaaacctttctttttcttgccttaactccagtgttttttcatgttccactgtgcttttacactgaaacaatacaaatacagcatgaaggtgtactatggtggcttgccctgttgcctttttaggactgttttcatgggataattatcctctcacatgtctccatacacaggtgcaatcaaagtggagcctgcatctcmaccttattattctgagaagactcagctctacaataagcctcatgaagagccttccaactccctcatggcaattgaatgtcgtgtctgtggagataaagcttctggatttcactatggagttcatgcttgtgaaggatgcaaggtaattaaaaaaaaagtcttcaaagaaattgttgaaactttattatttcatttcagcagaaccccttttttaggtgatacaatatatgaattttttttcttcatggaagagtatcttgctctgtcacccagaccagagtgcagtggtgctatcctagcacactgcagccttgagcttctgggctcaagtgatcctcccacctcagcctcccaaaggatgatataagatttgaaagcctaagaaagtggataaaagttgggctgctttgccccacatttgtttctccaaattgattctttgagacactgatctaatttaatccttgcatcttgcagatttttacaaaaaggtgacttctccaaggtgtcatggcaagacagtgatgacctggaaccaggatgcagatttcctgcattctctagttgtttatttatttatttatttatttattttgctataccgtgtaatattgtatagacagaagattttacagattatttatatatgcatatctttggatccctagagcaatcctataagattggacttctttatggccacattgcagatgtagaaattacaggttagtaaaacttgccaaggtcatcccttagtaagtggcagaccgcagtctagaccctgactccttaggtggtgttggctctcaaagcagtgcctcatgtttccttattccagcatcaatgtgagccacatacacggacaggtaaggaggtataacagtgtgggaaaggagatactatttatcctcatctctttcctttgtgaaaagggtattttggaaaattcagacgtttagtaatttattgcttaattattaagaaaatatgtgaatccactcatattttgatatgcagtcttttaagataattttaatatacacaatgcaaaaatagtactaatttattatatacgcattgcacagaataaactgttcataaatattcactttataaaataaatacctgcttattgggctttttattcaacgtaaagatacagaacaacagttaggaaagttttaggacatcttggttcctaaatggatggtgggccaaaaaaggaaactgatttttattgaattcttactacatgccaaatactgtatgaggtaacgttttcatacatcagtatttaaccacatcctacccaggttttctcatctataaaatgattgtggctgagtgtggtggctcacgcctctaatcccaacactttgggaggccaaggcaggaggatcacttgagcccaggggttcaagaccagtctgggcagcatagtgagaccccatccctacaaaatttttaaaaaattaaccaggcatggtggcacatgcctgtagtcctagcttcttgggaggtttaggtaagaggatcccttgatcccagaagttcaaggctgcagtgagctatgatcataccactgcactccagcctgggtcacaaaagcaagaccctaactccaaaaataaataaataaataagtaaataaataaaatgacactgaattacatgatctctaaagtcccttcaattgaaacagtttttactctaaaggcaacctaatacagtgaaaagggacaaaccagaggtcagctctgccactttccaaagtcattagccagtcacatacacattgtatccttcatcaggccccccatatgtaaaatgacttggttagattggctacacaaggtcttattcatctctaagttctgtaatttcaaaatgacactttgaaacactctggcaagagatgctttcatttaaaacactaaaacccgtycgttctgtaatttaaaccaagttaaaatatttatgaccttatatgaaatcattgtattaagtcagttatctaagatcttgatgagtagtaagaacatgtcattttattgacttagattttttattgaatgttttgtggttttattgagttttattttagatttaatgagttagagtttatttttactgagttggataccatttttgagtgagtaaactgttgctaaattctgagccatatttatctgaagaaaccattctgttttggtcatgttgataatttacaactataaataaataaaaacagcatggttggtttaaggttccacaataagttattgttttttatgggctagtaaagcacttagaaaactaaaacttttaagcaaatagttccaccataatcctattagtcacaaatttgtggaaagctaacattactgaaaacagctgaaaatggaaagacaagaacattgtcagtagttggttatagtgataaatctgagttctgagggcactaaaacttaaaagcaagcagggaagaagagtagcaaaaagagaagagagaggaggaaatccaagtgccttcaacttaggattagaaagggtagaaagcagggagggagaaaaaatacttaataaaacctgaagactctaggggagtccttaacctatcatagattaaaaagcaaacatagaagaaaactaagcgtattgtatactaacctgcagtaatttgcaaaccatccaaaatgtggattccagaattcctagactaaaatgtaaggaaggttttactcccttggaaagggaaaatagacatctacacgttttaaaggtaagaataagaaaaatattattcttggaaaatttaaacatttagtaatatactacttaatataaagaaaatatgtgaatccacttatattttgatatgcagtctttcaaaataattttaatatactcaatgaataaaatagcatttattgtatactgattgcacagaataaatttttcataaatatttaccttataaaataaaccctgcttcggctggggtttttattcggcgtaaagatatagaacagcagttaggaaagaattaggacatcttgattcctaaatggatgatgggtcgaaaaaggaaactttttttgaattcttattctgatttttattgaattcttagtatgtaccagatactatgtgaggtacatttgcatatatcattatttaaccacatcctactcaggttttctcatctagaaaatgattcagatgatattggtaggatgtggttacataatgaaacattatcatttggcttcttcaagtatacatcagcagttcccaaagtgtggtctggggcttggaccctttcaaggcatccatgaagttgaaactatattcataataatgatttttattacttttttcactttcattctctcaggagtgtatgtggagtgttctggaagctacatgatgtaggatgatgacatagctctggtagctaatggaatgtttgcttatgtgttcttgtatataataatttctcagttgtaatttctagtgtgataaatgtcagtaaagatagcccacataaacaaaatctctttggggtcttctataattttaaaaagagtaaagggatcttgcaaccataaagccttcagtctcattctgaagaaatgcagttactcattctttgctactttgaaactagacaaaattgctgccacattctgaatactgctgcattagaccagtggctgtcagtaaagacatctccttagcttataaccaatacgcaataaaaagccaggaaaatggaattagcaaatgtgtttaactcatctgcatgtattttctgagaggtgttttggaagcttcacatttgctgttgtagtaaaatgtgggttatattcataattaaaatacagttgaccacaaagctgcaggcttatctatggattgaaaagaataaacacagcataaaacaacttttggtagatcttcctaaacaattttacaatgtaaatggaacaggtttatattagtgattcttgccaaaaattcagtcagacagatgagaatgagtagattgggtttgaattaaggtgaaatagttacagattcttgggtatgttaatattgcaaacttatgtaaaataaaacctttagcaactgaaagatatatataatttagagcttggaaagctatcatttatttgttgtttacatgttggagatatatttttttctttggtaagttccatcctattttttatctttagtgaaagatcattttggaaccatagccgtacctaaagatataagtaaatacagtctaccatacaatacaatgtaatctaagtttgtatttctgtatacaaaagaatgccgtatgcttgttagccacttgtatgtctattcatccctacttcagaaagagttttaattcttctcacctgccagtcgtagcttattaatccaacttccaggggccagactgcttcatgggaaagccaactgcaagcccagcacagggctgttaatttcattgtaaaatcaacaacaccattctgaggtctcattgtccctgatgttttgttaaaattaaagcaattaaggagagatcaaagaaaatttttcaaatgatatgaaaaatttgtctgttactttctagcagacaaatgtgcagacattagaataaatatatacacaaaacaattttctcagatggtgactgatgcatctctaacacaccacatcacagacttcctgatcatcagaagagtaagttgttgaaaatacattgttctatggactctaaaataataaaaaagtgttattagagtgtttcttcatcagtaatatgaagaaaatttggagaagccagccttgttctgtaaatcgataaataattttacagaaaagcactcgataatatccttacatcttcctctctagattccttgagtcacataacaagaaaacacttggttatcggtgtaaaaaaagtaaaagcaagttccaagatgcatgctaggatctgtgtattcagttcaagattttatttacatatacagtgtataatgttcagaatgattattcattgaaagaccttggatcatcacaaaaaatgtgatacacttttgaaagtcatcagctgagtcatgtcagaaatttccattataagagttaaacttaattctctttttttttttttgaacatgtgtcaaagatttatttaaaacccattaacgagggaaaagcaggatggtaaatctagttcaaagaagaacttgaaggaccaagaatatatagtcactgaaagaaagaatcctgagataagattcagaatggttaatgttctacagggcaataaaaccataaccttgaggttatcttttcttttttttattattcttatactttaagttctagggtacatgtgcacaacgtgcaggtttgttacatagttacacatgtgtcatgttgatttgctgaacccatcaacttgtcatttacattaggtatttctcctaatgctatccctcccccaaccctccaccccctgataggccccactgtgtgatgttccccgccctgtgtccatgcattctcattgttccactcccacctgtgagtgagaacgtgcagtgtttggttttctgtccttgtgatagtttgcttaggatgatggtttccagctccatccatgcccctgcaaaggatatggactcatccttttttatggctgcatagtattctatgatgtatatgtgccacattttcttaatccagtcaatcattgatggacatttgggtcagttccaagtctctgctgttgtgaatagtgccataataaacatatgtgtgcatgtgtctttatagtagcatgacttataatcctttggatatatacccagtaatgggattgctgggtcaaatggtatttctagttctagatccttgaggaattgccacactgtcttccacaatggttgaactaatttacacttccaccaacagtgtaaaagcattcctatttctccacatcctctccagcgtctgtttttttcctgactttttaatgatcatcattctaagtggcgtgagatggtatctcattatggttttgatttgcatttctctgatggccagtgatgatgagcattttttcatatgtctgttggctgcataaatgtcttcttttgagaagtgtctgttcatatcccttacccactttttgatggggttgtttttttcttgtaaatttgtttaagttctttgtagattctggatattagccctttgtcagatgggtagattgcaaaaattttctcccattctgtaggytgcctgttcactctgatgatagtttcttttgctgtgcagaaactctttagtttaattagatcccatttgtcaattttggcttttgttgctattgcttttggtgttttagacatgaagtctttgcccatgcctatatcctgaatggtattgcctaggttttcttctagggtttttgtggtgttaggtcttacatttaagtctttaatccatcttgagttaatttttgtatatggtgtaaggaagggatcaataattctcttatcaaaaaaaccttcctctcctagccatgccaaataactgagcrctctgtgagccatccagctgtcagctagccaagtagcattttcacccactaatattagtctttaaaaagcaagaatcaaaagagaagtcaaggaatatcataaaatatctatgatcacaatggcaaacatcaggattttcaccaacatttatcaatgagaacagttctatacattagcattctgttcatctgtgaaaaaaaaactttttgatatctgaaggtcctcagaaccctttgagaattaaagagacttcaactgccagcaaattctacatcgggcatattctttaagacattgctgatctcacaagaggtagtgaaaactctccaaaacaacatcaatgaaacaaaatgaaacaaacataccctcagttccaagctgtgagctgcaggcacacttagcaggtcagggttttccccatgatagatgcccagagaggtacagtggtgagcattgccccaaaggcagatggctgtagcagttttctgagcaataagtgagaaggagctaagtgtagggcttctgaattaagccaggattctcaatagtgtctgaaatagtcataagtcagtaacacccctggctactgaattcctaattcagacyttgtaggagtcccccagtttaaggtcaagaaactagttccaaataatatcagcaagcatgtgagaagctaaccatcttgaatgacattcatcatcaacaagaaaactgatacagactccctgctcttcccctacctggggaaagcagaaattgggattgcctgatacagaatataaaaaagctattatgaattatttaaaggaagagggcataggcttgcaacaataaactattaggaataaccaggatgatttgaaaaccaagtgaaaaaaaggtgaagcttctaaaagttaaaagtataattattgaaataaaaattcagtggaagggttagatagcttactggacacagcagaagaaaaacctgaaactgaaagagatatgcaaagaaattaccagaatgaaagcaacagtgtcttaaagaatatgccctatccaggatctgctggaatttgaaggcttttagttcttgaaggattcataggatctttgaatattaaagaggtatgtcttcttcactgatcaatggaagagtaaagtgcagaactgttctcactaatgaactttagtgagaaatgtttgtttttacttttgccagtgtaattatatattttcatgttattttgcttctgttctgatttttactttggcaatcaatattagtgagtaagtagtgagaagaagatggaaaataaaaaagaggcattcagaaatgtgaaggctagaataagaaagtctagtacttatctaactggagtccagtactgatgaacatgtgaagccgtaatgcataaacaacatatccaagaaggtaaatgaaaagaaattcatgcccaaacacactgcggttaaactgccgaatactaaagacaaatagagagtataaaagcaaccaaagagaaaaggtagatcaccttagaagtaaattgacaagagacttctcaacagcaaaatggaagcagaaggataatggaattcaaagtgttaagagaaaatgactgagtacttggtaatctctcaagaatgagagtgagccaggcgtagtggcacatgtgtgtaatctcaggcctttgggaggccaaggtgggtggatcacttgaggctgggagttcaagaccagcctggccaacttggtgaaaacccatctctaccaaaaatacaacaaaaaaaaagagccaggtatggtggtgcatgcctataatcccagctacccagaaggctgaggcccaagaatcgcttgaacctgagaggtgaaggttgcagtgagccgagatagcaccactgcactccagcctgagcaagagagcgagactctgtctcaaaacaaaaaacaaacaaaacaaaaagagtgaaatgaaatatctattggttgaataaacaaaaatactgaaaaagtacatttcaaggatagtaagccagagaagatatttgaacatctgtaacagacaacagattaatatctagcatattttttaaaaaagtctaaaattcarttttaaggaaaagacagttagaaactgggaagtgaaaagccagggacatacaaatcaagatttaaattcaattttatacatttcagattgtcaaaattaagaagtctgacagcaccaaatgtggaagagactacaattttcataaagcgcttgtggggagtgtacattggtagccactttggaaaacaatttggcattatcttgtaaaattttaatactcacacattgtacaacccagaaatgccacttaaacatatttacaggaatatttagagaaactcttctcataatagcaaaaaattgatatttcaaacgtccatctgcatacaaataggttaataaattatagtatagtcatacaatggaatactatataattatgaaaatgagtaaatcatagtctttcactaacaagaacttaaatgttagaaacctcataccaaattttaatagtgtcccagaaaactacatatagtataataccatttaataaagcctcmaaacaagcaaaattaaatagtatattattttgttttacatagtatgtgataaagctgtattttcttccttttttttttttttttttttttttgagacaatgtctcactctgtcacccagactggagtgcagtggtgcaatcataacttggcttactgcagttagacctcctgggctcatgtgatccttccatctcagccgccagagtagtagctgtgactacaggcgcatgccaccacacctgcctaaattttttgtatttttttatagagacaaggtttcaccttgttgcccaggctagtctcgaactcctggactcaagcgatcaatccgcctcagtctgtcaaagtgttgggattacaggtgtgagccaccacacccagcctatattttcttaaagatcaaggaaatgacaaacccaaaattgagaataatgattactttgtcaaacctatcgcctttgtaacatctcagtcacaattgggaatcacaaactaccagagatggaagtgctttctcattttatagttgaaaaaggtgaggcccagaaaggaagttacgtgacatctgtattaattccacaaattttaatttagcactatcataggcatttggattccatccaggggtataagagactattcctgccgctgaggaacttataattttaattgagcagtgagggaggggcagaaaataaacactaaaacaataataagtaaattctgtggtgtgttagaaagtcataagtgctattggaaaggagaaaaactggagcagagtaaagaagatcaagagttccagaagagaggtggggcagggacaggccacagtattaaataggttggcttagccccattgagaaggtgagatgcaaaacttgaaggcgatgaaggaaataggcaagtgtgtatttagagaaagctttcttcttgaggaaagaaagaagtcaagagtgatttcaaggattttggcttgagaaactggaaggatggcgttgcgtctgctgagatggagaaagccgcaagtgaagtgagtttgtaggggagggtcaggacttcaatttggacaggctggcttagagatggctattaattatttaaatgaagctgtcaagtaatcagaacatactcatccagagttctaaatggacgtttggagaaagtcaaaatgcatgtcaatgaccaaagcaatactaatgcagtgctttttgcaccaaacagggccagatacmtttgaaagaattagcaattaagttttatgaagatgaacacaatagaaatgaataggaatatgatgaacccaaaaaatggagtcagaaaacacgtccagttcgatttttttcagctctttccaaagatgtaaatatagcagaatattcagttggcctcaaattgacatatttgccattttgagatagcagtcgattttgtgaggatttatctgattacttctcatgttattcccatagtctctttctgtctgtaagccacaacaatgatggggcacactttaaacaacataaataagtgaaacaaattctgcaggaaattatgcaacatagagaattccaaaaaaattatccacatgtggatttttattggccctgatcatgttttagaatgaaatgattataactttgccaggctgcttagcacaattacaaaggctggggcatgctgttggaatgatttgcagagagacttaactgattacacggtgttttatttgcattacattaaatccagagcacttcttagagcatgccgaaaaccaaatgtagagccaagatccaatgaaagccgcagctggatgtggtcagtgtctaagagctaaaaaagggacctggagatcctctggttctttattttatagcagagaacatttagttccagagaggttaagtgacttgtctaaagtcaccagtgacagaatcgtgtcaagaacctgccttttctgattcccaggccagtatacctttcgctgtaggttgctgcttccatgtgtcataaagacttaaaatttgmttcttttttatccctttgcagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatggtaagtaaacagtcatcaccwtatactttattattctcattatagctgccagaccagtggacactaaagccattgccaaaaatgtgtacagtttttccaccaaatgccagaatttagaatattgcatggcgataaaacatttctcttttaggtcagtgtttttaaagttttattatagaacctttctctctgtggttgggcatctgccatgaggagaaaagagacttgaaaaatctgggggattatgggaaaaactttagtgttagaacaaatataatgatcatcatgattaatttttatattgcctcatgcattaaaaacagaattaaaatttacttttgtgtatcagtagtgtcrttctgctttaaatgtaagaaaatcctgaagatgtctgggtctgaaactttaaatggcatatgagaatttagattcatttaattttttttttttttttttttttgctgtttattaygcaaagacgagtattsgtttccttcacttcaaggaacgtccatgagttgtggaaagggtaaaacaaattatttttatagttctgcaaaacttcaaagccatagaaacataagagaataaaactttctacttttgaaacctgtgtctaaagtcaagcttatgactttgggtgtcaayttaagggaaatgatgtagaagacctgagaaaagacccatgttttcatgatctgtggaactaactcagtaaggtcctggaagacaaacgtgtttgaaaaaataattcttggtcactatttggttctgattggttgcctggctgacaaaataaattttaggtgtaacttgatagtattatatgtgtctagtattaatcagttattttcaatgcactcaaggaataaaaaatgccaacatgatcaaattaaatttgaagtttcatttcatcagctatcctattttttctttcttttgttttcatctctctcaaaactgatctagtaagaaggcagtcttcatctatatgtactctaaagcatctgagaaaattaaatttttgctctatcatgcagatacttggttttcacagtggaaaccatcaagatatttgagagtcactcattgattaataacctaccctttaaaaatagttcacaaaattctatctgtatgattactaatgggtcagttcctctaaaggcaagaatgtattttgaatagagctatcagcagtactgaacaggatggaaatttggtccaactttcctcaacaattgactacatctgctgtatacaactgtagtcatggattgcaaaataatttgctggttcagttccatcagtttcctttttatttcagacctcataaaacataagggcaagcttccaagtcaagggttgtattttaggtgatgcaatcaagttgcaataaacttatttcatcttcatgaagaaatcattgactttgaggtcattatcactgagacagcctaggaaagcatgccagttccgcttttaacactaatttttgcctattaaaaaattatcacttcacacattcatgtaaaatataattcctgttacttacaggcagtgcatacattgatgtaaaatatatttcctgttgcttacaggcattgcatacgtttacttaaaatcaatctgcaattgcttattgtttataggcaaatattatttaaaccccaacctatgtagtatggatggtataattttctcctcccataaatgtcaaagaaagctatcataaacttgataggtcatattttgacttcatatgacaatttattttatttctagagagggtcaatcttgatagggagtgtttgttcagttctagcaaaagcaagaaaatatatgaattaagtgtcatgacatcagagacttaggcagttcaacacttaaaaaattgcaaacakaactaagaaaacctcagaggtttttatgggagtttgtttgctgcacagaaaataaacatcagactaacaacaaggttttgattagttttgcctgttagctgtatgaagaaaacatttctaaatacaaagttttctaggaagttgagtcactatttaaaatccattgctttgaccaatgtgaagccaacagggttttcattcatatagaatgcctttttatcaaaagaggctctgagtgttataccaaaatcagcacccagctgttttcagtatgcgcaagaaaacatgaacgtcccccaaagcaaatgtactccattccgtgttaaccttatttctgctccctggtctctgattagtctggttgatgaatgtagcttcccctttggccatgcactcacagctttgaaggaggcttctgaaggaactggtagggaaccctaggggctcttgctaatgttgttggatagtcactgaaatcagtgatcaccatgtcctttcactttgaaaattctatgattctgtataatcaaacaacctaactcactggatttttcacttttcaaccagctattccgtgtcttacagtgctctggtcttcacagataggtaggcacctggcatgtcagttgcctgaatttgaaagttttcacctgtatgttttggtacgataaaaataaaaatgtaatttatatatctgaatcaggtctgtatgttatgatcaattgctcagcaatttcgggcagttggtttgatggttatgtagtaatgtagcctgagagcagaaatacagagcctctgggctagagaaagtataaatggcatcctaggctatgtagggttacagctcttcagaaggaactttcattttcattgtgacacatcgtctacatgttgtagaagaacatagtttcagaattcttccagttagaaacatagtttctcaaatattcactttcagcattgggtagaaaaagtacccaggtgatggactgattgatatgcttcagaaatatgttttttcctgcaagtaatgaaaataaacacacgttcttaattattttggtcatttaacaacccatsatttctggaccatgggttaattccaccgattgctcagaagccttcctgagtcatctcaagcacaatcaattcactactgtgtctagacactgcccttagaggaaagctcaaaatgaaaatgaagcagaaatacagacccacttcctaggccactcagcggtgtatgtaacttaccaagtgatcattgcatcaactactctttgttagtgaagctggtgtctgcagaatcttgataaaaagactcatggataatgttgcttctttagtcaaatgggctcttgcatgcatttttatagattttcaaagtagtcatttttgttttaaaatcctgctgccaagtcctttatagtaattgcattttaaaaatatgtcttctttattttttattattatttttttttgagatggagtctcgctctgtcrcccagtctggagttmaatggtacaatcttggctcactgcaacctccgcctcccaggttcaagcaattctcctgccttagcctcctgagtagctgggattacaggtgcccgaaaccatacccagctgatttttgtatttttagtaaagatggggcttcaccatgttggccaagatggtctcgaactcctgacctcaggtgatccacccacctcagcctcccaaagtgctaggattacaggcgtgagctaccacactggccttgtcctctttatttttaataaaattatttagtcattaagaattttggcttgtgggccrggcatggtggctcatgcctataatcccagcactttgggaggccraggtcagaggaccacttgagctgaggagttcgagaccagcctgggaaacatgacaagactccatatctactaaaactacaaaaaattagtcgggcgtgatggcttgtgcctgtrgtttcagctactcgggagtctggagtgggaagatcgctttagcccagggggtggaagttgcagtgagccatgattgcaccactgcactccagtctgggtaacagagcaagacccagtctcaaaaaaaaaaaaaaaaaaagaattgtgactagtgaataattcatattcagagctctttttaatgtatgaactaaataataaaatagtaagtttaggctaagtgccctttttatttttaaaattttctgtatttattattactatttttagagatggagtctccctgtgttgcttaggctgggctcacctcakcatctggagttgctgaaactataggcatgtgccactgcacctgacctatttaagaaaataatctagagaagaattgacatgttatttatgaatcattcagttaggttttctctataacattgagatttggttaaaaatatgtttttcataaatttaaaaactattgaaatcttagctttgctgactaggatgtcttattatataaatgagagagagtttgtaattttttaaaaaaaactgacaactttcaaaatagtttctcagtggcttcataaaaatccagaaaaaaagatttcacaaatttttgtgacactcaacatttttaaggtagttctctcagtgccttgcaaacagcagctctagtgtatattgagaaaaggaaaaattctgaatggcaaatactagatttcaactttaacctattcctttttattattattattattattattattattattattattattattattgagacaaagtctcgctctgttgcccaggctggagtgcagtggcgcgatctaggctcactgcaagctccacctcccggattcacaccattctcctgcctcaccctcctgagtagctgggactacaggcgcctgccaccatgcccggctaattttttgtatttttagtagagacggggtttcaccgtgttagccaggatggtcgcgatctcctgacctcatgatctgcccacctcagcctctcaaagtgctgggattacaggcgtgagccaccgcgtctggctaacctattccttttttttctttagtcttcttggttgtgtaaagaaaaattacccaaatcttaactttcagaaaaggtaacaaactcctaatgcatgtggcagtacatgtttgctccagctgccctgtccctctaccctgcgtggactccagaaccgcccatgttggagcccacctcctytccccacccctgcccactttccactcacacctcaggcaaaccctgcattttgctgttcctggaaaatggcttatgcttggatacctctgggcctctgttgatgcgtctgtctgttccttgtggaaattcttcctgacattcaaggctgcattcaaatgccttccttcccatgagacttttctgattccctgctcttccttttctatgtgtttcataccttcctgtgatatcacattctgccttaaaaagcaagagagtgatcagatacatattaccaaaaaaaaaaaaataccgatagcagtaaaaatgatagagaaaagactggaattgggaaatccatctgaagaccaatgcaatattaggaaataagacattgagaagggtgagaagaaaggaaattgagagaaatatcagagcagtgaccaatgaataaaagcgcctgaagggagagaagttgtcaaagattatttaggatatctaatttgggtgatagaatgaattaaccaagagaggaacacaggaataagagccagtttggaggagaaaattttaaattcagttttatattgtgttagagatgcctatagagtatccagcaactacgtatagaggaatataggaggatgtgaaaaataaggctccaaatttcagtgaagagagagcaggaatcatcagcacccattgtaggttagagaggtcacactagggaccacagaatacaagctaagggagaggcaccatcagagagatctggagagcagctggcagaatgttagaggacccagaacagcaggaaccaggacaagaaattttggaartaagagggcggagatggtcaccagaattaaaggctgggagaatactgaagagctcaagtctattgagaacttagaagaggccattagttctggccgagagaaaagcattcaggatttttacaaagttttggtaaatcccagtgagcgcaaagctagactgcagtagatcgagaagtgaatagaaagtgacaaacacagacggagtgaaaacaactctttcagtaagttcagtggtggaggaaagatagcttaaagaggaggtaatagtagagtcagaaccttcaacctgggcagaaaggccagagccagtacagagaggcacactagagaaagactcatctgtgtaatatacccagtctcccctaccagacatgtcctttccatcctttcccccagccccatctgtgcagcacagtgttgcatcaacgaagtgttcagtgaatgaattaaaggttgtcaggaagacttcagggaatcagagattgagttagaaggtgagctggtggtgttttgctcatcttcatttttgaaagaaacctaagaaaatgtttaaatgtcctctacaaatagtgtgaaaaatggtacctctgcataaaaataatttaatattagtgctaaagttgctccttgttttcctttagaggaactacaaaaggatagttattagattgccaaatcctgcagaacctccagcaggcacaagttggtttttctccctcaagaaagagaagtgagccaagcgtggtggtgcatgcctgtggtcccagctactcaggaggctgaggtaggagcttcccttgaacccaggtgttcaaggctgcagtgagccaagatcacactactgtgctccagcccaggcaagagaatgagaccctgtctctttaaaaaaaaaagaaagaaagaaagaaaagaaagagaaaggatggaagggaggaaggaaggaaggaagggagggagggagggaaaaaggaaaaaggaagggaggaaaagaaggaaggaaagaaagagaggtgagccaggtgtagtggctcatacctgcaattccagcactttgggagactgaggcaggaggatcacttgggccaggagttttggcgagatcccatgtctaccaaaaaaaaaaaaaaaaaaaaaattagctgggcatggtcatgtgtgcctgtgggcccagccacttgggaggctgaggcagaatgattgcttgagcccagaaggttgcagtgagctacgatcatgccactacactcccacctgcgtgatcgagaaagaccctgtctctaaaaaaaaaaaaaaaattttaaaragagatgggaaaacaacttattggcaatagcacatgttcttgtttgtatgcaacaaacatataaaaagtagaaaaattgaccataagacatagccttactatttttcaaaagcctgataatgattgcaaattcatcccttagatgtggaaagacaaaaataagacttgtcttatttcattctgttattttctattgatttattattttgaaaacctgctttaattaaccttagtaattaagtagcatttgtctttaatgcttctacaattaggtagatgttttaaaaacatgccgattaattgtttcttagcgttatacccagatccaaaaagcaggacatctaactattccatgtgcttggtgtttgtgtgttcagcaatatcagtactaaatacacaatacaaatctataacatgctagtagtagctacattcagctcaatagaagtgtgttgtataaaggaatgccaatatgctttcccagaagttaatgagtctctatcaaacccagtcttcctgaagggagcctaccagctctgatatggataattttttttaccaagataccagatttctctgtaggtgatgaattattccaaataggaaactgcgtgccagtgttctggaagttgctctgtgtgacaggtgccagatctgtagaacagacagaatgtaattttttttgagcctcaaaaactagacaaatactgcttttaaaaagagagcagagcattttcttgagtactatgtagacatttgtagaactttagagctaaatttagagctagaggaaggaaactttagaatcttcttttctaagttcctcattcagtaaataaatcagttgaagaccagagaagttcagtaattttcttaaagccacatagctagtttgtcactgagctgaaactagaaattaagcttcctgactgcattcagtgcagtattcattcccttgctttccagagaggccaaaagttcttgctcagtgactcacagtaagacatgaagcattttccttttaagattaatcagcagtggtagaagatttggaaaaatacacttgtatatgagtacactcagcctttatagttctgacccccaatgcagaatgttcatcttctatttctaaggtctgacttcagtctttcaggaaacacctcccaacctccttcgctttcctcctcttggttgtcagattctccacatgaagggtagaacctraggctcaagaattacttaactaaaaaacaccatctcacaaacaatttaaagatggaaagatagaaatagagataggcagacagatggacacatagattaggktttcagattctgttctttctctgtgggagaggtcagcgtgccatgactaccagcctggtctagaacccacagcagccatagttaccaagaccacagcaataaaagctgtgtttgttaagcattgccatgcacctagcactgtgttaaacacttcctgtgcctcctctcatcacctcacgtgaggtagataggtacaattatgtgggactcaaaagcaacgaaataataaaactggcttttttcccccttaaaaaaggtatgcgtgcctcagctgaaagacagaaaaaaaaaaaaaagtaggcaaataaaaatccttgttttctgtacaatttcagatttgtgtatgttttatgggaatttagtctcaccaaatgggatcgatttttcattccttttatgaacttctggtgtataaaaatgttaaaatcacctatataattggttgcactggtagttaaatggaacctaatttgtagcatgggcatttaacaatacagataatttattcattagagttagcctttggggggaacttcaacttacaaaaatacgttttagtgagattatagcagagggatctcactttaatatatcctaattctaaaatggtttttcggggtattttttggttatatttgttaggtgatagaaaagcaagactagtaaatgtagtaagtggctatctttggctgtttgtccatttaaattaacttttttgattacccattaggaaaaaattgcttttctaggtgtgtaaagttttgcatatgattatagcctcttacctgtaaaaactgaatcagagcttagaaccatgcctggykcacaatagtcattcaacaattattccttgaataaagagacagtattgtgtggtctgtgaaataacaaaagttcaggagcaacagacacttggtgattctagtcacctctattttgttataggataactggttttctctgagttttacaccagaatgccttcttcttttaatacgccttcttacttrgtgcttttctcatgatcattttcccaaacttcctaatggacatagtgtctcattttctgtctgtttttaaacctgatactttggagtttaatccatcaaacatttattgttaacctactatgtgtattttgttacacctaggaacaaagatgagaaaacatgttactcatataatttatattcgagtagaataactgatataaaccaacatcatagtatagtaacagtttaatacatgagctaatgtatgcatacaacaggagcccagcatttaggaagctttttataaactgtcccaaaccccaggttttttatatactcctaattgagtggatggatggcccatcaaaatgtcccgtggaagacatataatgtcagaagttaccgagtgactctgataggctctgcctcccctaccctccgcactcctcaattaggaactactggtgaacaagaaatgaatgtagtacagccatccctccttattccctgggattggctccaggacccactcagataccaaaattcctaaatgtgcaagtctctgatataaaatggcatagtatttgcatgtaacctacacataccctcctgtatactttagatcatctctagatgrcttataatatctaatacagtataaatactgtataaatagttcctatggccaggtgtcatggctcatgcctgtaatcccatctctttgggaggtggaggcaggaggatcccttgagcccaggagttcgagaccagcctgggcaacatggtgaaaccctgtctctacaaaaaaattaaaaattagccaggcgtggtggcacacacctgtagtcctagctactcaggaggctgaggtgggagaatcgattgagtctaggaggtcgaggctgcagtgagccatgattgtgccactgcactccagcctgggtgacagaacgagaccctgtctcaaaaaaaaaaaaaaaagttgttatactgtatttttttatttgtcttattttttatcattgttttatttatttattttagagacagagtcttgctgtcacccaggctaaagtgtagtggctctatcacgactcactgcagcctcaaactcctgggctcaagggatccttccacctcagcctcctgagtagctgggattagaggcgcacaccaccacgcccagctatttatttttatttttatttttgtacagacagggtctctctatgttgcccaggctgctctcaaattcctggcctcaggcaatcctttcactttggcctcccaaagttctgggattacaggtgtgagctaccacacccagcccatattattttttattggttcttttttccaaatattttcaatccacagttggttgaatctgcagatgtggaacctgcgggtatggagggccaactgcataaggaattctatctgagcaaagtggtcaggaggtcacagaggattttgaaggaatatgctatctggggttttctttccattgtatttcaaaatacagtagacaaggacttaatatgtgccagaaattgtactaagtgctgaggatmcaataatgaacaagattcctgcctttgtggagattatatggcaagggaggaaagaaaacattatagattaattcctgtgatcagtgctgtgagataaggtcatatcctgagggacccagacaagcctagcaccaggggctggggtcaccagtagataaaaatatgaacaaccataccccagccccatggaacaacacagaaagaaaatggggaagagtgagtagggaacaggatttttgaccaaaacctcctagtttaaaggtttctatatgaagaggccatgtaccaaggatatattcactaaaagtatctaaatataggctaattcaatttaaaggaatcccaactgagaggtaagattttcttcccctctaacacccaagtctggtctctaaggaggcccctacmaaacaatagttgtattagtcagygataaaatttatttasggtcaatggaaatgaatttatgaatttgagactcaagggtacatgtcagtttcttcttgggaaaatccaaggtaatattcacagagtactcagatgggaaagttgtcgtgtgctgtcatgtctcatggtagaaatgctacccttagcataataacatrtaaaataactatctctggctgggcacagtggctcatgcctgtaaccccaacactttgggaggctgaggtgggtgaatcacttgaggtcaggagtttgagacccacctggacaacgtggtaaaaccctgtctctactaaaaatacaaaactgagccaggcatggtggcccaccccttgtaatcccagctactcagaggctgaggcaggagaatcgcttgaacccaggaggtggaggttgcagtgagctgggattgtgccactgcactccagcctgggcgacagagcaagactccatctcaaaatataaaataaaataaaataaaaatctctttgttctgggattcagcagagacagagtcttgctagagacataaacaaatatgacagtctctgcgctcgaggagcatatagtctagtgaagccgatcaccataaaaacgcatggctgtgataccacatcgtgagtgtaagaacagagctatgtatgcrtggggaacagtggacatgatggccaggtacccttattatgggaaacatagaacccaaagtgtgttcccaaaggaacatgattcaaaataatattttgctgaacatattggtaagaaggaaagaaaacatatctgagttgaaaagttacagtttattttttccccaaactagtccccactaacccctcttacattttccttgttgcttttctttctttcattatcttctttgacacttcctcaccctacaggcagccagtttgtctttctgacaaacatcattaagtggtaactctggagagtcgggagataactatggcttctctccgctacatgtaaaagtgctctctggactagtaaaatgtgataaagcaccatccatatttctttttaacagagacaaacaaatcttataaactccctgagaacaaagcctatgtctgtacaactttgaattctgcacagtttcgtattttaattcgtgaaacgtgttgatccttctagtgcctgaccttaggtcaagtgctggggatacaaagaaggtgacctttgaattgggtcttgagggatgagtaggagttggttctcaattatttcacgtttaagtcgacatacttccctccctttgctaaactcgaattctttcactttctcagcaggaktatgcattaacttttaaaaatgaaagttaacggtttaatttttactgatggtctgtgctacttttgtgaaataaaaacatgagcaaagtggtagacagaaaccaggactcaagagcagtggaggaggagggcttctactgtgtgggaacgagggctgggagagcacagtgtgtgttcagagcagtagtaatccaatgattcatcctgtcattcctcttcctctatagccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcagttagttctcttctgctgtcttcattgggggaggcgggaagttgttttgggtttttgtttctttgagtaaatggtttactgcgctacaaatgcacacacagaatattgttcaactgttggctgttaacatattgcaggctgagtctgaaacgcaggaagtgttttcagatagcacaagtcaacattattttgaaaagggagaaaagtccataaagtttttgagaatagtgtaasaatgtattggtcatcctaactttaatgaatgaacttaagccccctgagcctatcaccctcttttaggatccatctcctttytcggcatcaaaataactggccacagcaatattcattcaagcagccttgctttccyctgggaagaacccgacctaggtttagaaaaggtattgaatcccactatttcacctttcaggagaactaccagagttacctctttttttttttttttttttttttttgagatgtcgtctcactttgtcgcccaggctggagtgcagtggcacaatctcggctcaccgcaacctccgcctcccaggttaaagcgattatcatgcctcagcatcccgagtagctgggattacaggtgtgcacgaccatgcctggctaatctttgtatttttagtagagacggggtttcaccttgttgatcaggctggtctagagttacctcttaagaagttcaacatgaggcataaaaatagattctagatattatgttacctttctttccttgtagcattcttgattattccggggcaactagaagctctatccttttattacatatgtgaattttatcttctgcaaggctctgagctgcctggactacttcagtggactctccaacatctgttcactcattgagcagcactgtttagaaaacccagaatgggttgtaattgttactgagttaggttttccaagcagcagagctcttctctgactggaaactgagaaaacaacatggaattatagaataaaattgtacctgaattctagtcccaattctgccatcagcttggatgacctggatcatgtctctgtacctcagtttgttgttgttgttgttgttgttgttttgagacagagtcttgctctgttgccaggctggaatgcagtggcgtgatctcggctcactgcaacctccacctccctggttcaagcaattctcctgcgtcagcctcccgagtagctgggattgcaggcgcatgccaccatgcccagctaatttttttgtatttttagtagagatgggttttcaccatgttggccaggatggtcttgatctcctgacctcgtgatctgcccgcctctgcctcccaaagtgctgggattacaggcrtgagccaccgcgcccggctttgtagctcagtttttaatgacagggtttggcttygattctgatgtctgcacarcgctcccagggctgtaagaactgcagaacacactgagaagacaccgtcccagccatggaaagcccttctatgcagtcatttattttcacatgaacacctcccagagagctatgcaatgacttgatagatatgtgtaacttttcccctattcagatatattgttaggaaaatctcattaacctttcatgtattttgatgactatctcaagatggtagttcttctgtttagctaaactagtaagagtagaatcagttaatagaaaaaggaaacttatggcataaagccatatggtaataaggacaatgagttttctgatttgaaaataggtctttgatacctcaacaataatatacctggattcaattctttacagtataaaaaaaaccttgcacatttgttaggttcgagccacatgcacctgactactgctattattatcctctttattttagagatgaggaaaataaagtccagagaggttaaacattttgccctaagaccccacagcaagtgkgtagaagacctgggactataatgcaggttttctggcctctagttcagagcattcgtagcatgctagcccctcagtagcatagtactttaggaagctagtctttcccacttgctggtagtaagmcagggagacataatacactaagaaagcttcgstctgagaaaactttccatgattgttttttctcaatttttagaacagtaggaattcttcacctcatctgctatcccaacatattcacaattggaaaatttttgtgctgttmtgttcttttcaaattacaaaagtccttgactaggactgctggcttttacatgcacaggactgcacaacactggtgtttataaagctcattcgttcaatgataaaattggccatagcaaatcaaaaataaatgaagacctctgcgtagctgattggactacagaaaataarccattcatatccaggaagaaaaaattaaaaggattgctgaaaaggaaagagccctaaagcaaactatctacagttttggttagttttcttttcttttcttttctttttttttttttttttttgaggtggrgtcttgctttgttgcccaggtgggagtgtcttcttatattggtcaggctggccttgaactcggggctcaagcmgtcctcccacctcagcctcccaaagagctggtattacaggtgtgagccaccagccatggttagttttcatcaactgctttctcaccttcttttcatcctctaattcatacctgcaatccttattagaaatcctgtcaacttaatagtaccagaaagtcaggcaaaagactgataaaaaaaaagcctcrgtggtcaagaacttaaaattacactactggtgtgcaacgtgctcttatctgtgttactggaggacaccctcaagatacctcactccagttgactccttggctctaaatctttgagttaaaaaataaggaggttctttatggaataaacaggtattaagctatttaaaggagagggctgcgaaatgcttgattatgggcttttcaagttcagaggccaagcgtttgtcattttcttccagtaactaggactgtgtcttgcccctaatagttactcagactatatttgcttaattgaattaaacacagttgcctatgccctttgaaattctggactttcaacagagggcctctagcccaatatttgcttaccaaactggacatcattgatgatctggattcaggcagggtctggaaaaagagagactgggccaaattaaaataatccattcactgatgacacaaaactaaactacaattgtttggcaccctctcttctccttatcttgcaaaatcaaattaagcactagtggaaagaaacagttcagagaggaatatgggaaagrraaaaaaaaaaccaaaatgtgatttccaacgagactagagatttgttctttatctacatggtcatgttactcatttgatagcatctatctcaggggtattatgttatctcttggccaggactcatgaaagttaagatttgcattgataggaaaagttttgcagaaatatggactcttgagagggtgggaggtatataaaagtggctatggctgtgcagcagagcaatttgcatttcttatacaccctgcttgagactgatgtcattagtgttggttaggccaaggctgggggaggctactcagaatagtgggtgaccaattacccagaacctttggaaaaggaaatgacttgattgaagaggccattctttaaatgtatcttactgctcaatttcaccattgcctattgtagaatgcgcsctgcccgctcagcatttgcctctaggcagaccaggactccttcccctccccaactaatcttccttctcctgtatcttattccctagggccacttgcacctttcaaaatggataaattaaattcccctgctccccttctaccaactytaacatcatatccttggtgtatgatgccctacttttcattgttttgcctaaataagagtatgcttgggaattttaggcttagggctgggaaaagatgggatatggaatcgtcagctatagattgccggacaagaaattttaggagcagtagacctttcaaccgccctcaataggatggaactgactgtccccacaacctatttccctttcagtggcttgctccagccaaggccccttatttaagagatctttgtgcgctctgaaaaccatgcatatgccagaactaggtgctctgtttcatgaaggcagtttgataactgaatggactttggaagtgcccagtgtttgactattaccctggtgcgatgatcacactgggcgtatcattgtcacatgatcccatgtttgttgatgaaaataaacagtggttttcaaaaaccattttcagtgccatggtttgtcataaaacaataaatagaaaagcgcttgatgtacctgccaacttttcacccctatctaagagatggcgaagctccggctgcactctgtctgcaaataaggaataaaactttttatttgtgctatattggactttgggttccaaagcatcacattgtttatggtaggtacatgtggagtcactgtatttataattataagagcaaactggtgccattggaaaaaatggtctttctaaatagtgtgtgaaatatgaaactagtgaagaataaaatcaatatggaaatgtaaacttctatgaaaacatttccttacccatttaagtttgtgcattctgaaatttacaatggccatcaaacccagtgactcaaagctattggaaagatatctgtccttttaaatcctacacttacagctaaacaacgtatgggttcttttccctttatctctggaaaagcccgactgagctggaatttgctccccaaaggaaagacatcaggcagaatcctcagagaaaggggcttagggaccccagtagaaataaaatcaggatagtagtgccaattcatttctggggctgctggagaagttaggcttctgggatcattcatccatgtatcaatattaataaaataaattcttctattgccaggactgtcaggaatagctaaagatgtaaaagatctaaaccagtgtgttctttcagagaataagttaaaaataatattttatagagttaaaaagaaaagcacttggattttttttttccaatggctggactcagttggccaatacccttgtttgcctgctgagtaactctttggctggcaattgatttttttaagagctgtggttatgtgctagttcattagcatgtgaataattcttcatattaagttttcatttgtttgtcgtaaatctctaaaccctgcaggaaagcagaatatctttgacagctttcaaacttcacttctatcacacacagcactccaccagcacctctaggaaacagtggttcaaaaggccctgccccaagaccccagcatgttaagagcgttagtttaaaatctccagttcatcctagaacaatcattttaaaaggaaaaaaagaagtggggaagtcctatagaaagcaatggaaagggaaaagttctcaacccagaatcggggcttaggttctagttcctggtttgctataaatggcactttgactttggaatgtctctggcttccgtttatccattagtcagagaatgatgggacagattacttctgaagaccccttatgtcctataaatctcatagttctcaacaagagggaaacgggaacaacaggggcagaaaccaacgagabgctgaggaaaccaaaccaatgagttttggattgtagctaaccgaggagaaccaggtgtgtcaaaggtgatgaaagtcagatgtgtaaaaagcaagaaggaaacaaaatgaagaacatgagccctaagaattcagtgtctttccctggtaaaactaagaacatcaggaaagccacactcgatgaggcacacatttttccaagccagttttcactctgacagggttacctcaagtgattgtttgagagagggtagaggggttgactacactcattcaatctgccaaattagaaaagtcacccagaataccctgtgctttttgagtgattttcatgtttatctcccgtagcttgctattttgttattcaaaaggagtgtaaacttagggcattcatgtataatacctttcataactcatgttaaaatgctgatgttattggatttctcaggaacactactgttctatttctccattcaaaaaggtaaaaaaaaaattaattactctattttcatcattaatcccatttcccccattgtctttgtattctacataggaagcatgccatagatctataattgaatttactcatctatataaaacagtacttttaatcccatcctgaaaatcaaaatatatttttgaaaatcaaaatatgtcaaaattgaaaatcaaaatgtcaaaatattgaaaattgaaatatatcaaaattaattatatttgatgtatccctcaaaaaattgatttctccttacagaaatcattttgctttcctggaaaaacactgggttcaagtgcagctttcttcattccgttctggtctgtccagtatatgaaaagcacaagcacacaatgaccagtgacagattcaccatgaagctaatgaagcttcatggggcccttcccttgtgcagaagtccttccagtgcttggggaagggccgaagcaattttattctcataatttgtaatattttccttagagagactccactactgtgtatattttatgccccacaaaacctgaattcaccccatcatgtcccatttgtaattaagctttctttcctgttaaggagggacgcttacccagccctttgatgtacggtctgaagataaatacactgttagcccccaactagaagtgtaaaatcattaagacaaaatttgagaatgatacggctcctataatggcaatctttggatgatactgkccaagctgatggaaagtgtaaggactccactttgctttgtaaaaaatacaaaaaaacagccatggaagtgcagtacattttgtatggaacattgtaccacattgtaccaaatgtcatgttaaattaatgattcaagataaaatgcagaccaaatttgaccagggttttaagaggttctctctccataaagcaggctggccacgatcttctcactaggtttgagggtaaggaggtcccctgtgaaatatgaaagtgaactctctgctatctaagaattggtgaattggttgcaaagaaaggcagaccaggcccacccagggatcactcttgcagtttgacagatctacctggaggctgaaagaatctatgcagccttcggaaatgcagtgaaaacagtataatcagatatgactagggaaaaaataaaacaactggtgttcatttgcatgtcaacacccagaattctctgctagttcacctcttcttcagaatgyagaaaggattgaaaaagctggaatggggccgggcrtggtggctcatgcctgtaatcccatcactttgtgaggcagaggtgggtggatcacctgaggccaggagttcaagaccagcctggccaacatggtgaaaccccgtctatactaaaaaataaaaaaatttaaaaaaaattgccgggcrtggtggtgggtgcctgtaatcccagctactctggaggctgaggagaatcacttgaacccaggaggtggaggttgcagtgagcctagattgcgccattgcactccagcctgggcaacaggagcaaaactccatctcaaaaaaaaaaaaaaaaaaaaatgaaatggtttggcatgatggtggggtgctgattcctctctctgtccttgagtatttactgccaggaaatcctgaccaacatcaattgccaaggggttaaagtcacattgttgttaaattgggagagaaaattagcaggattttgtgccctatgttcaactattacagagtttcaaaaacaggaacctggagctttatatgaggggacaggggaagtaaaggggaagagtgacaagggtgatttatcagggcatagttccagataaatcacttacatggaggtgaaagaatttcatgcatatgttctgtgccaagaagccaaatggttgagcagaagctctgaaagttgaagtgggcagttctgggtacagtctttccacatgtgaaaaggtgatgattttatattcatgttatttgtactcctgcatgtgcagttggtcttttcaggtgtccagatcatcattttctcatgacatgaaagaaagccaataaaggctagttgtggtggctcacacctgtaatcctagcacgcacttagggaggccaaagcaggacgatcacttgagcccaggagttcaagaccagcccaggcaacatacatagcaagacctcatctcaaaaaatgaaataatttttttttagaaaaagaaagtaaatatttcattaatataaattataatacactgtaaaatgcctggaggacaagaaacacgttttctctaggttctgtgaaagcatcattatccattcacatttttctcataattagaacctgacgttctggaaaaatacagtaaattttcatcgatgttacttgctctgccccccttgtattcctcccattaataatattaatcctgaaaagaaaaaaagaaaaaggaaagaaaccacccaagcaaaatgtttaagaaatacggtaaggacagtttggtcccaatttccttaaaaattagagccaccaagtaaacctgtttgggggtcctcacatctgtcctcttttggagtttgctaagtagtacagttgaagtgaattttttggtaacaaaagtaaaaacttccagaataactccagtaaagggtgttgatgtgacgtacaagtttggaaatatatttaatatctgagactcctcaatgttggtgttatttcctccagtttagaacaaacttaatcttttgatgaaaatcatagagttccatagatatgaatagaatctccaaccagtgcatcttgaagccggctgccacggccactcatgcaccttctctcctttcaggagagaattgtcagcatctctgctcaaaacaatctttacttttagtccatcagagacttcatgtttgtcgtgcatgcacactcacacctctccacacatatgcccactccccacacacatcctgcttctgagaaatgcaactagaatttcctccggagaagagatggaaacccctgattgagaaatttaaggcctaggaaaggtaaatgacttttcttaagtcwcatggctcaccacagaaccaaagctggaacacacataccctcagctcttcttccagtgctttcaggtatacaagtatttgaacaggattcaaggtttaactccttatgtgtcattcagtgtatccagtgtaagtaaaatgttaccccttagtcagaacagccttgagaatttctcaatgactacaaaccttgcttagttctatacaagggaagtaaaagagagagaatgtcatgaccaaatgacttaacttttgaaggcagcctattgcaaacttgaataattggggcatgtattttattgattgtttgacctataaggacagatattttaaaatataaattcaaaattgcttttttgcagcattcacctgtaggccttctatatctgctctttgtgaaatagatggcttccagagcattaaaaaaagaaatagacattttcttggttcaagagctgtaatctgctttccgagtgatttttcatagttaagcatattttatgtgcacatagtttcatttgagatctgagaggatttcatctaaaacggaaaagttattacctgtgaaggagaacaaaggaaaaggaaaaagaaattttaagaaaaaaawatttttttaaacctgtagttactttatgttcaagtgggtattttcaacgctgagttgctgaaatggttttttattgaaagaaggttaaaagtgtatttcattgaaagccaagataaacagtagattttgtatcattttaaaaatcaacaatcggccgggtgtggtggctcatgcctgtaatcccagccctttgggaggccaaggcaggcagatcacttgaggccaggagttcaagmccagcctggccaacatggtgaaaccccatctctactaaaaatacaaaaatcagctgggtgtggcagtgcatgccagtaatcccagctacccaggaggctgaggcacaagaattgcttgaacctgggaggtggaggttgcagtgagccctgattgtgccactgtaattcagtctgggcgcagagtgagactctgtctcaaaaacaaacaaacaaataatataaaaatcaacaatgaagactccccaaacaaaagaaatcaggattcttagccagtcataggtaaagtgttacagtgtaaattgaagggaaagaagaccaaaattggtgaaatatgtttggtcccagaagataattaagatgaataaaagaacttgagagtattttctcattattaagcatcttcagctttaaagattttagttagcaaagcaagtttacataaacagttttctgaacctgggatggcattcactgtgagttagaaatctccaagtcatccacgttttccctgttttatttgcagccattcgttatctatgacatgaattccttaatgatgggagaagataaaatcaagttcaaacacatcacccccctgcaggagcagagcaaagaggtggccatccgcatctttcagggctgccagtttcgctccrtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagcctttwggtgactttatggagcccaagtttgagtttgctgtgaagttcaatgcactggaattagatgacagcgacttggcaatatttattgctgtcattattctcagtggaggtaagatttgtcttttgatcttctatgaaagagggtgggatgatggtggggtggccaaaagaattttggatttccttagtgttagtctgcattgtcactttaagtgccagtggcatgatgccatgaatcatcactacacgtgcaaaacactgtaccaagaaagagtgtcataggtttgcggtgtgaaggttataagtaacccaggatcttctctttcatccctcaacaatatattttttccagtcaaatgccctcttctcctttttctttttcttttcttttctttgtctctttcttttccttccagaaaggaagattagaggccagtctaatctttggttcctgtaagtaatggcatgtataactttgcttaagacaatgctcacttgatgtagagaagggaccactaagtatttctggtcaaatcatgctcctgccccaccatcagtaagatactactttgaattgcttttgtgatatcaggaattaaggaatacctactgacctccacccactctcttgtgtggattcctctgatggcttcccttaaagtacctttgtgaggtagttggttgtgattaagaatgcaatgtgaaccgaacacacaacatagaaataaatttagttatttagcaatttgttgtatttttggccctgcaagtagtacatgatctgactaaccaattccaaaagccagattttyttytgagtgtgacttttttcttttttttttcttttttttttttcctttttttttttttttttttttttgtgagacagggcctcactctgtcacccagactgaagtgcagttgcacagtcatagctcactgcagcttctaactgcagttagtaagctatgatcatgctacttcataaaagtaatacgtggccattttacagttgggctcaagtgattctcccacctcagcctcccaagtagacaggacaacagctgcacaccaacatgccctgctaattttaaaaatttttttgtagagatgaggtctcattatgttgcccaggctgatctcagattcctgacctcaagcaatcttctcaccttggtctcccaaagcgctgggattataggcataagccaccacgcacaatctaaacattactttcattagcctctcatgagtagaagaaagttttactttcatctctctgtataaaaattgtttttaagtggcaagttttcctattgaagtggactttaggtgagctttttgtatgtactctacagtgtatcctctgtgaaaaacccgtcgggggatagtggtaaactgtatataactgcacaatgtattataaagagcacgatccctttgtcatcttttgttgtccagttgaaaggagaatgtttctgaaatcaggtgcatagtgcagtagtcataagaatagcaaacatttatttaatacttgctgtgtgccaggcagtgttctaagcacttcatgcatatttattcaatcctcacaacaattcagggaagtaaggaccattttacaaatgaggaaaccaaagcactgagaggttttctcatttgcgcaaggttacgtggctagcaaaagatggagacaggattgtgagccaggcatgctggctcagactctacactctctaccatcacatcatgcggaataccggcctttaaatgcctagggtgcaaatagatcacagtatggcatagtttacctttggagctgtgaagtccagggtcaagtcgtgattcactttaaaataactacttgatattgtgggtttttgttgttgttgttgtttgttttttgtttttttgtttttgaggcgaagtctcactcttgttgcccaggctggagtgcaatggcacaatctcggctcactgcaatctccacctcccgggttcaagggattctcctgtctcagcctcccgagtagctgggattacaggcacatgccaccacactcggctaatttttgtatttttagtagagacggggtttcatcatattggtcaggctggtctcgaactcctgacctcaggtgatccgcctgcctcggcctcccaaagtgctgggattataagcatgagccaccatgcccggccgacgttatgtttaatagaacaaaaatatactacctggcatggtttaatatcttgaccaaatttacttcctaaattaatccctggctgtctggtatctttgattaattcagcaaaaaaggatgagattccagtatataagaggtttgccagaagaaaaatattaaattttgaaaaaccagattagaaaaacagttgatattatttatctagtattttattttacttcattttattttattttattttttgagatggagtctcgttctgtcttgcagtggtgcgatctcggctcactacaaccgggttttccgcctcccgggttcaagtgactctcctgcctcagcctccctagtagctgggattacaggaatgtaccactacacccagctaatttttgcatttttactagagacagggtttcacaatgttggccagtctggtctcaaactcctgacctcatgatccacctgcctcagcctcacaaagtgctgggattacaggcatgagccactgcacccagactatttatctactattttaaggcacattttatttttaataaaatttgaaaatatattaatatttaatttatttcaaatatttttcctaagcatactatatatcycatgtctattcttttcacttagtcaatttcccatgtcattacatactctttgttaatagtttttgttaactttttaaataaaagtattacatggtcattttataattgagagtacagaaaggtataagtgaaaagtaaagggctttgccctcaggataaaatagaattaacaaagtcctatttttcctatcaagaagtttacatgcacactcatgtagatagatacatacatacacatatgtgtacrttcatagcagtttgtattcctacccacatatacgaagggaagcatttgaaatgagccattcaaaggtacttagtttctactaggcaaggtctagacaagaaacagtcatgagaattctgggctttatgaagtgagatctgaatctcaggcatctatcgaggatgagatccacctccccgattgtgcttccttagagtaagacaaaatttctcaattagtttttcctcctattccagattttccattcagctaagcaggaggctttcatccactaaacaaatttctgatcctacccagtcttaacaagagtgattgtkttctcctctgcaatttattcgaaagtctatcagttactttggtggtttcagaaagaagtgcttttgttggggatccagttggcctcattctragctggctgtggattcacagaagaacttcacttcagcaaaggctcttagggccccagactaaaagaaagatgagcaagatgtgcgtcatctaagagtgggcgggggtaaggaattggggattaatgggggtgtccctagaggacccaaagaggagatttttagatgaaagtaactgatttgacccaactcagtatttgctggggaaactggagttgctacctaagattgctgccattgaacttcagccttaaaaactgctgataccatttgattggtacttagatttgcctgggcttagcgtctctgctgttcactcagctctcaaaccaagctgctgagaaagatgacctagttcttctcgagtctttctcctctctctctttctcccctgagcttgggggcaagaattagactaaatgaaaggaacagcaacctattctagaaccaaagttcaggacttggtacctttttaagggcatttcatgttcattctctcattccatcctgacagcgctcctgggcttttaattctcatttcacagaaagaaaagtgagggtcgtaaacttaagtgatttgtctgagatctgacaaactagtgccaccgtggaactaacactgaaacctgggtgtcctaactgtcccctctggccctggccagtggactgtggtcagcacactcactcttgtgttggtggctgcaacctgttctctattcactatatccctaaggtaggcccatacctagaagccaggaacagcgcttccttggtcatcatggtaaacaataacttcccttgcactccctagtcttactgacaggctgggcggtgtcaagagtaataaaactgcctccagcaaagccatgtttgcaactggcgccgcagcatcatgccagccaccctagcaaactcccaaaacctacccagcagccaaagccaagcgtaaagctcagtgaagctgacaagccccaggacactctggtggatgttttgcccccttgagtgtttgctgttttgtgaagaaaaagtgtaggagagttccagctggaactctgcagcaggcaaaagctctttttgttaattcaaaacagtttggaatccatttcagttcttcctaaacctccaagatacgggggaggaaattcactggrttttacaatatatttttcaaggcaaattgccatcgccgtcctaatgacagagaagctgccgatatcactacaacggctgcagatggcaagtcatccagcctcctcctgtgccctcctgagtctggcttggtgacgcaaaccacctcaagggcagctccttctttttccagcagtcccagcactgttccttctctgtgaagccactttggatggctattcttggcatgatcatagacttttctgctgttgagtgggcaaggagaatagggtagaagcaggggaattgttctcattgctatgcatttatagatcaaagaggagcagatattttatgttaattggataacacctagttctatcaggtcagtaacctggggtccctggggctcccccatgggtcataccagatagatagattttttaaaaatttgttggaattaaagtagaatcaaagcctagtgctagcccagaataagttattcaataaatgcttgttgagtgaataatcatccgaaatgattataatactgcctaccattcrttgaaagcttcagtatgtgggagaatctgtcctgggcactttatatacacccataatctgtttggatttcttggtaggaagactacatggctgcatacatggtctttcwttacctccattttatagatggagaaaatggaaatttaaagaggttaagcagtttgccgaaggtcacagagctactaatcggtgaggtcaaggttcagacccaggtctctcagactttaaaactggtgcacttaaccattagactctactttttgcgtattgagatgtggaagcatctcaattaattgcttcagtcttggagttctttggcggttatcaaaaactgcctatttccatattgcctccagatattgtaattaagaatttccaaggccaggcacagtggcttatatctgtaatcccaacattttgggaaaccaaagttggaagatcccttgagcccagaagtttgagaccagcctgggcaacatagggaggcttcgtctctacaaaaaatacaaaaattagccaggtgtggtggcgcatgcatgtgtagtccaagctactctggaggctgaggcaggaggattgcttaagcccaggaatttgaggctccagtgagctgtgattgtgccactgcactccagcctgggcaayagagtgagatcctgtctcaaaaaaaaaaaagaaaagaaaaagaaaaaagaatctccagattatagttcagatattacgtattaatatccaaagccctccttaagacaccattttaatctgtctaacaaaattaacaccctaggttttgacaattgcttgaggagggagtagggcctggtgatagagctaaagactagtgttctggttctttaatttgttcagccagcaggtacctggaaataatgatactgtttgcagaactccccacaaaaatggacagtcaactttaaataactaagtaaacacatctctgcttaatcagataccatcttatactaggttctaatatagataagtggttgcagaaacatttatgagaggaatgttaaattgtcgaaataccatccagtcccttcatttcttcctgcccttcagaaacaaacagaataaccctgatgcagctgtcacggcagaacactcattccagctcacagaacaccagtgttcaatcagcactgagtttgaggagcaccgggtttgggagtattcatctctcttccctgtcccatagctgcccttcaaactcttgagactgttyccagctctaaaatggaaagggtcgtcttctctctggaacaaaagacaggatgtacttgcttgaataggccagtgctttcctggaggaaactccggcttatggagcctctgcttctgcacagcccagtgccttccaccccctsttcatctgctagcatctacattactagttaactggagaggagaccaaacccaaaatattacaaaacatagatattaaaaatactgtgaacaacaatcagcccgctttctcccacctctcctrtaccagctaaatatttacmtccctcatccgtagagggtttttggacaagacaggctggtgcctacatggtgaaagttgtttttctctcttttcttgtaatattgcaaataaacaaggatatctgctttctcttgagcaggacaacagccaaagagtattattgcatagttcctgtcccctatctgggctacgattgtgtctgagagtaatagcacttatttattaactggaagaaattttacaggcacctatgttgtttctgcmtagcttctgaggctcctctcttaggccactcctctcaccatgcccccacagctagttggtaaaatggctttgaataatgactcgctttgagttatctagaaatgtcccattagttcactattttcataaccccatagacttggtttgacaagggtgaggtttatttatgagttctcaactggcacccaatttttaaaaaccacagagctgggggcggggatagaatgatggggaggagatgaaacatcctagaatcatctgatatactttaaacatatacatatacaggcttttgttgtttgtaaaatatagaagcatctttatctgtgactggttgagaaataaaatcccttccccagcccaggcatggtaggttgggatcatcccagtgagcgagcaagcaattggatttgccctcagagactgactatggggtcgaatgctgagtcattcctgtccccacaccagcagtcctggaagaggctcagtcgatcagtcagtgggctgctttctggagcactttatcattttgggctctcacaatgtgtgtttaaactctgagtgaccccaggcagccttccagactggcacagttcaccaagacgttcagacagatcatctgcaagtgaggaagaatgaaaacccagcactggttcaaatcactcctagcagaggtagtgaaggcatcactcagtcctggagaaatcttcggagggctcaccagcrtcacaagtaggtagaccagaagaggcaggctggcccattgcaaagccctggaatcagagggacaggagttccaaatccccactctctctcttcctagatgtgtgcttgcggcaattatttatctctctgagccttaatttccttatcaggaccctgagcaaaccaaataacatgatgtgaagcctctggcacaatgcctgggacatgttcagcacacartaaatgctaattttcccttttgccctatatgatatgatttgaagcagcgccactcartcctgccagtcacattgctggaaatgccaccaacagtcattcttaagatcgcttattacaatataaatacccctaggggatatcagctaatcgctttatcaactatcgctttaaggggattaggtgtggattgagaacaaaacccagaaggaaagagatcctggaggaaggggagggcttggaagtggggaggattcggacgtcctgtggcccccgaaggagacggggaatggcaggtctgctggattcccagccttcaggaattcccatgaacttcttggggacttcatgtgtttagaccatatttagagagcgtgcatgtgttttgagatcacaggtttttctgagagacattgggaaggaggacagcgggggagtggagtggagagaagtcatacctggcagcttttaacttcacttactgcccttcatgtgctgttgccatttccagaagttgagggagtaaggaagggtaggagttcttggtattcccttatctcttcctttccctccccttatcctgcccagagcatcgcagggtagagccaccagayggattcagggcatggagatggcaggttagtggtagacttggaagggatcgttcttcctatttcagcaccacccttcttcctctacctcccaccctgcatttccagccccagtcagattccttcttggacagagaaggagcagaaatgtacgtacatcactaggcttaaggggggactgcagatggctcccctggtcctgacaaaaaggtggggagcaaaccgcatggctggacgtaaattgagtgacctggaatgactagaacgacagggggcctctaaccccagggtgcacagaggtagggacccaagggctttccggggtcggacagaaatctcgggttccattttcactctgagagacccagaaatgacagagcccatgctcagtttccactggtggtgctgttgagtggaggggctttgaacatggcacacaggaaagggttgcccaccctgtcaccagatgggcttgcactgttttgtggtttgggagttgcayattggaggtgggagtggagtgttgagatgaggcaagttgagatgtaatcgctatttaatgggcagatcaragaaaacattggctggtttgatttttattatggttatcccgctccaccatcctggcccagtcatatatattattgttatcaggcatagataggggaagcaattaaatgtgaaactgttatttaaaccggcaagtgtcagaatgttaacccacttcagagcgaaggctctaccagcaacatgtgtgttcastgcagaatgtgctggttacagatratctttatctgtttgtcaaagcatttgcaagatctctattttatgtcatcccctttccctgaaagcagcagcagtaaacgacattgctcctcaaatcatccatggctcagacctctgattaatttaagctggccctgctagcgttcttataaatccccagcaagatgcaggcccaggagtggaaaggggaaaacatccggaaagcagcggggggcagggagggggaaggctgaagggaaaagaaaaaggctgaagggagcaataattgaggaagaaagaataggaaaaatrtagaaaggacccaagaaaatcagagaaatgagaggaaaagaaaggtaagaagaaaatgaggcaagtttacagagcagtaatgaaaatagtaatagctaatttactgtacaacagacactgtgctaagcactttccgtatgtccctcagtcctctgaccaacactatgagttaaattaccgctacagctccaattgttaaagtgaggaaactgaagtatagaaaggttaaggaacttgcccaaggttacctagcttgcaaagttgtaattccaactgcgtctcactcagctggcagtgtgcacccttggccacacattagaatcacccaagagctattaaaaatcytgaaggtcataccccaggcaagtgaatcagaatctctagggatgggtcccaggcattcgtttgcttttttagtctccccagataattttaatatgtagccaaaattgataatccctgcactagacsaagctccgattcaaatttaaatattaagaggacacatgtataactttgctgaataattttttcctatcggtaggatggtgggaaggaattgctataggccrcaccatgatactttgctgaattggatcagaaaagtaccctcaaattcccagcatcatttcttcaaggaagtagtgaattggggcacygtgggttttttgttttgttattgktcttaaaccaccttgcctatgtgcactcaactacaggaacgagaacttgcctgaaaccccaaacgtgtctgcatcaggcattatttttcttgagctcctgaatttctgctctaaccaagaacaactcaaaaaccttcaatttcataactgttgatatgccacccactcctacttacactcctgaccccaaccccatggaaactgcctttattcgaacaaacacaagaattataatatgttctaaagttcctctacctatttcattctcaccatacgcttatgaaagaaatgtcattgtcttgaaaactaagcctaaacccagaaagattagatgatttgtccacaggcacacagaaactaagtggaagagaaacaggactcaagtcttcagtttcccaatccactgcctcctagaacatgcctgtgaactgagggagcagtgcaataaaggaaacttgagaggaagcgcaaaaggaacttaaattgcaaagtactgggttccctaagtagccctgcctcccctccagttttcagcccacacctgaactaaggtctttcattgtctgtggatcaatttacagctgccctgcaatcacatttgttttgtttgtttgtttgttttggttttgaacgccctagggacagtcggtttcagattagtctctatcagagagccaatagggaaagatgcagaaagccaggagagcagctcctagaatagagacaaaaccacctgcattttttctgcctcttcttcaggagactccactgtggtcatctggttccctaattgagacacctcctgagaaaatctgtgctagggaaacacccagcccaggtgggcagatctcaagaggaccagaacrtttgaatctgcttcagataaaccctccacttaacagtaccagatctggacragatggaagctttgtagatttgcccataatccacagtgctctgtaatcaattccaggaccgtgtggatggagaccggaaaggtttctttcccaattcttcacagcctggggagtagggaactagtaattgactccagcctcctcgagtgctaagtcctggagtctgagtcacacacacttcccaaaagggccttctaagcagcctaccccagcagagaggacccttggccctggccctactccagactcaactgtaacctcagcaaggtgcagggagaggatctcaggtgggcctcctggsaacagtgccttttcaggcactaggctgttgggaatggagagagaagagaaaggccctggcactgtctgggtatttggatggatttctgtggcacaactgtggcacctggcttagctcagtaaaggactgagtgtgcgtggagcagaaaggggaaagagactagtggggagctggtgaccagttggagggtggagggtagggaacaaccctggcagatccmktttgcccttgactagagcttaaagaccaaaggaagcgttcttgtttttaagtaagtcaggtgttctaagtttartgttaatatgctttttcaattagatgtttgagtatatttccccagttgaattatgtagagggaattacaaatgagaatacatcttacaatttttgaattagaatctttgagattatctatttagtccggtctgttttgtttagacaagaaaattgagcccattgatcttaatcagtttgcccaaggtcacagagctggtgagtgaaagctttagatgtagaatatgcaacttttctctgctgccctccttccctaaaccatcttgccttaacggaggctcagtcagggggacaatgggactgatctgtaaatgatctaacttgtcattgcagaaaatatacttactccrtggccacaaaatttcagcccttcagccaagcttcatccatcacatcataaagaataacttgccaaagaggggtttgaaaatccaaaccagatccctctccactcctagagaggccagttccatgacactgcaccggagccaagtgtttccagcaagccctgatcagttgcatgttagtccttgtttgtatgataaacgggacctagtagattaacatcatctcctcagcccaagggctgaccccagtggtgctgctcaagaggaaggaggaggctgggagcggtggctyccgcttgtcatcccagcactttgaggggctgaggagggcaaatctcttgagcccagcattcaagagcagcctggaaaatgtagagattctgtctctaccaaaaaaaaaaaaaaaaaaraagaagcaggtggaggaaggaggagctgcagaaaggctccgggagccagtgtctagtaagcagaggcctagcccaggctgagtggtcccagcccaggagggcctctctcggcacctgtctttagatgcacgtctgcctctggcctttgagatgcacacattcatcaagcaggaggatctgtagtcattaaaccaaggtgccagtctggggcccagccttcaatgaagcatcagtggctttttcattcccatagagcaackgcgaggaagaccccatgctcccaggggcccarttctccaggccaggaccagatcatttgttccttctcagaatctgagatcttttgctgatggttccaaaattgaatgctgaaatctaaaaagaaaattatacttactctggtcaatgggatatgttggagacctgagagtgaaaaaatcaaactgaagaccagtttccttctttaatggaagaaaagtaagaaagttaacttagaagaatatttagagttctgaaaatcccactctgagaccactctgccatctcacattgttctcttgagccttatctcaatggataaaggtcactagagtttattagacacaggaaaacatcgtttacrgacttcttcattgtgtagggattctgccttcaggcctgttcaccagccaggagaattgtgctttttgatccagggctcttggccagaacagccttctcgctcattaactcagtcaaccaaatgcttcctgtgtttccactggtggttcagaacgtagtctctgccctctratacctcayggtctaacgggggagaaacaagaaagtcagaacttacaatacaagataataaggaataagagcagagcctttggaaccagacagacttagatccaaatgtcagctctgcatttactagcaagtggtctatcttggtaagatgcaactyttttctctaagtcttaatttctccctctgtaaagtatgacctcatggggttattgtgaagattaaatggcatatcgtatataaggcccttggcacgatctttggaaaataataaccattcagtgaatgtaatctactagtatagtagcgattgaggtgtttatagggtgctatgagggcccagagaaaggagatgagatgaacaggagagaggaagggatactgttgaggaaggatttcaggatggaatcccaccacaggctgtattttgaagaaatggttgaagtcaataagaagagtgaagggaaggtgagaatgtttcaggcaggaagaataaaatctgaataagtgcagagtcctgacagaacatagggtgtttgaggaacttggtatggaaatagattaatatggcttaacatggagcaaaatgaaacagaactgagactagaggatgaccaggaccaggtcatgaaggacattaaaggtgggtaaaactcataccatgaaggagagaagagttacagtttttaaaagaaaataaatagccttcaggagctcaaatttgaaatcaatacgagatagatgatcaagtgaatgttctgtcttcttgatgagcctgactgagaaaaccttataatctaacccaaggcaacaaactgagaaattagaaaataaaacttagagattagaaaacaaaaactgaaacccaaactttttacttggaaatttaaaaacatgcttctatataactcttaggttaaaaatgaaatcaaaattgtaagacaagctgtttagaaaagaactatgagagtaccgtttatcaaagcccatgggatgaaaccaaagtggcactaagaagaaaatgtggaggcttcaatgcatttattagaatacaaagaataccaaatcaaatgaattaagcattcaactcaagaaaactagaaaaagagaagaaagtaaacctaaagaaagttttaaaaaggaattcaataaattaaaaacaaaacacacaatttttaaaaacagacttgattaataaaaccaaaagctatgtcttttttaaaaaagcaaaaaatagataaacctttgacaaatcagatttttttaatgagagaatgcacaaataaagagctctaagagctgggcayggtgactcatgcctatattcccagcactttgggaggctgaggcaggaggattggttgaggccaggagtttaagaccagcctgggctacgtagcaagaccccacctctacaaaaaatttcgaaattagttgggtgtggcggctcatgcctatagtcccagctacttgggaggctaaagcaggaggatcacctgaacccaggagttggargctgcagtgagccatgatcatgccactgcactgggcaacagattaagactctgtcacaaaaaaaaaagcrttaagttaaggagcgtgaataaaaataatacatttcatattctaagacaatatcatctacaactttattccaatataaattactaaaactttaccatataagtagtagaaagcctgaatagataaaagctatggaagaaaaattaaagatagtgatagatttatcaccaagctcagatggttctgcaaacaaattctaagaaaccgtcagggaacagatcattactgcgttgacacagaaggcaaacctctcaacttggtgtataaggctagttaacattgttactaaaacaggcaaagaatggcccccaaaataactctaaaccagtatcacctacaaatacaaaaactctatataaaatattagcaagtgagtacaagagtataaggaactctattaatgtaattcactgtgctaggttaagataaaaccataactcttcagatatcatagctctttagatagaaaaatgtaaaagtatttgataaaaattcaacaacattcctgactaaaacaaattaaaattktaaaacccctggaaagccaggagtaaaacatgttctccataatctatagcaaacatcatagttgctgataaaccattagaagcatttccttcaaagttaggaataaaacaagaattgctactattgctactattatttaatcccatattggaggttttagccaacacactatggcaagaagaggaaatgagaaaggttaatgctgcaaaagaagaaataaataaagctaccattgctgatataattatctatccaaaaaaagtagaaatccatgattaaaagctatttgaactgataaaagttcagaaaattggaattgtttcaatatactaaaatcaattagttttctgcacatcagtggggatatattagatgtaatgaaaatgaagggtccattcacaatagaagctataaagtatttgagaataaatctaacaagatctacataaagaaaaaagtaaactgcttaaaagtaatttaagttcaccatttgcaaattgaactaaagaaaaatctaaagaagaactagtgaaaattgcttgcaatcttaccactgaaaagaaacctctgttaaaatgtatcagtattttaaaactgtgttttgtcctttggaaatatgccatattaagcaaacatagcataagcaaattaagcaaaaagacaaacctttttttaaaagcatatttgtgaaaaaagcatatttgaagctatgataagaaactgagtagaagctataaaacgtagattcatcaggaaggagcagaagttgaaaaggagatttctggctgggcacagtggctcatgcctgtaatcccagcactttgggaggccaaggcgggtggatcacttgaggtcaggagtttgagacaagcctggccaacatggtgaaaccctatctctactaaaaatacaaaaattagaaaggcgtggtggtgagcacctatsatcccagctactcaggaggctgaggcaggagaatagcttgatcccgggaggcataggttgtagtgagccracgtcatgccactgcactccagcctggatgacagagcaagactccatctcaaaaaaaaaaaaaaagaaaagaaaagaaaaggagatttctgagtagaaacaygttagcagaggaaacttcatttggggaacaggattgttttgatgccatgctccctcagctgaccacacagattmcatcctggccakaaaaaggccctgcaaagagctctgatcattttggttctgattccrtccttagttcttacccattatctgcttacccttcctccccacctatttaagatacaaagcaaaacaaaccaaaaatacagatgagttgcttggtagagctgcctaggcctccaaggcggggcccagaggattttttgactgaaccccctgttgtgttttccatatgtgcttccccagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacaygtgcagctantgcaggtgatcaagaagacggagacagacatgagtcttcaccygctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagtatttgaagactgagtcttgtgtgtttcccaccctagcccccaggctttcttttttaccccttttccttctcccctccctccctccatccctctcactcttcctccctcccttccctcctttccttcttcctttatttttcttttctttcttagacattttaaaatatgtgagtggaactgctgatacactttcattctcagtaaattaattttttactcaatttacaacttttcggaactctgcatctgctttaacaatcagaactaagaagggaaggggaacttcagaatcagaaactgctcagagcatgtgttttgtagcctggatgtgctgatatgcagcatatccctgggattacccagaattcagtcttcttccacaatcctaaccgagattttcacgcaccaccagcagcctactcgtatactacctactaatcaatgccactgcgcacccacagagccagtggccagcaactgagcactgctagaaactctggggaacacagaacttttttaagatttggtatctgcgccaggcatggtgtctcaagcctttaatccacgcacgttaggaggccaaggtggatggatcgattgagctggtctcttgttcgagaccctgtctccacaacagttttaaatattagccatgtgtggtggcacacacctgtagtcccagctactcgcaggctgaggcgggaggattgcttgagcctgggagttgaggctgcagtgagctgtgatgatgccactgtattccagcctgggccacagagtgagaccctgtctctaaaaaaagataaaaaagatttgacacctgccaaaaagaatttaccgattataaactgaggagaaaagattaatcttttttcatacagattcaaatacgcagatgaaatcacatgccaggtgaatggtaagagtttgtaggaagtaagatgagtgaagattggaatcccagagactgaatctgtggatttgctgaagagggcctcagggaagtgttagactggaataggtagagaggaggagaaaagacattccagagaagcaaaataacaggaacacaatgaaagaaaaaaaaaactgagggagaagagctactttctgttttctccttctgcaaggcagttttgctgtgattattcctgtcctcctccttgggaccactctgtccagagatctcttttctgaactgagaggctaactatccgcatcattaatggaatgcttgcctcccaagcagatagattctaagttccctgaaggcgtgacaatctattcattcttggcacagtgaatagattcgttgattcaatccaccaaattcacttgcattggctactcatgaactcatcatactatgtctttgaagaatgccttacggggtgtctaagggagagaatagagtcatgggttctccatttctgtttctgactgggccaataaagccccttcctcatccctcttttccacttaccactagggacagaaattaaaaaccatggcttcaggctactaaaagcctaaaccaaaccaaatcaaaccaaacaacaacaacaaaataaggcaggttggacaagcttacgagtgtaaccaaactatctggaggtgtctgttgtgcgggacgcttatttccactgacctaaatttccctgccacttctcccttaatttatcttgccttaggatatttacactcaggagacataactgcagacttgaggttttcaagccaaaatatcaagaaagacctgttcatcttttgcttaaaaataactatatctccaaagaatcaggttatagaagtgagtactgaccccagccctaaaaatgtaggattcctaacccttcaggagagacctttctgagctcaaacctttaggatgacagatagacaaagactgaagccattgtctaagtaacaccaaaacatttggaaggaaagtgacaaattcagtcagtcatatggctctttttttttcttccttgatgccaaacatcaggatattttgaaacttattttcaaacacccagatgactggctagagtcttctgtgtagagagctgatggtcagggatctcttggaagagagaatgtacaggcagtagacaagatagagtccacttctgaggcgctcccttatttacaagctttcttgaacaaaaagtctttcagccccgctgcctggtctcagttcccaccagcgctccgcagcccatccaagcctttccacattatcggagctgttgctgccaatggaaggaggaagagaaacgctctcagctctctggcactgatggttagcattaaatggcttttaaatcctggcagctttcaaattcccatctctgactttttccctgtggcttggaagatcatttgctaaatatttgacaacactttatattcagcctccaaagctcctgctcctttctccctctttctctcccccaggatgaatcataagttaacgaatctgtcatcagttattcatagtactttctctggacacaaacacaygtagggatgtgtgttaataaaaataggaagaaaagtaactttggtcaagagtcaagaaagggtttccaggctcccacaagagccctcccccagcacctccctggaacgggctcccttttccttcctcccgctgtgtgtggagcccaggaacgaagaggggacacacagaagaaacaaagctgcacaccctgtttctccagccgccataagaaattaggctggcctgagtttctggctccttttttacaatgtgggtgcagagcaaggagcctaggaggctcagggtcggaagaggtggcagcactagctgatgtcacatagcgaatttccaactagaggaagccagaggggcagcttcaccacctccactgaggggcaaagagggaaggggacagaggcatctgtggcgggctttcttggtggcttctggactccagtgactttttcttggctccctcgaggctaaaaagcaggtattttcctggacaggtcctccttgcttgacatcacccgctgaccgtgtggtgctgatggaaagagctgggtgagagaggggctggatgttggcctctggatacccattcccttggaaatacctagtggagatgggcgggtgcggggctcctaattctacatcctgagagaaagaaccaaagctcatttccaccatgcccatccccattgctttctggtcccccttttcctactcattcactccaagagtttgggttatgagacaggaggaccaagatgcctgatggtcactaggtggccccctccctaccttctgctcaccccctcatcctggttcttgacctcagcccctggctgtctctgcatcatgaatgttgttatttgcacgtctccaccctgaccgtgggattgcacctggtacatcctccatttaacaccaactgaaaagaaatagcagggttttaagaattcaaaagatcatacaatgtcccagagccccaccgcattcattaaacacataatccatactccagtcatgtctagcaggttatgatggtgaccgcgactaggccctgctctcaaggggggcacagtctgtggatgagtagtcacagctcagcagacgcaacaagtgcctagagaggtgaaaggatttgcagagcgtgtgcataggcccaagagtgtgaaattctccaagcgttcagaaaacggccaggtgaggggcgtggcccacagctcccaggctaaaatgtggatgtggccagtcagcggcaaattgtgggagccttgtcctccctgacgaggagctctctcgggctgtgttggtagcaactgggatccggggatgctgccaggcagaagagagacatggtcaaatttgcaatttggaaagtcagcgccccgaaagtcaacactccccaaagtagaaattctctctacaatgctcctgatggttgcccaacccacagacaactactgaagagacaagaagctctctcccctctaaggccctgggtgatttccaccccgcaggcctggctctgcccctgggctcacacttaccacatgcttgctcctgcaccctgggggctccagctcacctccttccctttcatctggtcgcaatatcttgcctcaatcataaacagcttaaggacactggccctatcccctgttgatatccattccctaccgttgctcatattgccccaagctacaaaggccctctgcttccaggagcttcgtttcaccttcttaatctaattcatggagatctcatggtcatttttatccacatatgtcaaagcctgcctgtcccatatctcatgtccagaaaaggcctgcattggtcatagacctcaagaaaattagaggctgggcacggcggctcatgcctgtaatcccagcactttgggaggctgaggcgggcagatcacctgaggtcagaagttcaagactagcctggctaatatggtgaaacctcgtctctactaaaaatacaaaaattagctgggcatggtggcgtgtgcctgtagtcccagctactcaggaggctgaggcagaagaattgcttgaacccaggaggcagagtttgcagtgagccgagatcgcaccactgcactccagcctgggcaaaagagtgagactctgtctccaaaaataaaaattaaaaaaaagcatattaaaaacaaaagagattattatataagacacttagaactgtgtgtagcacacagtatgtgttcaataaatagcaactattattggagacggcaccctggggtggaatgcagagttacgctgatttgggttaaaagtctaacttcacagctatggttctaggtccatatggctttggccaatctcttaatctttctaggccttaattgccctcatatgtaaaatgagataatatccaccttagagggctgttatgaggcttaaatgtaataatggttgtaaaacacttcacacaggttcccggtacatccaaaccagtcggtagtgttggctgcgggtaacgttattgccgcggctgttaaagtgccccacctttaaggaggcattctgggcccacgggacaggtcttcctgtgcaagtgttctggacctcacctgaggagcctggaaactcaaagccgggattgaatttggcacttggcagtagagtaaaaatacattctctcaaaagattttgcctccaatctataaggattaggagaaaaaaacagtatttgaaagacaactgctgtgttctgatttagaacacatgctcaggatgaggctacaaaaacattctctccccaagtagtgggacttttctcttgtgacttacactcctaattttagmctaatattacatagttggaatttccagaggggttataaagaataagaaaattgctaatttgagtctgtagggagtgggttgggatattttcatcccctccggagctgtgtaaatatgttccaggccaaaagttcccaggagagtgtcattcctggggtctatttagtgccaygggcttgactcaaggaggatcctagtggcttcccgcaagagttggaaaattgtgatcccctggccatttttccacaatactggaagccggaaagtgtaggttagagcccccattgtccgtttgagacttagcactgccattttctatgtatgtggccttgggtaggtcactttcctctctggggacatcatacctggcctgtagaactatctcagcaaattacatctaattccttcatgatgaatgggcctcagtttccctagccataaaatgggaatagcagcacctaccctgcatgttttatagagtaaatgaaaaaaagcagggcaagcctgatcactactctttacagataagaaaggcccatagaggtgaaggagctaggccagaaaaatggagaggcagggctgaggctggacctcaggcttccagaggcccacccctgctagggctctttcttggtatgctgtgctg

SEQ ID NO: 1676 - DNA, 64423 bp, Homo sapiens
tcaaagagattatggtttaatgagactttctgcacctctccccagtcacacaaaattggaggaaaagatataaaaggacaaaaccccaaagacagcaaatgagagacaatctcagatacaagaaatggaacgtaaatgcagagtggtggcaggtgttgatggcatgagacaggcagtggtggccactgtacgtcatggagacatactagggtgctacgggtaagctgactgctcagggccagggaccaagcacattcttcccagcttgtggaatcaaagatcaataggctgggcgcagtggctcatgcctgtaatcccagcaatttgggattactcacctgaggtcgggagttcgataccagcctgaccaacatggagaaatcctgtctctactaaaaacacaaaattaggcaggcagggtggcacatgcttgtaatcccagctattagggaggctgaggcaggagaatcacttgaacccaggaggaggaggttgtggtgagccgagatcgtgccattgtactccagcctgcgcaacaagagcgaaactccgtctcaaaaaacaaaacaaaacaaaaaagcaataaaagttgtgccagacttttgcttccattaggatacagaaagttgcagacaaatgtggttcctaccttagtaagaacaagctggacaacctccaaaatcataatttttgcagctcatcagagagctgatgctgcaaaggaaactaatgaaccaaaattgagggagggacaggagagcagaaaaggtcctgtctgaggcacagacatgctggtctgccaaagtctgagagcagagcaggaaaattggaagcaattctgtattagtctaggttatccagagaaagagaaccaataggagatatatgtatgtataaatatatgtgtgtttgtgtgtgtgtgtgtatatatatgtatataaagagatttattataagtagtttgctcacatggttatgaagctgagaatgcccagaaacagcaggtgacaagttggagacccagaaaagcagatggtctaagttccagtttgagtataagtctgaaggcataagactgatatcccagctcaaagtcagccaggcagagagaaagaaatctttcttactcagcccattttcctattcaggctttcagtggattagatgaagtctaccttctttgggcctgttttataatcaactgattcaaatgctaatatcatctagaaacactctcacagacacattcagaaataatgcttaaccaatatctgggcatcccatggcccagtcaaattgatgcatacaattaaccatcacaaatctcaaaggactctgagccccaggctgagaacaagacagtggtcatctgtactggggaagagtcaagagatcagagagagatgaactctttgaagctcagagcctgctgaccctctttgaagctcagagcctgctgacgtttgaggtcagggcaggaaaacagagagaaaacccacaatgaacccagccttacgctgaacaggagacagtagctgcctgtggctactggtagggaagaggagagcaggagagctgagacccctcctatggcgcaggagcactgggcctgacgatgggtgcaggcagggcaggagaactaagacaaaccctccaggcactcagatctcaatcctggctagaggaaataatttgatcttgctataataatataacaaataaaatttaacaaaaataacagcaaagcctagacccagctcaactgcagcctagattggctcaatccttcacactggtggcatgagagaagaagatatgggacctattctgggcttatctgctagttactttagtctatcctatccttttgtacataacatctgtgattcaataaaaaattacaagtatatgaaaaagcataaaaagtgacccatcttcaaaagagaaaatggtcaaaagaaccagatgcagagattgctcaaagacaatctttgttcatacatgtatgaaaaaatgggaaatgcagcagtgaaaagtaaactctaaaaaaaaattcaaatagaagtgtcagaaatgaaaaatatatcagaaataaagacttctttcaatggacttatcagcaaactggaactgctgggaaaagaataagtgaacttgaagccagatcaatagaaaatatccaaattgaagcataaggagaaaaaagagataagaaataaaacagacacactctagttattattgtggtgaggaaagaaattactgcaaacttatggatgtagactcatacgtacagagccaatggatttttcccaaagatggcaaagcaatcccatgggagaaagaaaagtgttttcaggaaatgatgctaaaacaattgaatacttatatggaaaattaaagaacgtcaatccctccctcaaaacatacataaaaattaatttgagatggatcataaacctaaaagtcaaaactataaagcttcaagaatatctgcatgatcttgagttagacaaagctccttagacaagacccagaaggcactaaccactaaagaaaaattgataaattgaactcagcaaaattaaaaacttttgctctgcaaaagacatcaataaaaaatgggagagccacaaagtgtcagaaaatattgacaatgtatatgtctgacaaaggagttgtatcctgaatatataaataactctcacaagttaataataaaatgacaactaaattttccaaaatggtcaaaagaatttgatagacacttctcaaaggaagatatatttacaatacatatatctgacaaaggactgatgtctagaaaatgtgaataactcctacaaatcagtaataagacaaactatcccaactaacaaccaggcaaatgatctgaacaaacacttctatatatatatataaaatctaactgtacacttacgatctgtgcatttcactgcatgtaccttaatacaaaggaaaaaaatgctgctcacttttacctaggactggtttataagtagctgctagtcagtatgagacagaataactacaccaggagtaactaagccaataattaagtcaagtcattgctgtttgctgactggatctttgaaatgtgctccaaaaaccagtgtaagacagggctctggaatggaagcgcagggacttcttggaggcatgtgccaagcagagagaagtgagcataggggaagagagaaagaaatgaaagacttcctacttgaaggaagacttcctactcaaaatgagcctgcagaccagagttccaaatcacagaagaattcaaataccaataaaggcagctaacaaaatcaatactcagaacatgaattcacccaaacataattaacctcataaagcagtgcaacactgactttaaaataagtatcctgaggattctcaatgagagatctaaaggaatcatatcgactaaaaaattgaaaaaaatcttaaatgatattttaaaatactggtataaaaacaaaatcagtaaacacgcaaaagaaccagctgtaaatgatttatatagtcatcgaggtaattatttaaaacacctcaactggactatgtagtctaaattagactcaaagaataaattagtggatttgaagatagtgctgagaaactcacccagaatacagcatacagagacaaagatgatgagtttttaaaacatgaaaggacagttacaagacatgaaagatagatcaagaagctccaacaggagcccctacagggcactagcagagatacgatagctgaagaaataataaaatgattttccaagactgaagaaatgtctaaatcctcagatcaaaagtacatcctgtgtattgagtaagataataaaaactaaatccacatctagaccagagtaatggatctgagaagcaccaaggataaagataatcccttaaaagttatcaaggagaaaggacagctaaactgcaagggaacaacaattacctgggcagcagattcctaccatgcaacaggaaatgtcaaacaacaatgacgcatccgtcacactcgaatattacattcagctaaactagtacttgaaagtgaaggcaaaagaaagttattgttaaagatacagagcataaaagattttatcacctgtagacttttgctataggaacttttaaaagattgcttcagcaataagaaatgtaatttaaaatttattgttttttatgcactctgtttcttttgtatcctgtttctgtttccccagagaggaaacaggacataaaataaagaagaaacacagatacaaaataagtagcacaaaaattgatagaatttattagcatattttaactattttgactgtttattttaaagttaacttttatgttaaaaagataaggtaaaagttacttgggttagtttttctttctctccttcagtgtgattatgttattcatttgaaacacaggttcgtttttgtttgtattattttttaaaatttatttgtttgcttgttttaagtacatatgtgaaaagaacatggttctaaaattcagagtagttctaaagttcagaactattcaaaacacttcacccaaagaagcgtccctccctgtctcttctaccctgtcttttccagtgtgtttccactcacctcccgtggataaccagtctcattgatttctaatctatccttcttatgtttctttctccacatatgagcagacacacacatattttcttatttcttcttctttcttatacaacaagtggttacagtggaggtcactttaattcattaaatatcattcaatagttttaaatctcaaaaggaaaagtttgaaatctcaatcattttcttctggccaggcacgatggctcacgcctgtattcccagcactttggaaggcagaggcaggtggatctcctgagctcaggagtttgagaccatccagggcaacatggtgcaaccctgtctctactaaaaatacaaaaaaaattaaccgggtgtggtggggcacacctctagtcccagctacttgggaggctgaggcaggagaattgcttgagccccagaggtgaaggttgcagtgagccaagatcacgcctctgcactccagcttgggctacagagtgagactctgtctcaaaaaaaaaaaaaaaagaaaagaaaaaagaaaaaaaatcattttcttctcagaagttaattgtgggcaggctgatttattttgcaaatttgccaattctgacttcaagaacattcaagtgcattaaccaatgggaatgtaggggaagagggctccactcacttacagagggtaggatatggcctcatactagacaaaatgttatttgatgctactttcaagatgataggggatgggcctggatttaattgatggctattatggtgacctttaaataaatgagattcaaagtaacctgatgtctttactgcttgaaccagcttccatgaaatagtattcctattgggggtgggcctatcattccatatggtcaaggaaacatctttttgaacagagatcctgtaatcatccttacaaactgcacttcaacattggattggattagccagatttgaggaactcactttttacgtcttcataaatttaaaatgttgaaaaagtcagaggcaagggaagacatttatagtacttcacggtagatctccctcaacatgggctatatatccattagtcaatattctatagctattgttctgcaataaaccagacaagatcctactgtattactacccttttattcttggccctaccttccccaaggagttacacattttctagatagtctaaattaagagcaactctcatcatactctttttgagtgtttaattatcaagcaacagcctaactaagccaataatatttctctttttgggagtggaaatggaagctaagttgattgacccacaggaacaagagggaacatgccgttatattttaaccrgtgtgtaaagaaggctgttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagaggtaacccaatagaatcttagactgtggtgggycactctcctcacttgtttgcctcatgtcgtgtcaagtcagtgcactgagctggtggacaaaatggtaaactttgaagrycaggtctttcagaactttccaagttgccctgacaaataagtagactttagcacaatgggctatcactaaagacagggtcttttttctttcctggctctggttttattattgggagaaccttggatgatacgcatatccagtgactatggagattcaagaaattaaatcttttataaacgtaactatttatactctaacttgatgtatgattcatattcttcctgtcttcacataaaaaaagttaactatggatcatttattttccccttgtacatggaacataggaggaagaagagggtgaagtgttaaataggaggtttggatcatgcatgattatttagcatggaatatgaaaggaagaagagttgtgtgataaagaactattatctgattcttattttgcttagtagattcccttaggataaactatctagaagaacacaaatgaattcatgctatagcacatgcaatgcatggagaaaatagttccagggtatatgtaatgtaatttattaagtagtcaatttttaggctttaaaacattgatattgtttcctttggaattatcttattttttcccctttgttttggttctatgatcgctttctcctccaattatctttgagacagatccctctcctcatgttagtaaatgacaaagaaagaagagacatagggcaaaggaatataccagtgacaaggaacattctaccaccaaaaaaatgttcacggtcataaataaccataggacaatggtttggaaaatagatcttgacttgtgagcctgaagctgtgtttgtacatgatcactgaactgattatagttgattgatcttcttttgttcaacatgattgtcgaatgtcgagcaacaaattctatcataaaatgatattatttttgttatttaattgacgtgggggtcaagattgctgcaatgatcagtgacttatgtctttctctgtattttatcggtgaatcatatggtcaggatttctaaggttcttgctagttctaatattccataacttgataattggcttcagttaagggaaagggggagaagagaaaaattggtatcaacatgtccaacttggctactgtacacagtggcagtaccattgacagttaggggaaagggaggaaacctctgcttatttagtgcctgtgtttgtgccaggcactgaactagtcacttagaaatgttatctctttaaatgcataaaatcctacatgctaggaatctttactgacattttacaaaggaggaaactgagcctcaggaagaataaataattggcccaagatcaaacagtaaatgtagagcttggattcaaacccactttagcctcatttcaactccatgcactggacagcattgcctccataaaatctggaaattaggaagagagccagtttgaaggaaggtcagatttagtcaaagggagttgcaggcagcagttggtttggaaagtagcttggaagagaggttcgggattagaggttcagtctcatggttctcacccactrgcagatctaatcatggccttggcgtcagcccagtgcaattatcctcagctggttgttgcagaggttggcgggcaggtgggctcactgcagaccgccatcttgatcgtagagtaacccaaactcttggataggataatcaatagcaaaacacactaaaagctttagcacatctcttcaaatgagtacgtgtatagcagcttagtgacactaaatataacgcaaatagaagaagtagccaacaataaaatagtaaaaaaatgagtgagaacatatcttcatgcatgggctttgttactatttgttgcttcagcttatactctgaaatctgactgatacttatgcttgaaaaaaggaatgaraatgtgactatattttaaccaaagaatatcacattaaaaatatttaatacttttgcatactgcgagggtccctttgcagaggagaggaggtaggaggacctcagtattgtagacagatgaatatctgaatcctggttcccatcccttcactrgaaataacattgcaaactactctttctgtgagtaaaaataaatttttttaccaaatgtttctgtgctccacttttccaggaatggcctattcctgaagctaaaaaggaaatctaatttcattcagggcaacagactttgataaattgttgctggggttcagaatatcaacccttctaaaaaaaaaaamaaaractaacagtctggctttttcttaaagctgttctttgtttttttttttttttttttgtcataatcattttcctactaacagtttttattcatgcagtctcttagtggctgatttgtaggttcattttgataaatttcatcagtgaaatgccctggaacaacaacaagttttaaaggcataaatatcatatgccaaagggaaaggcagccaaaaaatcatgactccatattcatttgcttttaaaagccaaacactataaagggtaaaaataaaatactagcaagaatcttgtaaacagaatcagtaattgtattgtgcagtgattacctaaatgcagcctgccagcccagactatttggaaagaggaagtaagagacactaggaagaagacttaggaattagagagtggaggagggttgaggataaagggcttctgaattattaatagaccacaggaagtgttcctctgttgacttcacatactgtttgggtacctggagaccagtttactctctttcactttgttcctactgatgyattgttttcatctcaaagaacaggccaccagtggccttaaaacactgtaatgtgtgcaacaaaattgcagccttgggctatgttccattgttcagagacatcttgccagctttttaaattcaaaataatctttcagaatggtgaaagtgtgaaccctcccctgtaaaccatagcaggggatacaccccaatgaacataatgacattctcagaagggaaggaacagaggaagtgttgcataggtattaaaagctcaggatctggattcgagccccagatctgctacttatcacccatgcagacttgggcaatttgctcgtcccctttcagcctttactttttttgtaaagtgacctgttacttcactgtgcttgtacttctcattcgatttttggtgcaaggctgttcttttttctcaagtggttattgtgtaagtgctataatcgtatcattcagagacgcagttgaaacacagctttagtttttgtctcccattgccccatgacattttgcgtagtggggttatctatcactgctctcgcatggaaagttagaaaatttcaaggctttttagcctgcttttaagtgacagtccttgggtcctgctaaaaatacaaatagcctcaatttagaaattagaatgtcacctccaaccaaggtattgttcaaatatccccatctttgttgttaaaagaaaatctttaaaagaattatatttagcaaaatttaattgaacaaagaacaattttctaatcaagtaaccctcaaaaacgaaagaagttcagagagttctgctcagcaaagtgggcaggcagcacttataaacagcaaatggaaatgaggtccagaagcagcttgagtagttacaggtgagcagttgtcttactgggcataggctgmtcagttggccacatgggattggctgtagcttggctgctgtgattggctgagactcacctcgttagtacaaaaaaaaaatactcctaagttaggttgcagtttgttatgtagcgactcaagttacgaggcatcctcagaccaaatttagtttaatttaacattatttataggaaaacaactgcctcacctcttccacaaacacaccttactctttttcttgttagtctttttctcgagttctaacttcttagagttgtgtgagacatctttattggggaagcctctggaccaggacagatgcttctttgtctaggttttcacttgcgactccatccttccccgctaagagtcttgcttctacctctgggctcttgttgttgagaacyttccatccctttaggkggccctattggatggcatctaacattaagtgtttcttttcattttaactactactatctagccaactagagaccagccacatgcaggtttagctttatcaggagaagccaggcaccagtctttgtgtctgtaaatttgaggaaacatccaactctctcattatctcctggaagtccccctactaggctgaggtaaggggagtgcaccccgaaacttcatccctttgggagggtggtgacttacagaaccataaaaacatgctaaaaaaaaaaattcacaaatcctctccctctttccactctgacagctttttatatagcctgtttatgactaagtaaggggaagcagtcatgaaaccagtttccaaaaatagagtgatctgactgaccctcatcccattacctaactctgttgtgttagcactttgctcaaattctgcataagaagagtctgttcactacaagctgaacttggacatatcaataaatttttggtgaatttttaacttcataattttactcactatttcctaacttattttttgaatttcctttattttttcttcttaagaggtctcatttggataacatacatttttacctttatattttctttctttctctgcttgttgactaatttttatacttttctccttctttaatacattaggtttttttttaatttaatactgcccactcaacattttttgttcattattttctttctttcttttgagacctagtcatgctctcttacccaggctggagtccagtggtgtgattttggctcactgtaacctccacctcgtgggttcaagtgattctcgtgcttcagccttctgagtagctgggactacaggtgtgagctactatgccacgcttatttttgtatttttagtaaagacagggtttcaccatgttggtcaggctggtcttgaactcctgacctcaggtgatccacccacctcggcctcccaaagtgctgggattacaggcgtgagccactgtgcctggcccattattttcaatataatagattatctaccatactgccttgtgaggattaaataagaatacctgtaaagcacttagcacaatatccaagttactaaatatcagtaaaaaagaagaaaagtccccccagacatattatgctctagtcaacacaagacttcctctacatggacttgaaattcagcatctctttagataatgaagagctcattgcttgataaggtgtcctatctcatggttagctcaaattgttagaagttcacactgaaattacagtgatttaatgatatgaacctccacttctctatactttacatgaaaaggaagctttgagtttgccacatcttttgctacaactcccaaaatcatgcccaaccaacttttaagtaagggccacaatcttgaccccagcatttaagacccttaacaatcaggtcctaccctgccattcgtcctggctttatttcctggtatatctctatataggccccatatttctgcccagctggatcacttctccttccttgagctctgattttacttttctacttgtgcacctgcayttatgatgtttcatctccaattcgtttagcaaaattctgcctatgttagtcttataccatctcatcttcccttcacctattgaatcctagtatctcagaagtccaactcagaatatctccattctctgactacctaagtcaaaaatgatacctgactttgtattcctgtagcagaatatttataccactcgcattgtacttttagtgttttatctcacagaataggcatttgtatcagttgcaggttagtttccccaggaaacagactcctgagatgaagattgcatggaggaagtttactggaaaggaatctcaggatcagcatctgtggaggaatgaaggaagaaggcttgggcagaggagaaactgacctgtgatgtaatcacaactatggcstcacctgttcctgtggagagccttgaggctgggttggcctggtaaakttgwcccaaactggggcaagcaggcatgcctttgtaacccctgtttattagtcactgggtgtggattgtaccttggaggaggcatcatgttgggcagcacagctctcttcaggcaagggcaagtcctagaaagggactcaggtgagaatatcagctgccaaccctcccagaagctgaggagacaaagaagctgaggaaataagagttcatccctggatggagatctaggcagcaaaacgtgacatctactacagtccaaccctttgtgtcactcaggtcaattttcttcataaaataagctttgagatcaactcttctggggttttgcttggtccctcttcctaaaggaaatatacaagaggaacgttagtgaaataaactacaaccttcacagctacagctagtctcgaggccataaccaatacttgtcattcctcttctcccctacccgttctgttttccccaaagaggtgccctttgctagcacctcttctaatctaggtggtttacctggtgagacaacccagaccctcaatcctcaaggatctgagtcataatcactgggccctcttgggccatggctgctgcaattgtctgtatacatcaaatttggacaagggaatattacagaacgcctaagctggattccaaacatattcttccctgccacattcagtatgtaagtgcagccctcaatgtccttctgattattggagtcaattacccttcctgcatggctagaaaacccatggtaactcctcgccttcctgataatcaatcagcatgaggaaactgaaatgactggacagtaacaacagctttcagtttaaaggaactcttcctatgctctctggaaaccggaatttttataagtacagagtccatatttgtagatttaaagtactaattctccgagtgggttacttggagtgacggtatatggaaacactccaacttggttcctggaaccatgtatactacctagtagggacacagcaccacatgagtattgatttaaagtgtgcactggaggatgttgccttccaagttagcacctcaattgatccttcaacaaaccatttttatttcagtaacaggatagcagcaactaggtattctggtatgtgagaggctaagtggattccatggtaatggacccatttctgcaattcccttgttgtaaagtggagcccatgatctgataggatgttatgtgagatgttttatcagtggtcaaacactccgtaagcccttgtatggtgatgcttgcctgaggccctacaggcaggcgagataaacccatacccagagtggaagaggacagatgtagtcaacttaccacccagtgactagctggtctctatgaggaatggtgctgattccggggctcaactttggtctccgttgctggcaagttagacatggggcagcaacagtagctagatcagccttaatgagaggagtccgtgctgctggagccatgcacacttcatctctgccatcaggctattctgttctagtgccttttgtgccagcattggggtggctgttgacacaggctgactgacatcaactggctgagtcatttgtttatgcagctgtttaatgtctattctgttgtgggtgctcctggttaggcattaataaatgatacaaagatcttcacactttctgcccactctcatagttccattcacatccccctttctccaatctctttgtctccaatctgtcaagatttcttcttccaggttcttgaggggttttccagtcatgtcacttgccactctccatgaattcctgcatattctaacactggaaacaccttttccacccaaggtgtatgatgagatgcaacactgaagctctgcctatttgggacsatttccctctctgctctctttcggtcacccgagtgagtccataatgcagcaccacttcacttttttttttcttttttgagatggagtctccctctgtcgcccaggctagagtgcagtggtgcgatattagctcactacaacctctgcctcctgggttcaagcaattctcctgcctcagcctcccaagtagctggcattacaggtgcccgccaccatgcccagctaattttttgtatttttagtagagatgggatttcaccatattggccaggctcgtctcraactcctgacctcaggtgatccacccacctcggcctcccaaagtgctgggattacaagcgtgagccaccgtgcccagcccacttcattttttacttgtacccatgcactatcaacttgactgtccatgtatcagacttcctcttcctacttgtgtcagttatgatcctctgagaagcagacaccaagatgggattagctgtgcaagaggtgtgttgaggaaaatgcttgggtgcaagaaatggggagagggctggaggaggctgggagagccatgagactgcaatgcaagcttaacccctgtggaggagagaggaaaggaaggaagcaggtagggaacatttcaggtcrtagtgcagttctaagaaagttttggcaaaaccaaccaagagtcctggccaggcacggtggctcacacctgtaatcccagcactttgagaggccgaggtgtgtggattacctgaggtcaggagttcgagaccagccttaccaatatggtgaatccccgtttttactaaaaatacaaaaattagccaggtgtggtggtgcgtgcctgtaatcccagttactcgagaggctgaggcaggagaatcacttgaacccacgaggcagaattgtagtgagccaagattgctccattgcactccagcctgggtgacaagagcaaaactctgtctcaaaaaaaaaaaaaaaaaaaaaaagtcctatagscagagtcacacatcagaagagtttccagttttgtagaaagagcctcccttagtatccccaccatactcagttattagctgcaagaagccagtgggaaatgtggtattagcactaacacagggacagatttcagagcacagtagctgggggcttatatcaagtacacatcttgcagctggagagtgagaaagttaattaaagctgaggcaagactgtaaatatgcactggtgtctgtcccaagtggatgttaactgttctgatgctttttccgactgacatatccagcgcaatagctgaataccatatgcctgagactctaccccggcaaagatgccacatcaagcactatggctgcaattgagattgttgcttggttgagtttgattgtttgctgtcgttttccaggatccatctggtttttgtgggatccagatggcaaattaaatgtggwtttgatgggatctatcatccctgcatcttttaggtctttaagggtggtactgatatttgtcatttcccctcaaggatgaattttttttttttaattttgatatcttggctgggaggttgggcaatttcagaggtttccttttggcttttcccactatgatagctctggtcttacagtcaaggaaacaatgtggaggttctgccaactacctagtatgttcatgtcaattatacatttggtgaccagggaaataatgatgggggaatccattaacatggtgcacccgctatgagctagtcttaggctagggctccagatacccaagtttcaaaatcaacttggatagtgaccctgcatccaacacacctgaaaatatttgagtattaccctttccccagggtgcagacttacctgaggaaatttccataggtctctttgggaaaggactgaaggagtcatgatctttttagattctttttttatacagttgcagggtctttccttgtggggacctgaytcctccttcaggcaagaaattctgggtctaagaacagctcagatctggaaaagggcaatggattatgacttttgattaggatagctgtcctcagcctctctcattatccagctttgatttatttttattgtaaagattgagcaatccttttgttggctgcttctctatcttgcccctaagaactctgtgttctcctaaccgactccacaattttctaagggtcatggtcctctggctgccactccgaccttactgctcattgtaataactgtgcccaacttgttactggtggttaagccctcccgcctggcttctctatacagggatcttaacatctccattggtatcagagagctcagttctgtaatggcatgtcctgtagttagccctcaggatctattcccacctcccctcctggccttcaagccaataacctagggtagtcacaacataagctggctgtggaagtgctgggcatgttaacaaaggaaagggactataccccaaaggaggtgcactcacccatgctacagaatttaacattctagttagttccttgagaggtggtacaaacatgctgttagggtagtttttggaagcttggagaaagcatggcctgcaccatctgagctagaaatgtcagagcgaatgtggcagatggtgaaaaaagagatagagcacactagaataaaaatgctatgtaaggctagaaaacccactgggtgactaygctactccaagggcccagagaacattctgtttatgaaaataataaggaatgtgctggtgagatgagagggttaccagcatcactgagaagcttgttagtggctttttcacagtcaaaggagatttttctttaaatttaattttcttgaataaatacaagaataggagttcttttgggtttaaaaagtaaayaatacagaaaagcataaaattagggagaaaatactaaaatttcaccatcctggtgaaaatatgaacatgtttgtgatcatcctttcatacatttctccacatagttatacctccctgggtataattgtatactagttcaatgttgtatctcctattggtactatagaaacctttcttttaaaaagaatctcatttgttcttcccctgccacttacccaaggcttcaattgccatttcccaccctccaaatcaaagctaacaatgtgttgtttatttatgtataattttctcctgattttaacacatataatttttctttatctttctaacttttttccaaaaataggatcatatttcataaagttctccatatcttgcttttctcccttaatatgccatttaaagcccccaagttaactgttataaatcaaactcattttttataatgactgaaaagcattctagaatgtggagacactaccaacattcgacaattctgttactgctgagcattcacatggtttttaggttttgttactatgaataatgccgtaatacacatccttgaacatgtatctttaatcagtggtttaatagtttatgctaaacttgtaccagagattgacataaaatttctcagtctagctacttttcccctcttctaataagcaagtctctccatagacttatttccagaattcagaatattttactcaggatttccaaaataaagccaccctccacccttgttaaagttatccttggtgggcgcggtggctcacgcctgtaatcccagcattttgggaggctgaggcgggtggattgtctgaggtcaggagttcaagaccagcctgaccaacatggtgaaaccccatctctactaaaaatacaaaaattagccgggcatggtggtgcacgcctgtaatcccagctactcaggaggctaaggcaggagaatcgcttgaacccagaaggtggaggttgcagtgagccaagatcacgccattgcactccagcctgggtgacagagcgagactccatctcaaaaacaaacaaacaaacaaaaacaaacaaaggaaaacaaataaaattatccctataaatcacagctcaaatgttacctttctaacttctaattgcctacaagataaagtccaaatttctcagcatgcattcaagaccttctctagggaaggatgaacataacttcccacactcatttctgtttagctcccattcttctcttgctttaaacacccgtatcctatacttggcaacaatgaacaagagccatttttccaaaaatgccctttatctcttgctattgtgcctttacccactcttagacattcttacacacccagacatcccttctatgaagcctttgctaataatgacaaacagaagttatcataacctcttttgtgctttgagagctcttggtacatggttttcttaaataagatgatttatttggaatatttttagatttacagaaaagttgccaattgtaatacaactgtatacccctcacccaatataccctaatgttaacattttatattatcatgatgtattagtaaaaactgagaaatcaacattgttatattactattaactaaactccagacttttttggatttcaccagttttcccactaaagctctttttctgttccgagatctaatccagaacaccatgttgcatttagtcataatgttgctgttgtctaatgtcttgagtgctgttgttccatacattttgtccaggtttttagttatttcataaaggagggtataactggaagcaaagtctaagattagttttaaataaagcaagaggaagcattttttctaatttaaaatatatctatcgtcatatttcaagggcaatatttgtttgaaaataaaagaaaaatctcgttcagttaaaaaaaagggggggctcagagctggcaaatgccaccaacatgcttaattttaatttaaataaaatagttcttgtgaggttactcagtggtatactggaaacctgagaatgccattgccgttaacagagtccacaatccctcacctcactgcttcctttctctccttatcacttacctataaaactggatggagagctgcagaaatgaggacatttgctaagaaattctttcttttctaagtggtatgtgaaaataaagtaaattcatgttgagtcacattaatctattgccttggctgtgtaagaatcaccaagaattctcacaaccttagcaacagttgcaaaatagaaatacaacaaagcaaaggtgagaaaaccaaccaagtgtctgctttttaaacaatctattgatataattcaccacattaagatattaagccagaaaacccatatgctcatcttatagaaagcatttaaaatccacacttattcatcataaaaactcttaacaaagagcaaggagttttttaaaactgataaaagacatctaccaaaaatctacaacaagcattctaatggtaaaatattttaaggtttttcttaaaaatcaggaatcatgcattttatctccacttctattcaatgttgtactgaagtcccaggcaacacagcaagacaaaaaggaaggggaaaaggggctctataagcattgaaattaaagaagcagaacgtattaaaagtacattaagtacattaaaagtaacggcaaaaaccgcaattacttttgcaccaacctaatagtgtgtgcagatgtaatgattacttgcaaagagaaatatccccccaaatatctataccaaaattatcaaaactaccaagagagctaaatagaaaatcaacaccaaaaatcatttttatttctatatcttagcaaaaaagagcttagaggtggcatgttaaaagttaccatttactaacgaaaaggcaaatttgttagaagaaaacataatttaaaaatgtgcagccgggcacggtggctcacgcctgtaatcccagcactttgggaggctgaggcaggaggatcacgaggtcaggagttcgagaccagcctgaccaacatggtgaaacccagtctctactaaaaatacaaaaaattagccaggtgtgttggtgtgcacctgtaatcccagctactcaggaggcttgaggcaggaaaatcgcttgaaccagggacgtggaggttgcagtgagccgagatggcgccactgcactccagtctgggcaaaagagcgagactccgtctcaaaaagaaaaaaaaaaaagtgcaacatctttatggataaaattgtaaaacttttggaaaggcattaaagaatagataaatgggctgtgtgcagtggctcacacctgtaatcccagcactttgggaggctgaggcgggtggatcacggggtcaggagttcgagaccagcctgactaacatggtgaaaccacgtctctactaaaaaatacaaaaattagccagccatggtggtgtgcacctgtaatcccagctactcaggaggccgagtcaggagaattgcttgaacctgggaggcggaggttgccctgagccaagatcgctccattgcactcctgcctgggtgacagagtgagactccatctccaaaaaaaaaaaaaaaaagaatagacaaatagacaaattcactgtatttattaataatgacactcagaatcatgagtatatctgttctttccaaattattaatctattgatccaatataattctaatgaaaatttcatttttttcatgaaacataacaagctgatttttaaaaattatgtgaaaaagcaaaggatcaagacaagaggcttgtaaaaaaaaaagaattgggcagggcagaggggaagcaagagtttgttctctaagatattaggatgtaatatgaagctaccatcactaagatgagtagtattggctcaagggtagacaaatatatcaatagaacataatagagaactaagaaatagagcacattatattagcaagggtaatccttgattatgctataatcactaataaaacctgaaacagctttacttaatacaatatagggttaattctgtcttagtacgtttgggcagttataacaaaaaataccttaagtggtgtagcttataaacaacagaaatttattctcacggttctggaggctgggaagttcatgacaaagcaccagctaattcttgtgtttggggagggactatcttccgcatagacagaaccttcccgctatatattcacatggtggaagggggaggggatctcttttttaaggtcactaatcccattcatgaagcctctccccttatgacctaatcacctcccaaaaccctcatctcctaataccttggaggttaggatttcaacataggaattttggggggacacaaacattcagatcagagcaatttctcactcataatactaattgatgaaggtcatagaactctccctggtgctctccttcaacttggagatcttggctgcttccattatgcaactccacatttgaggctctttgcttctggccgcaggatgagagggggcacgtgcacatgaagacacacctactcttaggcacctataacactcccacgcattcccattggcaaagctcaggcactggctctcaacacaaccacacggaaggctgggtaatgaagtttttctgtctatgcaggaagaggcagtggtgttgatgaaccaacattttctctgccaaacagtatggaaacttgatatatgacaaaattgacatagtggatccctgggaaaaatatagatgatgtaaaaaatcataataataaacgatgctaagaagaaaaaaaaagaagtctatttcttctttacactgcacccaaccaaataattttcaattgaatttaaaatttaaataagaaggacagaagaagtatatgagaatatctttatatcccagatatctagaaagacatcttaaaccacacaaacctggaaggaaatgattaaaaaaaaaaaagcacatcatcaagaaagagaaaagacaaattacaaactgctagaagatatttgcaatacatataactgacaagaaattagtatttagaatatataaagaaattatacaaattaactactacaaaaatacaagtaaattagaaaaaaatgggcagttgatctgaataaacataacatataagcaaaaatatgaatggccrataatcaaatataaacaactgtacttcattaataagtcagaaaatgaaaatcaaaatcacaagaaaatttcatttcataaaaatttgattgcaaaagttgaaaagtcagagagcatcaggtattggcaaggaggaagaacaacaggaaatcttttccactgctactgacaatataaattgatacaaaaaacttgaggactgatatgacactatcctatgaaattaaaactgtgcatatcccatgaaatggcaattccacttgtaagaaaatgctttcatgtgtgaactgtggctagctacttcaacacagatgataatcttgagaatacaatacygaacaaaagaaaaacaagattcagaagaatacatatagtataccatttttataaagttgaatcaggcaaatctaagggtattgtttcagaattcacacatacatgtgtttaaaaatccatgctataaagaaaaacaagggaatgagcaaaagtcaaaatttaaggtagaggatacctctggtgatgtggcaagggggtaggacagagaggagcacacaaggatcttcaggatgtcaaggaagctggactttttaagtggggtgatgggttcacaggcattcattttattgtataattaactaggatcagcataaatattcccttatgcatcaaatatttaatttttaaaattaaaacacacatgcacgcacaagaaaaaggaaagaagtaaatactctgtaaactgacccccagtcaagagagctgttgattttgcaattgcttaggagcataaagactgagagtatatgttctcttattacactgaatctgtagtaagatyctctgtcctaataacattttaaattttgtttcccttttgcaattacctaaaagctcctcacagtrtaatatattccatctttactctttatttartatcaaaatcctcttttatttttttccccagtggccaagttctagctgctcttcctagaacctctaggcaagttcaagttctacagaatcttactacaacatatgaggtaatttctccctaatttatgtttatattggtttcactttgtataagcactgggtgttgagtttcctcctgtatgttgtctggcttacatgtatctggtatgaactcttcttctcatagtcttctctcccttctcataatcacatgattttgttggttccccaaatcaacacttcttcacttgtgctattggctttccagccaatttcataatagtaccttgggatataaagtgtgcacttacaaagaggctacagtaacagaaattaaaatatttataaataaaaccttactcatgaaacaatggttcttaaccaaggatgcaccagaaagacagagtacatttattaaaattctcacccaggcacccatctcgacataatgtctaagatgtagaaaattgacaagaattacagaatattaatggcagtggcggcccatctagagcggctgctgccatgcgggaggcacggctggggctgtgtgctccacggagccagcagaagccaggaggaggtaaaagtcccgcccccttctgtgatggcagggcggcagcctcatgctccccaggcgcagctgcagctgcccgctgcagctacagacctggacatccctgtgctcttgggggccaggrgcaggcaggagccctgccctcctgggcgcagctgcagctgcccagctggggttgcagacccaggcatttctgcactctcagtgttctgagaaggaccctcattcccctacaggctcgsaagtgcctgctcccactgtctggtctctccgagttcctggtgctcactccaatcttggagcaaaattgaggctgagcctaggtgttgtcacaacctggctggctgtgtgcatgatcagagcggtactgacatgctagccccctgctgcctcagccccctctggactttgggtactgacgagcacaggagggaagccaagggggtggctgagggcttctcggcactggcctgcaggccccctcagctggaaaatcctgggtgccataaatagccgtaggaggcagacaggatcctaggcagaaaagggcgggtccctggtgaagccccaccttcaagcccaggaaggctgccagtcccgtggaccgcagtgggaactgacggtgatttttccgcacccgcctatggccacccatgaaccaatcagcactcacttcytcccatctgaagcccatagaaatcccccggattcagccagactcttctggagagacatggggaggaccagctgtagagaggagccacccactccagggtctcctctctgctgagaackaacactcatcaggacaccctggctgcagagaggagctacccaccgcgagtctcctctgagctgttctattactcagtaaagctcctcttcaccttgctcaccctccgcttgtccacgtacgtcattgttcccgggcgctgaacctgccaaatggtggaggtgaaagagctctaacacaaacagrgctgaaacacgccccttgcttgccacgttgtgggtgacaagaaggagagaagagctgcagccttttggggagctcagacctaagaactccccgaggcaggactatgacaccctctttagggctctgtggttcctgacgtctccaaacttctgggtgccaccaccttccccggtgccagccattgaagctgcttgagggacacctggtccagccacagccttgcagggagccgaaagatgcccaccctgccgcagccagcatgcctcgctgtgtgtagtagctggaccccacacctgctcactcacacacccctcaccgctcagctcgcccttggcacgaatgagacccaagccagtagcacgagatgagtgcagcctgccaggccgagtgggctcagcgggcctgagcaaagcttaggcaaaggcgccactgaccacagaggtttctgctggtgaagcgaccccagggatcctgtaacaatatcatggtacaaaattgatggctccttgtttgttagtgttttccaagaagcagaggtyaagactagactggaggagcaagcgatgaggggaatgctgttggaggatagaggcgggagctggagaaggcagagagcatcatcagaccatgtcatagctctgacacctctgcagaaaggggaattttgtttggagaatctcagactatagggcaggtccaaagaaggctgggctaggtcagtctcagtctggcaagaatgggcctgcattaacacttccacaggactcggttactggctggatgcagccctgagaccacatggcctcagcttctagtgggtcaccagggcagccactgaaaacaccagccaactgtatttctctcaaccgaagagctaaatggtgcatattcacgaccaccacatcatggtaaagaggaaatactacaagaggaagcatctgagatttagaattctagttcttgttctgtcatttctaggtgtatgattttagatgtcaggtatgaaccttaatttcttcacctgaacaatgcaaataataacacctgcctagtctatatcaaagcgttataaatatcaaaggaaatgagtgtgaaagtgctttgaaaaagtacgtgtagtggctcgtgcctgtaatcccagcactttggagggccgaggtgggcggatcacgaggtcaggagatcgagaccatcctggctaacacggtgaaaccccgtctctactaaaaatacaaaaaattagccgggcgtggtggcgggcgcctgtagtcccagctacccgggaggctgaggcaggagaatggcgagaactcgggaggcagagcttgcagtgagccaagatcgcgccactgcactccagcctgggagacagccagactccgtctcaaaaaaaaaataaaaaataaaaaataaataaataaataaataaaaagcacattaagagagaaaaaatgtaaatcttattggaagcctttttaaaaaaaggaamaatgacatgatgataattacaagaacatgaaatttttattaaataaaatcaatgtttaatcaactttctttctagaaaaaattttgtttcctttcaaatatctgatgtacacatgcaattttacagttaagccatgaatatagtcattcattcatcattgtctcatcaaatatttatggattatcttgtayattccaggcccttttattttatttttttttagcaactagagttatagaaaggaattttaaaaaactcactgcaaaataaatgtttatattaccatgtgtgtggatggggaccagcaccagggagtgtccttttcatactccttatagataaaactgtcatggctctagctacagatgagaatgatgtgaacaactcttttttaattttatcaattttgccccttaaactgtagattgttctctggcagccggtaacagctgaccttattgtgaagaaaaaacaagtccatttttttgtaaatgcatctgatgtcgacaatgtgaaagcccatttaaatgtgagcggaattccatgcaggtaggcaccgttcaatacgtattgagtagttattataaacacttactatgcacttgactagggtatggtataattgcttcctggaaaaataaaatgtattaaccatggcagcatagaagtctctgactggaccaaatggactggtgataaagcctaaggtccagctctgtgatcttggataaatggttcaacccytcatgacctccgtcccttatctaaaatgcaggttagactcagtgattggtaaaggctctcatagttcctttttctctgactctgtacccagactcagggagcaaaactgtcatttgccttggtaggctttttgatatctcctgaaaaagcagcttcgggaggggatttagcttctgctaattcttcttcacaaagacagtgaccatttctgaatgtctggctttaaaaagtgtaacaggtggttggactctgcagagacctcgggttagtctggcactgccccttaccacctatatgaccctgggggaattattcacctctctgctcccaagttttgtatattaagggtaaaaacagcacctaccctgtggattagaaatgatttccttttcttaaaaagtgtatcaggtacaatttctgctcacagtctagccttcttcttatggagtctcctaatatctcccctccatatccactgcccaactgccagtaccttcctggtggcctggccccttgagaccatgctctcttctgtgtatcaatgggtgccccctggataatatgctatgttaattattagtaatatattatagagtatattataggtgtgtactgttttccaggaactgtgctgaacctttctattaattgacattgtgtctattaatctttatttaaccccgtgaagtagatgcaaccccattatatagatgaaaaaatatccttacttataaaggaatttttcagggtaaatcagaaagaacatggcagagttaggagtcgaacttagacctttctgatgtcaacactgcggcttttatttattggcctaaataaaagtaaagaaccctttattagtatgatagctaactttcaacttgtccatctcaggcgatagaatgcctgaattcagctaaaatatttgcctggttaacaaatgtggtgctctgaagagaacttgaatgagatgcctttcctgtacttcccttttcctgttctatttctttggctctgcagaacatctgatgcaggtcaatgggggaaaaaataagaaaaaaaaaaaaagaaagaaaaggcttttctgcttcttcttcctctttaactgaaaacagcataatacagtgttagyctggattgaacaaaggtacattaatccatatattcatataaaagacactgaagaatcaccattgagtaatgttggtaatggtgggaaacggtggtttttatggaggtcctgaaartatacctaataggagctactttttctctagtgcccatgtaggctctactgaaagggtttgtcaaccagtttaccacaatgcgagatgtcttacttttaccttgatgaaatgcttatgaagtttcttagtgattttttttcttcatgctcacctgctgtgcctgcaatgggccatgtgggaagatccaccctctgcttggaaactagctcactctctgtttcatcacctagtgtcttgctggcagaygtggaagatcttattcaacagcagatttccaacgacacagtcagcccccgagcctccgcatcgtactatgaacagtatcactcactaaatgaagtaagccatcacacagctcttcaaagctactattttcatttaaccagtattgccatttcaatcaggggaatattcaagaatcataattggtggaagatggtaaaaaataaaacacaaacacacytaggttaattaaatggtggtcattcattttttggtagatmtcttccctgagaagactgcatcatatttggtaaactgcaggatgtttgtctacagctaagaatatctctaactgctgggaataacactttatgctatggaacaacagaaattaaagaattggggcttttaattaaaactgccaccaaaaaattaccagtccaattaatcatgtctctttggaccattaccctaattttactaattaccagattagctcactgaattaaaggaatatattcacttatatttaatacactataactaattgcattttattccttagaaggaagctatttaaactaataataataataatgcctttgttttaatctgtaagaaattggattttttttctatcagtacttacaggttccactccttctagagagaacttgagtaagatgttgatgtgcaggtgagacctcagcaagctttcacataatccactaaaagccattccctgtatttgttagttgaaagaataaatkcgcaggaggactttcttttttatatgatattctccaagtagtaaaaataccttgatgcctttttatgagtatgcagctatattgcctaatataactatttttgtcatctttgactaagtgcccagaaactattagggaccatatccatatttttaagacatctaagacttaggtaatgagaatcaattttatgtatataatctttaaaagcatctgttccttcccagttaattaagccagagtcagtatgcttctagaatgtgtgcctggttgattgagggggccttaaaattgcacccccccttttttaatctctcctacatctatccaacttagaccacctctctccagcatccatcagcacgactgcatgagcaaacttgatgcagagaggcttcataggtgggatttcaccttcatayaaggtgaaactgtcactgctgtgataagtttggtggggagaggggaatgccrtaaacagaagtatttttaaatatttgttaaaacatattttaattattttgttcaaaaaagttatgttttcttacgatatgttcaggaaagagttggaatgacacaggaggaaaaaataagcacatggctctattagttttctagggctgtggtaataaaataccacagactgtgtagctgaaatcacagaaatttgttttctcatgattctagaggctagaagatcaaggtgtcagtaggtttggtttctactgaggcctctttcctcagcttgtaggtagttgccatctcacagcgttcttcctcatatgccttttctttccttttttttttttttttttttgagacagagtttctctctgtcacccaggctggagtgcgatagcatgattttggctcactgcaacctgcgcctcttgggttcaagcaattctcctgcctcagcctccagagtagctgggactagaggcgcataccaccacgctcagctaattttttgtatttttagtagagatgggatttcaccatgttggacaggctggtcttgaattcctgagctcaagtgatctgctcgccttggcctcccaaaattctaggattacaggcgtgagccaccatgcccagcctcatatgaccttttgtttgtgcacatgcatccctggtctctctctgtatatcttaatctcctcttcatataaggacaccagtcagattggattcgtgcccactctaagggcctcatgttgacttgatcatctctttaaaggccctatctccaaatacagtcactttctaacctactgggagttagggattgaacatatgaattggagaaaggggtacaacatctactccttaactatgacattatagaaaatgtcttgtgcttctctttgcacccccgcccctattattttctaacaggttcataggaaccataagcattttgctctcagaatattcctctaagtgcttctttccctttgatcggtggtctcttgatcagccctacctacaagatggactggtgggcagcagaggttattttgtcattgactcacaccaggagatcttaaatgatccggtgtagggagaaagaaacaaatggccaaaaattacttcttagaagaaatggtgagagaaaagagttcttcaaaggatgttacattattaccccagcttagtttgagaaatgaataaagtctgtcggttaaactgccttcatattatacagcctctcctgttagaggaaatctactgaagtatcaatgcataaattatttttttgtggtagctttctcagatgtatttatgcctagaagagtaacacaggaaatggagattcaattaggaaattgctgacagttacatttctgacaccccagacactgacagggtcggtacttggtggcaggtgggcaggagcccttaattctcagcatggggacaaccactcacacctaccactcatgctggttatgtgatctcagagaacccaaggataaatggtgctccagtttttaccagctaggattgctatttgaaatcacctctagaaaagttcccagagataaagccagggtttgattgcttctgtttcagaaggcatcagagtttaagaatggaccctggaaagttggtccaaattaaaacataacccagttcaatcccagcaatcccaaaccagacaataattcaatgtttgctttgaagtgggtgctagcctaaagtcagaatttttttcttttcttttcttttcttttcttttttttttttttttttgctttttccttcccctattatcttgacagaacctcaaatacaactggacttccacccaagagagaggtccagaatcgaactacttcttggggggataattgagtttgtttgtttttcctccagatggtccccacctttgcctctcatcattgtgccaatctcactgtgcttgcacaggtctttagtgggaaacaatgatgcttccatttatcctgcatgaagacagtgctaagggctcccttcatcttgaaaagtgcatttttaaaaaagtctcatataaaagtgaacttttgaatgaatgagaacaagaatttcatacacaggggcagtgactcaatgtgatgactttaaaagtaactttcaggggccatagtttatagattaacttttcctacctcattataagtatcttagcactttttcactctttctcaaaaccttgacacttatcaaaactttaattttattaatttccctaaacagcagaagaaacaccctgccctaagtgctttaggtcctcgtgcattccacatacagaggttttcctttctctgaagaagttgtctgcttgctttggtcagggaaatgctttgaacttggcttcgtgactaacctctggtttccattttgctagatctattcttggatagaatttataactgagaggcatcctgayatgcttacaaaaatccacattggatcctcatttgagaagtwcccactstatgttttaaaggtatgttgtggggaaagttgttgatctttcactgtgaggggagggattaattctccagtcgtgtttgttaaaacttgagtttgtttcctttgagttctgaaaatatttgcattacaagtgttcctcaactttaatacctggctatttaggggttggttatttttcccattaataatatagtcttgtcctggtctgtatgtcctaatctcctcccacaaggacaccagtcagtctggattagtacmcaccctaagggcctcatgttaacttaatcacctctttaaaggccctatctccaaatacagtctctagggggttaaggcttcaattctagatgaatcccagttctagaattaactctgtttctgtttatgtgacattagataagccatttaacatttccataaaatgaaggaagtggtgtttatttttttcaagtccttgttttattttcgttagtggacaaacactatttctgttaggggacaaacactaacagaaaataaaacagggacttgaaaaaataaaattaaaaattaaaaaaagtggtgcagctttttgatgttaatttttaaaaattgatacataataattgtacatgtttctggggtacatgtgattttttttctccctccctcctcacatgtgatgttttgatacatgcatacaatgtgtaaatcagggtatttgggatatccatcacttcaaacatttatcatttctttgtgttgggaacattttaagttcatcttctagctattttgaaatattgttgattctcgtcaccctactgtgctactacacactagaacttattccttctatctattttgtacccactaattaatctctctttatcctcctttcccagcctctggtaatcaccattctactctctacctctatgagatcaacgttttccactccccatatcagtgagaacatgtagtatttgtctttccctacatagcttatttcagggcatgttgctgcaaatgataggattttattccttttaatgcctgagtaatattccatttgttatccacattttccacatgcatatccacattttctttatccacatccacattttctttatccattcatctgttgaagaacacttaggttgattctatatcttgactattgtgaatggtgctgtaataaacrtgggagtgcaggtatctttttgatatactgatttcctttcttttggatacatacccaataataggactgctggcttatatggtagttccatttttagttttttgaggaacctccacatggtttttcatagtggctgaactaatttacattcctaccaacagtgtacaagggttcccctttctccacatcctctctagcattcgtaattgcctgtcttttggataaaagccattttaactggaatgagatgacattgcattgtggttttaattcacatttccctgatgattagtgatgttgaggattttttcatatacctgttgcccatttgtgtgtcttcttttgagaaatgtctgttcagattcctttctcatttttaaaattggattatttgtttttttccttttgaattgtttgcrttccttatatattctggttattaagtccctgttggmtggatagcttgcacatattttctcccatttttttcttttcacgctgttatttcctttgctgtgcagaagcaaattttcagtttgatgtaatcccctttatctatttttgcttctgttgactgtgcttttgagatcttacccaaaaaatctttgctgagaccaaagtcctgaattgttttcccaatgttttcttctagtagttttatagttttaggtattacatttaattctaatctgtttttagttgattttatatataaggcgagagataggcatttagtttgaattttatgaataaaatttttcccaataccatttattgacaagactgtccttttcccaatgtatgttcttggtgcctttgttgaaaatgagttaactgtagatctgtggatttatttctgggttctctattctaatccattggtccatgtgtctgtttttatgccagtaccatgctgttttagtactccagctttgctcattctgttcagcattgctttggattttcaagatctcttatggctccatatgaattttagaattttttttctctttctatgaagagtatattgatattgacagggattgcattgaatctgtagattccattcggtagtayggacattttaacaatattaattcttaagcccgtgagcatgaggtatcttttcatttttttgtgtgttctcttcagtttctttcatcagtgttctatggtcttaattgtaggtctttcacttctttggttagatttattayaggtttttttttttggtcattgtaaatggtatttctttcttgatttttcttttaggttgtctgctattgttgtatataaatgctactgattttgtgtgctgattttataacctgcaatttactgaatttatcagttctaacacagttttttggtggaggctaggtttttctaaatataagatcgtgtcatctaaaaccaaggataatttgatttttcccttccaatttagatgccttttatttctttctcttacctgtttgctctggttagtacttcctggtacagcttttgaaactaaagtaagaccaggacaacaaatcccagcgagggacaaacagccggacaaggctgaagtcctttgcagtagggttcttatgatggtttctactccaatttccacccatttggttatttattttcagtygcaaaatattatgcaagagaaattgattaacctaacttggattggatgtcttctctcttgaataaattgaccttagtaaaggtcagtgaacatagccacagccaattgttttcagaactaggaaacaactctatagttctgttttctacctctctctcttaaaaaaaattttttttaaagctctggaaaataatgtagtcactaaaaatgtacatttaatttagtaacatataatttatgcacagtatcccaatattatctaaattgtgataggtgagcctcttcagtcattcaaagataagactttgggttaggacttctcaattttaatctgtcgtttacaagaacttacagtgcagactcaaggcagacatatgaaatgttgggtccccttggtyaytgagttggtcaatcagattggatccatgtatcatggcatatccacccatgacatttgctttcagccatgttgtgtgtagtccttggaacatacttatctggaacctgtacacgttgaaaaatcatgcattctggatggtttggtcctactctyacttgatcaaggatgtgcagataatgtgagtctctgggattttgccaacttttcggtgtcagaaccagtgccaagaaaattggcccaggacttagaaaggtcaagtaaagtaaykaatccagacaacttaagattttctttgcattgagtagattaagctaggtagttctctttgactatacaatttgacgattagtggccaatgccattgggctttctyacttactatcctgttaaatattgctagctccaagttaggaaaaaacctcctggagtggttcaaatgacaatctaaatatctaactctttctttttcttattttggaattgcaagtctacatatttgtttgattttacaacagtcttctcccttccctctataccagtggtcctcaacccctgggctgcagacaggtaccagtccatggcctgttaggaacgmggccacgcaactggagatgaatagccagcgagcaagcattactgcctgagcaatgcttcctgtcagatcagtggcagcgttagattctcataggagcacaaaccccactgtgaaccgcgcatgcaaaggatttaggttgcatgctccttakgagaatctaatgcctgatgatctgaggtggaacagttttatccccaaaccatccccaccactgattccaccccaactctgccccatccatggaaaaattgtcttccatgaaactggtccctrgtgccaaaaaggttggggaccactgctctataccctaaactgtgttgtagctgacttttaaaggcaaatacattatgattaattttggaggtgttcttgataattcttctaaagacatcaaaggctattattgagaaaaggttgatgattcttattccagagttagcagcttgtgttagcccaccatactgggaaaaaagcctctgtccctggatttgctggtaagttcgtgagaggttagatgtrtgcttctttttgtgtgaaataaagaaataatccacataaaaaaatatgcactcaggaaaatcttgagggagtttttgctcygggtgtgtctccacacctcccggggaagattgccatccaactcacacccatttacctctaaatgaagcatgaagatacagcccaaatcattagttctctggtctcttctttgaaacttccacatgcagctctgacatgactgcataattgtggaggataaaaacagttttaaatcaaagagtcctggcttcaaacttcagtttcaattcacaccagctttgctaccttaactaatgtcacttagtatcaccagtgtttaaatttcccttgagaattttcaaagaaatgcagaacaatgcatatctcagagatttgctgaaactattaaatataagcactatataaatgaaagttattatcctgaagcttattgttactgtttttgctacttttggggtttctttgagcaggtttctggaaaagaacaarcagccaaaaatgccatatggattgactgtggaatccatgccagagaatggatctctcctgctttctgcttgtggttcataggccatgtaagtattcacattctcttaaccctatttctcaaaatggtgcccaagatcacctgtgtcagactcaactgggctatttattaaaatgcattttcctaggtcacatcatgaagcttgggaatctacaattttcacaagtttcccaggtgacttttatgcattagtaagttgaagaacatgacttcaagcatttaaatcacccaaaatatttttggtcttttctacatttctgcctggagctaaacagtggaaaatgattaagaaatagtacattgggccgggcgcggtggctcacgcctgtaatcccagcactttgggaggccgaggcgggcggatcacgaggtcaggagatcgagaccatcctggctaacatggtgaaaccccgcctctactaaaaatacaaaaaattagccgggcgtggtggcgggcgcctgtagtcccagctactcgggaggctgaggcaggagaatggcgtgaacctgggaggcggagcttgcagtgagcactccagcctgggcgacagagcgagactccgtctcaaaaaaaaaaaaaaaaaaaaaaaaaaaaaaaaaaaaagaaatagtacattgattataatatgtttactaagtagaggaaaggactgaaggagttatctaagttggggcccaattaatttatttctcttttggttttaattatccagacatcttttgccacctttgcccttggaaattgaacataaagcacaacattacagaggtgaaacagaatatgttttctcatatgtcataatagggaattttcttcctgaagaagggttttgcatcaaaaaagccatatataagacaaactgtatgttggaaaagtaaaagatataacgactattaacctccctgatgaatgaaaacagtaaaaattatgcttcaaatcctataaaatgggcatatatgttctctacactgatttctacaaagaatcatagccactggaaaaataactcaaaatatgtgtctttctgataatgatttttgcagtctttgcattcacagatacatagtaacagaataaatgagttaggaaattaagatattggcacttattaagtacatcaagataaaactgtttctgtctttgcttgaccttgacaaatgcaacatccctatttgccttcattcactgtgaatcttctatcctccattctccatggatgggagctgcaacctccctgagtctactggaaattcccaaacaccattggtactaccttggccaaatgaggatgattccaactgatcagacccttaacatatcccagtcacatcatgatctggaaccttccccaagttgagtagtttggttattttaggtagtgaagggagcagcagttaatagagaaaggtccaaagtaggagagtaagaacatttattttccattctatcactgaacatgagaagggccaagaagaaacctccattcatattgactctaatttatatcggtgaggttgtccctaatgactgcccttctcaccctgacacctctgccctcctattagacatcctaccctctacccaaactgcttgctgaatctttgtaagattaaattatttaatccacaaatatttatarattgcctatgatgtttcagatcctggaaatacaaggatgaacaaaatatagcccaaggatcttatagctgagtattttgctccaacaatgtgaacctgatttgtgtagcccaaagaaacataatcaataagggctttttaaatcgacatttaaactccattcttgcctgcctaaaactaattcagatcatctgactctcttagtacttcaaagcactggaggagggaaagtaaaataaaatatttacctttcaacaattgtgaaggyaggttttatattcaaaaactaaaccacccaaaggcaaattaaaatcttagcttttaagtctctcactcttttctacaactcaataaggatttcaaaaatcttataatctagtctcagtggaaatccactacactacactttgagaagcttgaagccagtcatttctttctaagcttctcattcatgtactctcgggaggcaaatttagatccttctctttccgcaaaggcagagctgagaccaatttgtgcatgactgcatcaccaagccaaaatccggcacagggctggcacatcataggacccagtgaatatatgttaaccatcacaacttgccaagtactttttctgccaaatggcttttctcactgctaacctcctgccaaacctctgccctagaaaactctcatctaattgcacacaaagttagagctctacaacctcagggccttcacagaattatctctgcccctcctcaccacagctgacacatgacctaaggacactgctccctggtggctccttcaagtagaggggctgctctttttttcacatcaccatgtgctgagaggcctggtggagtrgatcagcattctcttctcctgatactaccaatgatccttctcttctcagaaacttacacaaactggttgcactcttattttattgctatcgtgcactgaccttcagataatttcctggtayccggttcatgattctttattcccctccaactcttgccatcattctgagtgaattcaaagtccatgtgtgagagtcacctaacaatgtatcttcacagttccttgttctctgttctactaaacctcatctcaactcctctttagcagatttctcctgtagccatcctctggatctcagaagtaatgttttgctgawccttagacccagaatgtggccatggacagcaacaaggaatgttagaagaagccatctagcaatgtaacttcttaatttcctgtcttctctcatttctcacccctactatgactgcttttttttcaaccttagcatatttctagttcctacacagatctatatcattttaatttatcagtccctttccaggaacactttcttcactaattggtcccatcacaaattcatccgaaccctcaatttcttgctcccttgacctgctcttctggagttccaaccccaaacactccacagaattaaccatcctttttctgagccaccttgtacatcttgccattgtttattatcatacttatattaatagcattgaactgctgcttttccctttccaacttatcacttctattagctttctgaaggcagagaccargtctaaagtaatttttttgttccccataacctggtatattgtttggtcaacataattggtgctcaatatccccttgtggaatttgaaatttaaattaatgttgcaggtttaggctgacatacaattttgggttgcagagagtatctaaacagtacctactgttgggataaatactttattgtcattggctacagttcaaactatacatacatatatagagattggagtaaaaactgagacrgatagctctctgatatatttgtaatggtaatgaaaatgacattttgttttaaaattttcccttcatgtgtcttatatttttttttagcaaccccattaactgacctatatgtcgttatgtactaatttattatctctcaaatggtcattggttaattcctaggcaggaattgttgttgttgttgttgttgtttagggccacattaaaggcaaagcttgagtgcaccccaggcaaagtgagaggaagagctgagtaatcattgaccacaggccagctgatgggaatcaatcccaccctctcatcactcagtcttacactcttctccattctcctctattctcatcttctttttcttttatacagaggcttctcaatttatgrtggggttatgtctcaatatacccaataaacaatcacaactgaaaatattctaagtaaaaaatgcatttaatatacctaatctaccgartactgaatatcatagcctaaccttccttaaatgtgctcagaacacttacgttagcctacagtagggcaaaatcttctaacacagagcctaatttataataaattgctgaatatccatatcacttattaaatactgcactaaaactgaaaaatggaatggtggcatgggtatggtttctactgaatatgcattgcttttgcgctattgtaaagtcaaaaaatcataagtgaartcattgtatattgcagaccawctctagtaggacaggatttcarttatgttacttgccatgttggtaaatcgtaccttcaacaaatatttatttgtcgtcaggcaaaatttcttcagycactttgaaaaacaatgtggaagttcctcaaaagattaagtatagagttaccatatgacccagcagttctactcctaggtgtatacccaagacaagtgaacacatatgttgacaaatgattatagcaatattattcataatagtcaaaaagtggaaacaactcaaatttccatcaacttatgagcagaaaaacaaaatgcagcatattcatgcaatgaaacatcaatcagcaatcaaaaggaatgaartactgattcatgctacaacatagatgaatcttgaaaatactatgctaagtaaaagaaaccagatacaaaatgccacatatattattccatttatatgaaatgtccagaatgggcaaatccacagagacagaaagttcattagtgattgtcagaggcttggggaaatggcaggagggaaaggggagtgagttataatgggcayaggcatggggattttttatgatgaaatgttccaaaaatcagataytagtgatggttgcaaaactctatgaatacaccaaaaaccgctgaatttcacactttaaaatggtgaatttctggaatgtaaattatatctcaataagctgttaaagaaaaaatgggcaccccttccttcgggattgtagctatagccacacttgaaggtgtggcttggcacacagcacagactgtatytcagccctcactcactccttctgtctggagtcctacctattagataaagaaataggtaacattgttctgggcctaacatcggtmatctctcagagcataactttttgtagaaagattcccatccaaccagaggtaaaggtaggaaggaaatttaaaaagtgaagcagaaaaagaaattcatatgctgcatctattaaaagtttggcccatgttgtagaaatgaaaatgagaaatgctttattatttgctttattattttaaaaggaacaggctctcctaatatttttctaataatgaatgctacattattactgaaaagtgatgctaacataaatttataaattcgtaacataaaaatgtatttaactggttgctcgactatttaaaacatggcttccctggaaaccatcattctcagcaaactaacacaagagcagaaaaccaaacaccacatgttctcactcataagtgggagctgaacaatgagaacacatggacacagggaggggaacatcacacaccggggcctgtcgggggtggggggctaggggagggagagcattaggagaaatacctaatgtagatgacgggttgatgggtgcagctaaccaccgtggcacgtgtataactatgtaacaaacctgcatgttctgcacatgtatcccagaacttaaagtataataaaaaacaaacaaacaaaaaaacaaaacatggcttccttcattctacaaattttgcttccttttcattaaccttttatttctgacctacagtagattttaaaataacttttttcttttctttctctccgatttcataagtatttattcatggcaaagatttttaatgtgactcttgtgattgttctagggaaatatgaatataatattttaaacgtttaaagggaaaatagtaaagtttataaaaggcttgtttttattttgtcaataatgaaaaagacatttcttaacaatgtcatgagtatgctttaaggcaacaaacaattataaactaaattaaatatttaatgtaattaaatgtgaattaaattaaaatatagcaatgttgccacaaattaagattttgaaccaaaagctttgtcctagatgaaacgatttgaccagctaaaatttgtctttatagttctcctgcctgtacattttgtcattttggggtaaacttctcagtcaccaaatttggatgccattggatcacaytgcaatatgtgccactaagctggatgactctaaagtagagaggaacaagtttgagatgatgtccgttaggaattcatagccagttcctaggaaaagctaccctaattctacagctagatgatcaaagccttgggaaacacactcaattctagcaaaacttgagctccacaagttctaaggacaatgtagccaatatcatgtaatcacatctggggataaaacatggtaggtagtttaagctctgatgaacatgaattacagaaaaaggagctaaactaaatctaggtttttgtttccttaaatcttcttagtgggctctatggctttaataaagaattaattttattttttaaggaaaatttagaaagtttatggttcgattgtctgccttcattaactaggaatactggaccacgtgtaaggcatttatcaccacttcgtagcaccctaagttcagttcttttgaggaaytagcactctttctgaaagttaaatctgcaaatctaaacatgccaaatgacaaattaaaaaaaagaaaaagaaacacactaagtttagaagaacttaaaacatctaattaaatatacttggtttaatttgcagataactcaattctatgggataatagggcaatataccaatctcctgaggcttgtggatttctatgttatgccrgtggttaatgtggayggttatgactactcatggaaaaaggtaggagaaaaggcaaagaagacaaatcatgttctccttggggatataggatatacaggttgaattattcatagaattctggatctaggcacaatggctttattattaatttttttttaacttttattgtggaaaatgtcaaatatatatataagtgcacataattgtgtagtaaacttctatctacccatcatagagcttcaacaataattaactcatgaccagtcttgtttcatctgtattctctctacccacttctaccttactcattttattttgaagtaaatcctaggtaccatatcacttcatcaataaatatttcagtatgcatttctaaaaaaaaaagaactctgaaaaaaataattatagtataattataccttaaaaactagctgtttctgaataccataaaatattgccagtattttcaattgtataataacttttttttttttttttttttgagatggtgtcttgctctgtcrcccaggctggagtgcagtggcacgatctcggctcactgcaacctccacctcccgggttcaagagatttttctgcctcagcctcctgagccactgggactacgggtgcctgccaccatgccyggctaagctttttgtatttttagtagagacagggtttcaccatattggccaggctggtctcaaactcctgcccttgtgatgcacctgcctcggcctcccaacgtgctgagattacaggcatgagccacctcgcccggcctcctaactttttaaaaagtatgtttctttgattctggatccaaataaggctcttacattatgattggtttatatgtcttttaattctattttaatscatgaactcacattccatcttttgctctttctctctcttctttttttccttgcaatttatttgtcaaagaaaagagtttcccattatcaggatttgctaattgcattaccatcttgtagtttaacatgctcttctgtctgtattttctggttactcaacattgtgattcatgtaaaattactcaagcaatatgaaatactctgctttctaatttaaagaggggcacatagaaacataactaggtatatataaatttagaaaaacctacttgagtagcacatataaatactaagaggaataagattagttggtgtgattggaaacatggaattacacatgaattatttcatgtaggaggtaatttatgcagaagatatggaaatggcacaggagattgaggaaaaagtcatctctggtgagaggaatactgtaactgaaaattttgtaggtggaggtgggcaaatgccaaactaagtaaatgagaattacctagcataatgcctaacacaaatttggtgtccaatgaatggtcatatctgtaaactggtaataaagtatatttacaccttaacctgaatcacagtggaattcagtcaccctttagatttccagcttcccaactgttctttgtatcattaccctattattaattcccacagtttgagaacttgatatccccagggcctattgttgccacggaaccacaggcctgggagtggtaacaggctggaaggcttggcggagggttggtgagagtaggagaaaagggtgctacatcatcccaaactcagaacttaaatgaagtatgtgcaactcttttttttttttttttttttttttgagacggagtcttgctctgtcgcccaggctggagtgcagtggcaagatctcggctcactgcaagctccgcctcccaggttcatgccattctcttgcctcagcctcccgagtagctgggactacaggtgcccgccaccacgcctggctaattttttcgtatttttagtagagatggggtttcaccgtgttagccagaatggtctcgatctcctgacctcgtgatccgcccgcctcggcctcccaaagtgctgggattacaggcgtgagccaccgcgcccggcctgtgcaactctttacatgaccaaactttcccagtttaccccaagaacccaatagggaatttgctttatatttaaaaaccagagtcaaatcagcacaatcgaagaagtcatcagattaaaggtgtcttcacatctccaccttttctagctttgaaaggggagtggtgaattctacctaaagagagcattttaacttatgactcagcgttcagttgagacacaaagttattttgcttttcttcgaaggagctcagaatgaccctgtgcataaaattaatgtaaaggaaacaagactaaacaagaaggctaataagcagcctagtggaatgaaaggaaatctttatttgtatcagtcaaaattgatcaaatattaccattatgtttggttcaactaaaatagtctgagtggatgtgattgaaacccggatagcaatagggaccgtgcaaaggaatattgcaacaacagtgatgtgatgaagccatgcaaggtatgggattgaaggagagaaaggcaattctggcttcatggactttcaaatgcatgtctttcctcaggccttgaacgtggctacccaggttgtctgtttgtattttgtttatgtagaatcgaatgtggagaaagaaccgttctttctatgcgaacaatcattgcatyggaacagacctgaataggaactttgcttccaaacactggtgtggtaggttgttggctttatttcttgcaatgtctcttcactgaaagggtgatgttcacagggaaaggcccatgaattcaaattaaatacagagctggcctgtctgaatcagggaataatttaaatgataaatgcttaggtaaatgtaatgctgcgactgttggccagagtcagcaaatcactttggcctctcctctctcctgtttccctatctttaaaataagaaagttgaatcagttttttaagatcccttctagcttcaaaattctaaaatctattatcttggaataataaagaagtgacagttaaagatcctattttaataaacaaaaacattcatcattagaatatcaaagacctgagatggggggaggacctctcttttttttttgagacagagtcttgctgtgttgaccaggctggagtgcaktggcacaatcttggctcactgcagcctctgcctcctaggttcaaggattctcctgcctcagcctcccaagtagctgggactacaggcatatgccaccgtgcctggctaatttttgtattttttttagtacagatgggatttcaccatgttggccaggctggtctcaaactcctggccttaagtgatccgcccacctcggcctcccaaagtggctcacaggagtgagccactgtgcctggcctggacccctcatttttaattgcacaagtaaatgtttacttctatagtgtttgaagacatttttttcactattcactttcttaatttctttaataaataatataaagaaaatataaaaatattaaaaatagtataaaaagcagcacagtgggaatttattatttcttaattcgaatgagttaaggcattcgatgatgttgagttatgcattcaagaacagtctgctttcaggagtttgaagattttttaaagaactaaaagtagaattactatttgactcagcaatctcatcactgagtatatactcataggaaaatgaatcgatctacccaaaagacacatgcaatcatatgttcattgcagcactattcacaagagcaaagacatggaatcaatctaggtgtctgtcaatggcggattggataaagaaaatgtggtaaatatacatcatggaatactacacagccataaaaaagaacaaaattatgtcctttacagcaacatggatgcagctggaaggcattgtcctaagtaaattaacacagaaacagaaaatcaaatactgtatggtctcacttataagtaaaagctaaacactgagtatacacagacataaagatgggaatagacactggggactcaaaaaaggggcagggaaggagagagaggggaaagagttgaaaaagtacctaagtggtactgtgttcaccatttgggtgatgggttcaatagaatcccaaacctcagcatcacacaatatatccatggaaaaaacctgcacatgtaccccctgaacccgaagacaaagaagtttgcttttaggggggtaggtgttagttcactctttcttcccacccactcaacattatttttcatagtactacatttcagaaacagctacgaaaataaactaacctgacaaggagtatgcatcatctatatttttgggctccatggggcccataagggagagaagctattgtatccacagaaacatcttcttcctcccagacctggaccctatacaatcctatgcacataattttgcctatttcctttaaaaaaggtaaaatttcatgattttaaacattttatcaaaatcccagaatacctattaaaacctcacaacattcagcctgggaaagctgattgctaaaacaaaagaaaaccaaacctcacaacaaagcacttaccttatttccttatttttttccctgtctaggttagaaactccatgcagacagaaaccaatacccattatctagtgcagtgcctggcacaaggagggtcctcataaaatattaactaaatgagtccatgaatgaatttagttgctctgagagctacagatatggtaggaactcagaggaagaagcagttcatcccgacttaggttccagggaatcatttagtggtttctccctaaaaaaccactcgtgttcccagaggcccaaagtttgctgyggcactaataacatgccaggggctcacaggaacagcagccatgtaaaaagaatctaagtaaatagagctgacagttactcagcgctgagccattgacatagttcatcttccagatttcattatctatgaatcatagatggagaaacccgggctgaaaacagttaagtcccttcctcaagggcacgtagcaagtatgtgcaagtacgtggcagagctgggctataaacccaagttatcagttcccttttggaagtttttattttatcttcaagctcttttggtgcttgattttacttaatatttttcttggtgaagtcagtgttatttaatttggatagccaagtagtcaaaatatattctgttattgtcatcaagaaatgtctcagtcccctcttgggcatggtgctatattgttaygtatcataagagtgaaaaacagaaacagaagcagcaagcatatgggtttttaactaaaaaaaaaaaaaaaaaaccaaataaaaagtaattgtaaggaactgtccttattaccaactgttccagtatctattctgtactatgtaagcaagacagtgagaaagaagaatttaatcttttctcatccctacaactagaatgtgcccctatgattctttatataaaggatccaaaaacacctcacttattaacaggaagtgacatatcaaacctacttactcattttatgctcctctgtattaaaattttktgtgtgtgtgtgttggagatgagagtggagggtaggttgtaggggtgtctttgtcttctcaggctgctataaccaaataccataggttgggtggcttaaacaacagaaatttattttctcacagttgaggattgggagtccaaaatcaaggtaccagcagagtgaggtcttcctgaggattctctcattggcttgtagatggctgccttctctctgtgccctcacatggccttctctttctgcacaaacctccctggtgtctctctttattcctataagggcaccagtcacattggattagagccccatgcctatgacttcatttcactttgtctccttaaaggccttatctttaaatacagtcacattggggcttagggcttcaacataggaatttgggaggatgcaattcagttcataacaggagtacattatgagaacctttggtctcaaacttcctaagatagcaccacacattttctaaaacactgagttcaactacaaagtttttgcaactggcttgaatggaaaattctttatttctttttctaggagactatagtgttttttaaaattattttttattatgataaaatacatgcaatataaaatttgccattttaacaatttttaattgtacagttcagtggcattaagtacattcacaattactactatctattactaaaattttttaattgtcccaaagagagatttttacttattgtaaccagtaggcaatatctcctcatccctaccttctccccagcccttggtaatttcttatctactttctgtctctatgaatttgcctattatagatatytcacagtgtgcttggttccatgtctatagatcaaagaatgcttgagcttggagggatccagtggcccaagttccttcctggtacagatgakgcccctgaggctgagacgatgaagtagttgcccaaattaacatgactgcttaatggtaaagcagagtctcsacctcaagtttcctgcctcttcagggctctttccactaaaatgcttgaaatctctagaatgacaatcatagaatgagaatctgaggctcactgtccagcatagtagccactaaccacatgtggctatccagtgcttaaaatgtagcttgtctgaattgagacatacactgagtgttaaatacacaccagaatttgaaggcttagtatgaaaaaagtaacataaaatatttcaagaataatttttatattggttacacttgaaatgatactttgtacatatttggttaaataaattacaatattgaattaatctcacatatttctttttgtgtgtgtgtgtgtggcagggtcttgttctgtcatccaggctggagtgcagtgtcatgatctcagctcactgcaacctctgcctcctgggttcaagcaagtttcgtgcctcagcctcccaagtagctgggattacaggcgtgcaccactatgcctggctatttttgtatttttggtagagacggggtttcaccatgttggcctcgctggtgtcaaactcctgatctcaagtgatccgcctgcctcagcctcccaaagtgctgggattataggtgtgagccaccgtgcctggccttctttttatttttcttaaagtggtaacttgaaaatttaaagtaaatatgtgacttgcattatatttctattaaacaaccctggtctgaggattcatattagggcaccacctctctatttagtggttatgtcttccccgacctccatacccaatatataatctctattctctaagaattatatatcacataaaagggcaggaatattcaaaggtgaccgaactatcaaaaatggtttatccaatcaccttattggttaaaaatgaaatacttgggaagaccttagatgttcacatttcctctcagggaaacaattttttaacaaacattaatgttgtgtttgtataataacaggaataaagcagaatgagcttaattaagaaaagcaggctctgtaaggatagtgagtagcctcagccatggactcctgaggcagagatgcagctggactcagaaacagaaaggaactgggcctggagccctagagaggctcagtgaatccttcctctccccttctcatctctgtgatgcacactggcttctttcaggtctcagtccacatgatgatgatgatgatgatgatgatgatgatgatgatgatgataaacagcaacagttatgaaatgcatactacatgccaggcactgtgcaaagcactttgtatgaactagctcatttaattctcattcaatcagcatttaatgtataatttttcaattttgcagataaggaaattgagatacagatagatttttaaaaatttacccaaagccatatagctaataaatggtagtcaagatttagaatcaagtaattgggtgcttaacaatatgctgtatagcctcttattctgaagartggttaccaccaagaatatccagattgcatctcctaaaatgacagtatttacttcatagggctgstgtaagaattacatgagatgtggcaaaaatcttagcagagttcctgacgtacagcatgtgctccacaggtgtcagctggtagtattactatttttactgtctgttcaagagagcagctagactgagactagactcttagtattgatttcaagttatctttgaagggattcagattggcaagcacaagagtcagacccwatcctgagccctcaactgtttgcaggaaggaataatctcttgtgtcasatgcagcttgctggggcttcaccttgtgaattagggacagggggagaagtgttggaaggcagcctaccatctcaagtgatgcaaattataatctaycaaaggaatgaatgaacgttggtctggcaacaaatatcaccatcccattttatttactaaacttactaaaccactttagcaagttaaaagtagcactgaaggcagatttacatattctgagctctgaagtgaggcttttcttttatgggctatattgatggtagctttaaaactacaaatatcagaaaaactaaatttacagtggattaaggaaartggggtttattttttctcccataaccataagtctggagacagggctggcatctctgaggatctcttagccactttctcaaggttgcaagggagacaggtgctgggaatgactgttagaaggtcagctatgtgagcagataagtatttgacttcaaaagaaacataacacttagtggaactatgttctttgcagagccctacctaatccattcatctaaaagtgttgcaacataggtaggagaatacgttgtctgggaaaccacaaattacagtactatgtgcatcccctcataatttcaccttaacaatttcgttacagaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactggtaagtgctacttaattatttttctcattagcattttggaaataaaataatacttagttgaagaatcaaaaactgggaaaaattttgkcctctagaaggcaaatgatagatgttttaaatcatggtgtgatcctgttgagagtcaccctgggtcagtgttctctaagggaatataaagaacgtgccttaccctaacaacacacactttattctagcacgtgggcttcctaagaaaatgtcagacaaattccttgaaggttaggaaggaactactactacacttgacctgatctgcatgtgaagcggtataagcaaggatgagtatggaatcatgcgacagctttgtggtcactagcttcctacaacagcacaccacagattaagtctcaacacagcactcattgttttggtattagcagcaggaattgttcctgccctgacttccytaaccctcagggttttggtcctattaaagtacctccaattttagcattgaggagagagtctgttttttggaacataacagacaatacaggaaattcaaagaggactcacacaatttgatactcccttagcactttttagtccaagatactgtatgtttgggttcatggcaaaagatgcaaggattcttgaaggattgtagctaggcttygacaaatcctcatcccagatgctctccagacagtggaagtgttacatcaacagccccattcttgggaagggactaatttttaggtagtagcttgtttcttagtgactcatttttttttctggctctcttaacagaataaaatatagtcacattacaggagctagcaattgctgatgacaaatataagattatttgcattctctgaaaatagcccatttagaacataaatgtacttgatacttgagcttttttcttctcaagggaaaactgttaaggaaagcacctttcaaaaatattatctttgaagaaataaaaggaaatttatcatgatttgggaagtagaattagtctaattatgcttttttttttttgcatcactgccagcacacatatatgttgagagccattacgtgtaaaataccttgtcaatggatgtttaaagaagcattaggtaaaatcctgccctttaagagaatgtgttatggttagggagctcaaccattagcaaatgttacaaatagttgtactctaaggcgacatagagtaactactaaatacgtggcacagacagtacaactcacttctaactagaatatcaagggatggcttcactaatgcattcagagggaaatgctgagataagtgaggagataaagtagttactgtccttgaggaatttacaatctattaagggggggaaaaactacaaataataaagtgctgttgatgtcaaagatcagctacattttagacaggcattgaaagaggatttctataggcagacagggaaggaaggaccttccaagcaaagaagttggtgttcaccataagaggatgcaaaagtggagggtgatagcatcagaaagtagattaggttggcttctgaaggggtgtgactgtcagataaatttgtatttcattatgtagacaatggggttacattaaaacttattttttgaacaatgagatggcataaaataatatccgctgataaatctcttgagtttttcaagaaggtracagtgtataccatgatgctagttccaatttccgaaaagttccagataagtgagaacttcagaatagatttgacaaaatgaatatcaacagacaaaatgaagtcaaatgggggtcttagttattatcctgctccataccagaggcataatcttttttgatttgatgaatctatggaagtcattagacattttacacaagaagaaaatagaagttgtgagaaggataagaagtgagtcatgcatgcattaggtgtttgtatgtgtttagaaaggttggatttaaagtttggtgataattttgttcagaaatggagtacctctaagcctttgagatgtagttatacttcattttccataataaatgagttcccaaaaaggcatgtgataatttttttctgcaaattaatatatttatttatataaattatttcaatatattgaaatagtttatgtttaaagccacccaattgtgattgccataaagtgcacatattttaaattaatttgtttaccttatttatttgccttttagatgaatctagattttctacctgtatactttgattcaattaatgtatgattattttttagaaacttctacttgtcatgtttcaaagctgcacattaactgaaattctatatcttkttgcttccagtctctagtagccagtgaagcagttcgtgctattgagaaaaytagtaaaaataccaggtatacacatggccatggctcagaaaccttatgtaagtatttcttcttatgatcttagagaactttgagctactaaagaaatctgtgtgatctgtttttctttgtgtatttaatttttctgaattaaatagggtcacatgtaatacaactgaattgtaataattaggaacagaagcataatagctatgacaatgctgaacaaagctatattaataaatgagttactaaaaagaagccaaaatcctatttaagaaatcatatttatcacaatcaagtaggaattacagaattggcatcatactagttgagtgaagcagaaaagttcataaaacttttgcatgattcccagggccaccatggaaggttgtgcaggttgtacactacactaatctagggcatgccatttgcatcaagtgttttttagtgttagcctgttcccaagagtatagctcataacacattacagttgattgtctttaatatatattacacacacaaaacttgtgacaaactcttaacaaaaagttttgattaatttttgctgaaagatatttagtgagtaactcctatctacacacagtgggaggacagactgattttgcccttttgaagtttgaagggagatgggaaaagaggagcataaaataaacctgtaaccaggcatcagaaaactacagcctgaaggccaaatccaggtttttccattttttttttttttaatgattagaaaaaaacaaaaagaggccaggtgctgtggctcatgcctgtaataccagcactttgggaggctgaggcaggaggatcacttgaggtcaggagttcgagaccagactggccaacatggtgaaaccctgtctctactaaaaatacaaaaattagctgggcatggtggcaggcgcctgtaatgccagctacttggttggctaatgcataagaattacttgaacctgggaggtgggggtggcaatgagctgagattgtgcaactgcactctagcctgggtgacagagtgagactccatctcaaaaaaggtcgaaactgtatttatcatgaacactaaaatatgtacacattttagttaacatgcattaaactgtaacaagtcttctggcaattgtagctttcatgagatgcttcccaaactgtattagatagatgctaaaattataaattaaaattttgggtcagactttgccataaacctggactcaatttagcacccccccaaaaaaagtcagattattcaattaatgcggttggaaaacctaacaagttacctagaaaaaaattaattggattattaacatgtctttcaccaaagtaaattccaggtacagcatatattttcatatgaaaaccctgcataaaccaagttgaaatctcagtaaggagaaaaaattcttgtgaaaggagaaatgaatgaaaggagaaaaaaaggtctacatgccaaacaaagctaataacactaatgtcgtttttataagcaattgataaaatgaaccaagtagacaaatgaggaaggacaattgataggaaatataaagatagccaataaatatgccaaacaaatgtgcaactcactgataatcaaaaaacataaattaagacagttggatattatttttcgcccataaaattatcagaattcataattcctattgatggtatgggaaggggaaatgggcaaattcataccctgcttgtggaagtataaatgaattcagttcttttgacgtccatttgggaacatgccgtaattgcaaaaagtacagagccttagactagcaaatctattctagggaagaatattctaaagagacaaagaagcaattatgtataaacaagggtactcattgtaaagttgtttatattagttaaaaactgaaaaaaatctaaaggtatacaaacaaataaacatttaaatcaaacaattcccagtttgtaaattaatttgaaacgtctgtatttcaacaatttctttcttcttcttttagacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcarattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaastttcgacgtttgactagccatctcaagcaagtttavtcaawgatcatctcacgctgatcattggatcctactcaacaaaaggaagggtggtcagaagtacattaaagatttctgctccaaattttcaataaatttctkcttstgcctttaraaatacaaccatgcattccgtttgctccacggtaattaggcgatggcccagaaaggggaggggtgtcaaaaacgacaaacatagcctctcattccagctcagctgctcaataaacactgttgaacgaatgaatgagtggctctaggtactgtcaacaaatgccgcattttgcgcatttacaacagctgtttatggtaaggaattatgtaataaaaagagaaaactcacttaaattcacttttaattgggaattttagttctcccgggctcccagtttcctttcctaggatctctcacagagcacagattcgatttccaagtcccgccgcactcttaccgctcgcatggaaccttacgcctagagggcgtgtccacgaagggtggtgtctgcgcactgacgactaatctgacggccggaagctgcctgggtctacagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaagtaagcgttctgtgaattggtgtgggtatctggggaaggcattgagcggacccgtaatgcggaggcccgggttaccymcccccgtctttgcttgagtcactgggattttgagctttccttgagcatcccacccttaactctgcaatagccccctgtgctcaggcgtaatttctcactctgattatgattctggcatttgtctaagggcgataagtagactcagacaataggctgtacccctcgttaccatttgatgtaagcacgggaacccttgtatggtgttcgtatttgtgtgcgatggaagggtgcagcaatttgggcttaaatttagaatcttcctctatactcattccagatctgttagagaaaaacatcttacttgtgattggtcttgttttttttttttttttttttccctcagcagtgataacgatttaggtcctgggaattgagtgctactttatcttcacaagccttaggtaggtagttttggcaactgtcagaaacgggggaaagtggaatagaaagaagagagtctgtttggcggcattatctctctgtaataggctaacgcaatttatgtggtttgaaaattatttagagttgataatacttgaattatgttggtaagatgttgtttgtgaagggtagtcttaaggtatttggttatactatggggctttcaggtaattcgaactactttgaaaattatgggagtatgaagtctcttaagatttttggatttttaaagtagttttaaaaatttggaaaacatctttacacctcaagttttcgaagtccgcgataccgttggagaataaatacttatgcagttcagtctatgggtatatggtgccagttagcggggtctagttctgtaacatttgaaattactggctttagtacaatatattggagcgttttgtgaatacaatctatagattttcaaataatttttaatttcttaatgaactatttacattataacagatgacagtttcaactagagactagcaaagttgatgcaagcttgtaacaattgcggctttaaaaatagttgcactctgaaactaaggctttcactctgtgcatctggtaggattcagttttatcaaatgtatgcctcttactggcttcctgattactggtcattctaaatgaacattgcatattttgagatttgcaagcttatgtgattttcatatttgtaatatgaatttaacatactaaaaatccagcaagtggatggtatcttaacatctttacaaattattaaaattgtaatatcatcagtatttataatatgcattggcatttacatagaggaaacacattgtttaacttaaatttacttagagagttggttttcagtggatgatagtcttcctcacctcctcatctctcccaactccatctcatatagaggtggagctatttctccagctgttagtagtagttgaagcattaactgctgttgatatagaaagagtcttttattcttttttttttgtatttttgtatgatgcagttctttttacttcactttagagtaggtaccagcatgggatgttttctgtgcagtctttttaacaaattgttttttctgcatagtactgcagtgttgctttgctaattcctatgtagtcagcttagttctgtcagttgtatttggaatttagtttggaattgttttagcattaaatttacggaagcaatctgaaagtttgttttagaaagttctttttaaaaaattctctcaaactatgcatcaaataaagttaatttttctttctaaaaatatgaagtataaatgtgaagataccttatttttagtatcacctttttaatcttagaaattcagagtatagggatttatcctactagttagtacattcatgtagttttaattgcctgattgtttgaaatttccctaatattatgccgctactcatccggattaaagtgttatgctttcacttatgcttccagtagatgagacctggaaaagataattaattatggattgaagtgaagatactagaacgcatatgtgtttattgacaagattttattaattgagcttctggagtcattattcaaaaagagacccttttgtatgcttctcctttctcagccataattataatgtgaaccttctgagtacagtgttattctaagtttctcggggcaagggagcagttcccatttaagaccctcttttgttgtgtctttattaatagactcaaactttgtgtcccggattttctttttctttttccattttcttttttaattgaaaagagattataaagacttcagatattcatttgctctgcaaatggagaggagaaataggaaaataacgaaataggctttcactagtgccactctgtctttgataatgctcgtgtttgagaaagacttgatgatgtgggtggaagtgtgatggcaacttaaaccaaataataatttgaaaacaaaaatggaggaaaaccttcatagaagagtaaattagtaagttattggtatgaccttgatttctattctctatgataggaaagactttagtatttacatttttatcttatggtttctaatttttctcatatactttgaagcatttacttgtcatgttcagcctgttcatacataatttgaaaaagtttcccgccccgaaaatctacattttaactgttgtggtgttcattttcctttacgggcccaaagttttaaataggattgaaaattctaattgtcacattagttggtaacatttagttttaatatatgaaaaaggaaatgtttttctgctgtattgtagatagtgtgtatatttttagataaatgggatttttaaagttatatattgtgttctttacaagcatgaagcattttgtttattcaaattcatgaatgtctcattagtaatatttaagtaacattttattgttgactacttgtggaagtttttacatggatgatcagaagaattttttcagttagaaatcttcagtttctgcttttttcttttttcaccagacgttttacacacacacatatatatatcacattaaagaacattttattaagaatatgtgtgtgtgtgtattattgttgtcattattcttgttttaaatgttcagtccaggaccttgctgtaacccagaccgcatactcagatgctgtattactttaggacaaagtatggtactcttggagtctgagaaaaagtagagtacatcttttttttttttttttttgagacggagtctccctctgttgccaggttggagtgcagtggcgcgatctcggctcactgcaacctccacctcccgggttcaagcgattctcctgcctcagcttcccgagtagctgggattacaggcgtgcacctccacacccagctaatttttgtatttttagtagagacggggtttcaccatgttggccaggatggtctcgatctgttggccaggatggtctcaatctcttgacctcgtgatccgcctgccttggcctcccaaagtgctgggattacaggcgtgagtcactgcgcttggccacatttttacttaatttcatttcttcgctaaattgggagactcagtacagtagtagctgcaagtgaaattcctgggataattactatgtaggtgaatcttgaatagttcttgatgtcactggtaaaagcaattttgtctctgtggaaagaatatgggcgtagggtgagggaggtgaggaggtggatcattagtcttcacttgattgtctttcatagcaagtccaacccttgaaatcttcaaagttttttttttttttttttttttttttgaggcggagtctcactctgtcacccaggctggagtgcagtggcgcaatctcggctcactgcaagctccgcctcccgggttcacgccattctcccgcctcagcctcccgagtagctgggactacaggcgcctgccaccacgcccggctaattttgtttttgtatttttagtagagacagggtttcaccatgttagccagcatggtctcgatctcctgacttcgtgatccgcccgcctcggcctcccaaagtgctgggattacaggcgtgagccaccgcgcccggcgaaatcttcaaagtttgccttagggagtctaggattggagagaagctctcagaccagcaaagcaataggtcaagggaggagagtagtgcgaatcaggcaacagaggacagaccagaaaaagaaactgtagagttaatacctggaaccctcaaaaagtaaaaagaaaggagatgatagatgaccaatgttttaagtataataagtacgataataaatagcctgtcgtcctaactggaaaccattaccattgaattttttgaaggagactgagctgggagtggaggcatgttgggggtagtagagatgttgggggcagaactaactcatttccagtgacagtggagggaaaaataaaaaattagtgttagtccacttgaggcagtgtggtgggagggtgtgcctgttttctaagttctacataactagcaaataaggaaattttggaacctattcaattttgtttattaagaaatgttttaaaaattgaattattggttgaggattactctatatttgtatattaatgtagcaatatataatgaaactttatgtttttctcaaacttcttatacattgtgatacatttacttattattgaatcatgcttggatatatattgttaaaaaagtttttctcaaagctctacattttctagatctttctcagctccacttagctttcagttttttcgtgctcagtaaatcaaatagacataggaaattttaccagcttctcctccgtatgttcacatttcagctgagaatgagtctaagaaaaattaaatcaaagattatcttataatgctaacaccagtatgtagaattggtgtgtagttccttacttggagaacaattaatatttaattgattttgtgttgcagcaaattattgtttatgtgatgctctccactggttcttaaatttataattactgtgaagtaattctgtttttaaaatcactaaaaattaattgctattatatcaaaagaattattacattttatattgataaaaatatagattttccaatttaaaatcaccatatattatttcatattttccttccttgatgcaccatcttttatttatcaaatgttgttcttagtctttggattcttttaaaagtgtgacctgaagtacctcattgaaccaaacactgtttataattttttattgctgtttcaattaggtactaccacgatttaatttcctttaaagtgatatgtctttactttgaaaccacattaaagatttgtgatctttatagagactaaatgaaacttttttagctgctgtggttcattctagtaacttttgatgat

SEQ ID NO: 1677 - DNA, 19311 bp, Homo sapiens
aaaattaaagtattatgttaattagggatgacttgggttcaaccaacagaaactcataacaagctagcttggagcaaagggggggaaattactttataaacacagtgctatagaacgtaaatgtagggagtagtacctcatgaactaatagaacgtaaatgtagggagtagcacctcatgagctaatagaacgtaaatatagggagtagtacctcatgagcttcaggatccggaaactgaagagtctttggttgctcggggctgtctgtcttcctaaaactatgtgrtctctcttctctgccccctttgcacatttttttctttcttctgacactctgcagacagacattatctgcatcttcatcacacatgggctgaagatagtgtccttttgtttttgagacagggtctcactctgttgcccaagctggagtgcagtggcatgaacagggctcactgcagcttcgatctcctgggctcaagggatcctccacctccacctgtcgtgtagctgggatcacaggcacatgccaccacacctggttaactttttaaattttttgtagagacggatcttactttgttgcccaggctggtcttgaactctaggatcaagcagtcctcccacctcaacctcccaaagtgttgggattatgggcatgagccaccgtaccccactgaagacagtgttcttaaaagggtactttcaatctcaagtctacattacctcattagtctctgccttacaatttactaattgaagtttctcagacttgattccaaattttcgggagaaaaaatttggctagccaagtttaggtcaaacaaccacctcctctccccttgtctgatcaacttcggtaagggaatgggaacagggtttcataatctgctgtccccccagcagaggttatgggaacagagtctgagaagggagtacaggacaacagagaaacaatgagtgttgcacacctcaagtgtgatgtgaaagaattaagaataccacatgcagccaggtgcggtggctcacacctgtaatcccagcaactggggaggccgaggtgggtggatcacctgaggtcaggagttcgagaccagcctggctaacatggtgaaacctcgtttctactaaaaatacaaaaaattagctgggcctggtggcgcgcacctctaatcccagctacttgggaggctgaggcaggagaatcgtttgaacctgggaggtggaggttgcagtgagccaagatcgtgccattacactccagcttgggcaacaagaatggagctccatctccaaaaaaaaaaaaaaaaataccacatgcatccttattcctgtacccgtgtaactgttaatctactcaggatccaacctggccatatgattaatggcacatttgtaaatatggataggtgtcagagagccccaccaatcataacatcccttcacattttgtgtcagatgcttgtctccagtattgtctcttttgccctctttttattttcgttacagacagagtctccctctgttgcccaggctggagtgcagtggtacactataacattgaactcctgggctcaaatggtccttctgtctcagccccccaagtagctgggactacaagtgcacaacactgtgcccagctgttttttaaaaaatttttttgtagagacagggtcttgctatgtaggccaggctggtcttgaattcctggcctcaagtaatcctcctgactcaacctaccaaagtgaggggattacaaacatgagccactgtgcctggccttctgtagccctcttaagggacataccttttcattctttcttttccctggggattaagttaatttcaatgctcatactgaccattgagtgataaaccaaattcttcaccttccctattccctatctcccaaactgttccatatgcattagttaggagtgactgtaaaatgctataaaaagtgggccggtgtggtagctcatgcctgtaatcccagcactttgggaggctgaggcaggcagatcaggatattgagaccatcctggccaacatggtgaaacctcgtctctactgaaaatacaaacattagctgggtgtggtggcacgtgcctgcaatcccagctactcgggaggctgaggcaggagaattacttgaacctgggaggtggaggttgcagtgagctgagatcacgccattgcactccagcctggcgacagaatgagactccatcaaaaaaaaaaaaaaaaaagaccccaaaatgaaaacttatttcttctcccaaatcaggtcagggacccaagttgaaggtggctctgtcatcttcaacatgtggcttccaaggttgctctagtattcacctttccagcccatgagaaaggggaaagagagtggcggrttctgagggggtcacatgacaggttctatgcactaggcctggaagacacataccacctttgcttacattctattggaaaatacttcatcataaagccacacctaattgcaaaggagacaggggaatttcatgttgctgggcagttgtatgctcagttataattctgctactgggaaagaaggcaacaatggattttgatggactggatccatcagtcgcttgagagactgaggcaggaggataacttgagcccaagagttcaaggttatagtctctcctacattctccttttctgttacctctcttagttaatggcattattctctcaaatacccaagcttgagtccttaaattcgtcctccctttctccatctctctcaatcctcttatatgttccagctacctaagtaaccaccctgcatttgttccttgctttccatttcctctatagcatgacttaaatccattgtatctgttgattgaataactcatcatcctccaaaattacctccgtgtcagtctctccaggctcatcacacccatcctttactctgccgtcagacactacttccaaacacaaagatctgcttgtccaagacagcctgggcccattaacaggcacctccccactcacagtcaaggctggaagcaccatataaaaagcatctgcagctacacctttgcggctcaggagattatggcagactgcctcctttctctgccaagccctgtcctcctgggctcagggttctctgtctcacacttgaactctgcccatctccccacatcccactggatgaacaccacagtgggactgtctgcccagcttttcatttagccctgtccctagacactgtctgtcatatcaccctcagccccatctcacaaatccaaactccagagctccaacccaggcccagggcccaggcttgcttttgttcaggagacaagtttggacgctgatcattctcttcacttaaagctccatcagttcgcagtacttacggagcaacagattttttagcatgccatccatggccaaccactgtctgatcccatccccacttaccacccctaccaattcatcctcataatcatcttgacattttcttattcttcaagatctgactcatatatcacttcttccatgaggccttcctctttctccttgctttgtacttcatagcatcatgtttttctatgtattgctttctacctctagtttatttatttgagacaatgtcttgctctatcacccaggctggagtgcaatggcatgatcatagctcactgcagcctcgacctgggctcaagtgatcctcccacctctgctttctgagttgctggggctacaggtgcaggccaccaggcctggttccaacctctagtttttgtgcacatggtatatactccccacaggcaaggactctgacaaatatttcttcacttcccacattgctgagaataatgccttggacaataccttacacatggtattgatcactgcttaaaacctcctaatgccccaatggctttccatatcgccaggccaataataaaagccctacctatgcctacctggtcctatctgatctgatgcgctttttttttttttttttttttttaagacagagtctcactctgtctctcccgggctggagtgcagtggcacgatcttggctcactataacctccgcctcccaggttcaagcaattctcctgcctcagccttccgactagctgggatcacaggcgtgtgccaccatgtccagctaatttttgtattattagtagagacagggtttcaccatgttggccaggctggtcttgaactcctgacctcaagtgatccacccaccttggccttccaaagtgctaggattataggcgtgagcaccgtgcccagccctgatgctcctgttaccactccccacttgctccgccctatccaccatgggcccccctgctgttccttgaacacattaggcaagatcccacctcagagacacttcatttgctctttccccagatagctgtatggctgctctctcatgtcttcagggcttctctcaaaggccaccttttttgtgtgtgtgagatggagtctcactctgtcttccaggctggtgtgcagtggcaagatcttggctcactgcaacctccgcctcctgtgttcaagtcattatcctgcctcagcctcctgagtagctgggattacaggcctgcactaccatgcccagctaatgtttgtatttgtagtagagatgagtttcatcatgttggccaggctggtcttgaactcctgacatcaagtgatccacctgcctctgcctcccaaagtgctgggattacaggtgtgagccactgcacctggcctcaaaggccactttctccatgaggccttccctgaccacttattcacattgtgatccttgaaacactcccttttccctctccgcttattgtttctccatagcatttttcacctccttacatagtatgtacttctttaatgtgctgtgttcattttctgtctcctctcccctttttggaatgtcagcatcattctagtttaaatctgtttgtttacttctgtgttcccagagcctaaggataatgtctggcatagaggaggcactcaataaatatttgttgaaagaaagaaggaataagcaaattaatagaaggtgctccgtaaatatttgtgaaattgaattaaaagtgtcagaaggagatgactgtgaaattcccaaagtctaaaaatatgtgagcttagaagaatggtggagttgagtgctgcctcattataaacatcctcgaggaaggactgaaactgtgtgcttgcggtgggaggggcagctgggcaaggaaccgtgaaccttcgcagaaacatttggggctgcagaacttgggtgagagcgctgcatctgggagctggcgacgctggcggcttgctcattcaccccatctgaacacttgtctatgacacaggtgttttctcttaagttattttggtctttgcctctctcctcaggttgtgaagattacagaaatctgggatggcttatgggacgcttctcagccctaagtacgaaaacagcagtgaaaatggcaaccaaaacatcacgcaggactgggggttttggggaaacagctcactttagagcagtgcagtgtagagctttccgtcttctaccagggtccacctttaacactgtttatctgaaaattttccccctggcttactcgcttgcagctgcccactttgcagaaggatggcgctctgatctctacgctccctgttccttcagggactccatagtattttttttcacgcgtcgtcgctactacagcagacgcctgcgttctcattatttgctgtacagatctccggtgccttgactgtaaacaaaacactttagatcattgtgaggtcgatgtaagcacagcctttctgctggcagccagacttcttaaggtggtgtgactgtgacttgcttacttttcgagatcaacaacaacaaagcgacaaaatggtgctcctacatattagttgaaagattcagcatgtgaaggggatcgaagtgtttattttccacttccatataagacatgaattccatgagtaaaatcaaacttctgtggcaaggtgaactactctagaatgtctccatttacatacatgtggtagtttggrtgtttatgcatatggatagatgcacatatatagagttcctgtgttgtctagcaattgttttaaaatttggacaattatctaatttctagggtaaggtataaattatggtagggaggcctaccctaattttcctgttccttttcccccagtctgcagtccaataaattgacagccttaaaagtagaaaaactaaagaggatgagacctcttgcttgatcctaggtgaattcttttctgtcagttaggtaggaagtcctgacttgaaaactagttctgggcactgccccctttactgttctctgggtatcaacccctgtccttcaattttagttgaactagtggatggtgataccacaggctcaagayagctgcatttaaatatcagtgaccacaggccacatcaaggaaacatctgcaggcaacccagggcctgggaaggagccattttcagtcacttgtaagacagcaggacctgcagactacagcacaatcaaactcagacaaaaccctgaaccagtgagaaccattaggaaggaaaggaacagaaaatgaaccaacctgagtgttaggagacttgcatctagtcctgactccggtaccaaccgaatgcatgtccctggacaggaaacctctctgagtctcgatttcctccgtggtaaaaaggagagggttaaaccacagggtcccgagggtcccttccagctgtcacattctggagcgtatgagatgaggtaggcacacaaagtggacaagatgtggctaagaaaacaagctacacatcaagctcatctgtagcataggtgcttaagaaaactttgctgctgtgtaatattagaacggaaggttggtttccagtaaaatgcattaactttggctcaaaccaagatgatgggtaccgggcatgggggtggggaggcagttgaagatccactgagctttgtctcagggcagccctgctcatcgtcctactttaccttccaccacggtgctcaagcccacactgagagagaaatttccagctgcaaaagggagaagagaaacgctggaatactagtatcggacgttaggacatggttgtggtgttttaaaaatcatttcatcatctggagtttgaccccgaggggagtattttcacccttcagccctctgaaagcattcactagcatctgaatattgttctgagtttgttggagcagtgaaatctggtgagagagaagggtggaggaaggaaggagctgttgtatttggcggctggactcaggtagaggaaactgctacaatcccgggaaagaacagaaaagtagaaagggacgagttcccacacgcagccaatgtccatggccttaactgtgcttgggaaggaagatcctgggccaggggtgtaccctcgtttttcaaaactaaacgtgtctgagacagctacaaagtttattaagggacttgagagactagagttttttgtttttttttttttaatcttgagttcctttcttattttcattgagggagagcttgagttcatgataagtgccgcgtctactcctggctaatttctaaaagaaagacgttcgctttggcttcttccctaggcccccagcctccccagggatggcagaaacttctgggttaaggctgagcgaaccattgcccactgcctccaccagcccccagcaaaggcacgccggcgggggggcgcccagycccccagcaaacgctccgcggcctcccccgcagaccacgaggtgggggccgctggggagggccgagctgggggcagctcgccaccccggctcctagcgagctgccggcgaccttcgcggtcctctggtccaggtcccggcttcccgggcgaggagcgggagggaggtcggggcttaggcgccgcggcgaacccgccaacgcagcgccgggccccgaacctcaggccccgccccaggttcccggccgtttggctagtttgtttgtcttaattttaatttctccgaggccagccagagcaggtttgttggcagcagtacccctccagcagtcacgcgaccagccaatctcccggcggcgctcggggaggcggcgcgctcgggaacgaggggaggtggcggaaccgcgccggggccaccttaaggccgcgctcgccagcctcggcggggcggctcccgccgccgcaaccaatggatctcctcctctgtttaaatagactcgccgtgtcaatcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggcygcgtaggggcgctttgttttgttcggttttgtttttttgagagtgcgagagaggcggtcgtgcagacccgggagaaagatgtcaaacgtgcgagtgtctaacgggagccctagcctggagyggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgkcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacggtaatgaccctttcccaaccatagaatgtgtttggggccccgctttgcctgctggagggtgttaaccttagcttgcttttcggcgtattctgatttagctttgggagagctaactttattggtcttaggtgttcagtgctacctggcccactgcttgtctgtttgtgacttttaagtcagaaactggagatggtaagatccgataatttccctaacttaatacatcgcggtccctctcactagcaactcctaggtatgtgacaaagttgggatgtttatcaacggtccgcctcctggctagggaaagagctctggggcggagaatgcactttctgttttttgaaaacaacctcattttgtgcccttaaaagccactggggatgacggatccaggattgtgggtggaggtagtgggtttttcatcccctgactatggggccaacttctgccagccattgttttttctaataaagattgtgtgttctttttaaaaatttcccctgcgcttagattcttctactcaaaacaaaagagccaacagaacagaagaaaatgtttcagacggttccccaaatgccggttctgtggagcagacgcccaagaagcctggcctcagaagacgtcaaacgtaaacagctcggtgggttgatcactaaaggagcacgcactggaacccggggccttcagacctcacgatacctgatcttactggttgctggcaaattaaaagcttatggggttttgttttgtttatacttcgtgaggtcaaaaaagtagcaatggggaaggctggggatacggtaattcctcagagtttctatgcccagagatactttctcttcaaactgttgaccagagcagctacttgtaacccaggccccatcgggtaggaaggtcgtttccctgtgagtcccactaaaacgtgttgggagcaataggttctttgcccatccgaacaagaactagggtactccctcagtccgaattaatgagaattaatttcctagaggttcagcttgagtcggtaacagattttgagccatacatggaaaaatggcaaatacatgattaagtttcaattttgagggggaatgtttggtagaaattgctcatctttggttatgcaagggattagagatgtgaataggatggtatgttgtgttctttgacattttaataaactgtcactttccctgttgtctcctaagtttggagagagaaggaaccagtatttgcaaaaaccaaatggaaagataaaaaagttactaaagtttctacagaatttctggtaacactgaagttgcaaagcagaagttaaattaactcttgtcagtaagcaatccaggaacacgtcagccagtgtatgctaattgtgccgtaacagggygatttggatatttgtaggggaaatgggtagtaaatatcaagactggtgaccgtaggtcagcccagcacaaaggaagtggagatttttccatgcacaagaatctgatcactgtaaatagctaatttgaataattcagtccccagataaccaacatgggttggttattcataataaactacatattttaatagtttattagcttcctttagaccaagactgtgacctctttattttctaaagcacacacgtagtttagcatatgaggcgataaaataytgatgttaactttttaaatccccagttataaaaattttaaaataacagggattaaggtgagattcaggtttgttgtgtctttaaattgtatatgtgacttcacatatctttttcagcgcttatacaaaacggcactatagaacctccattttacagcaccatatgaagtgggaaaattaggtgaaaattttcctgaagcaaccttaacatgcgvagcccttgttggtttgtgacttgtggcctagctcatcagatgagccacgagaatcagacctggattttgatctggccctgttctgacatgcaatgaggcatttgtagsatttagtaatattgctagttcaaagaatactagaaatattagtaagaacctattcaaaagtattcatgagtattttctgcatatgaatcaggaattagaatattttgaaaatgatgttaataaaattttcctctggaaggcctttataatttttattcccaatcatttttcaaatttagaaagtttaatctgtcacaggagaaaaaaaattaaaaattttcaaaaatttagaaaatttttacccgtaagtattacagtttcctaattatcctatttatttcccacttgcctttgacctagattatttagagtagggtttctcagcctctgcactaatgacattttgggccgaataattctgttgtaggaggctgtcctgtgtgttttagattgtttggaattatccctggcctctcacaytagatgccagcagtatcctcctcccccagtgtgacaacctaaaatgtctccagacattgccaaatgttccctgtggggcgggggcaacattgccyactgttaagaactactgctctagaccaaagaacacagcacagaggaaaggaaaaaaaaatccagttaagagaatgttaggtggagatgactatagtcatcaaacttttttccccatcaagtatttccaagctaacatagtgacaaaataattcctgtactctactggtaacgttaatctagtgctcttcctttaattcttccgttttgttttcttttgcagaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcargtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttyttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttmaaggaaggttcatgtagagaaaagcacacttgtaggataagtgaaatggatactacatctttaaacagtatttcattgcctgtgtatkgaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctattcattgagtcaaattgtaatgtgctttaccaaacaaggtatttgacctggcattctagtcatatttacacaaatgtaaatgtgaagtggcaaatacctaggtaattcaggcccacaactcagatgatgttttatgtagtccgaatgtagttagcagttactattttccacttagctctgtgtgggaggacaaaactttagaaggtgaaaatggaaaagctacattttcatatgaataaggttgtcaaaagtctgcattagtaaaaatatttatgtcttctaggatatgaatgtgtcaaaaccaaagaatccttacataagtgtacactgacacatttgcaggattgaaaatgaaagtaacatggtgacttctctaaattctgtatttacacatgagaagtgtgaggaattaaagcaattgtttggaccatctaatgtataaatcttgtttaaaatattcaaacatatgggcccttaagaaattggtgtgcactctacgtagctatttttgaaatttaactggtcatacaaaaattctttcaatttctatatttagaaacggggtatttccttgttataatctacacaaccaaaaactggctaatgtaagtaaccaaatctgaggattttgagtctccatagccatacagcagatatacagtttttacctaaggaaaaaagtataagacaagacattttaaagtcagattactaaaatgattcctgtaattccacattctcaagaaaaaatgtgtttaaggtgtaatagtaaattcttataggacttattctagtaagtgggtaaatsgtaaaaatctaaatttgggttaaattttttcgctcaaatacctacatttcctttatcgtaccccaaaaggagctctcaaagagtagtttgaacagtttttgacccgaagattttttttttttttttttttgagcaggttggactcttcggcttcctggaagggaaaaataggtcctttagtggctgggctacatctttcaagkaggtattattttaatgaaagactagaggtgttttgtgattttgtttgaaactcgcatccaagagtgtttttcgaaaacagactgaaggagcaagaaaaacaattcgaaataggaaggagaggagggtcagaaaataatgaaattaaagttcctctgagtaaaaaaagataattcagaaagtgtctctaacagaataaaaaatatcgcctggattgctgcaggcaccccagtctcctttcctaaagaggtctctttaaacagaattttgagagattgcgttttagttatgcgggccagggagaagtggatgctcgccgcgccaggcacgtccacaggaacgcagccccgagtcaccgtgtccttcgtcctttacccgcctgtgtcaagcctcccaaaatgacccgcagttcagctcgtccttcgccgtgaacgtccstttgcggggttgcggccgccgtcgcccgccaccccttgccccactacccaagccactgcgccgtcgtctccycaaactgccccgcagttccgcgcccgcccgccgcggcagttgcggggtcgggctggctggtgcctcgggacgagaaggccatcaagtgttgctccctcatctgtaacgtgcagccccccgcactgtcgccgtcgtcgcgcgcagttcccgcgcccgggcggccgcgcctccgccgcgcagccgggctgggcggtttctcagaaactttcctccctcctcctctcctctgcgctgagaaagcagcgaaagctcccactcctctccgcaaacggactctccacctgagtaaccggccgcctccccggccgtggggatatcggagctaaggggagagccttcccgagttcgccgaccctccggcgctgcagcccgctcccacccctaccctgggctccaatgatccgcagccccgcgcatttcgaaagcccgcccggctcgccggcgcctggggagggccacggcggcgcgcagcccgggccccgcaccacggccgcccgcgtgggtcccctctgccctcacccccgctcggcaacgtgcccccatcgcaaccccggccgcccggcgcgggggcctgggacggggaagaactggggaaatgtgggtttgggggcgtgtttgggggactccgggagcgtgggcttcacaggcgaggagcggggcgagaggcctctcaggccggggtgcgcccaccgccccggcctcagggagcgactttcccggaggccgggggacgctgccttcgccatttcatcttcatcatcacagcgcccacacttgctcttctctcaagctctttgcacagaaaaagtgattctaaatctcctctaggatctcctgtctggtgttcagagtatgaatttcttttcaaaacttgctgtgtctttcacctgggccacaccctacgcccacccaccccctctcagccaaaagggaggtaaaaaatcctgcgggcccagctgggggtggggaaggggcccacagtcccgctggaaaacctcagcggccacctcccggatccgggctggcctggggactggggtgggatggggtggggtccgcctcaggccgaccccgcagaaccgaaagtgccgagttgacacgtaaggcccagcccctctgcggccgcccgcgcgcccggcctgtcacgcgtggggacactgagcagcaggcatcggagcgagcagtacaaaaagaaatcaaggcgttgggcgcgaaacctcgacgcgcctctaaaggaacgttgagaaaaggcagggagcagggcgcgcggccgggggattgcatcattgcggctccccctccagaaaacgggccccgaaccgcggcgaccatcatggcgctcgcgccgggctgcgctccccgcgcgcctgccccgcgctccggccgcggccccggagcctcggacgcgcatttcacaaacattctcgccctctcccgagcgcccgcccccaccccctccttctttctgtgtgtgtgtgcgtacgtgtgtgcgtgtgtgcgcgcgcgtatttgtgtgtagggagaacttgcagatgattttttttttccctcccgtgctgctggttgtaaacttgattggcattggctgcgcccactgaccccgacgctgagtccgctgaagatttaaggtggatccgagaagctgcagcttcaggcggagtctcgcgctctagtcggttttgggaagagaaaaaaaaaaaaaaaagccccgaaccgggcgcccgccgcgtttgccgaatctcccgcggccccagcccccgcgcccgcccggggcccctccccgcctcgcgcgccgcgcgcggcctccgcccacctcccacttcttccccattggccggcgcgtgcagtttgaatttttttttttttttgatgcttgttttcttgtaaaaaatacagtcccccagatcgtgtgacgaaacctgcttcggcggcccgaggtgggggttttgagtcggttagtggaggcagtgggagcaggatgggcggagcttctgttccaaaaatttcccctaagtgcggttgacagtgtgcaggcaggcgggggtgcgcggggcggtcagcgatctgcagcttcgcggggacagagatgtaacccaactcgttcacggatgttccgcgcgccgtgtcaccggctgcgggccaggggtactcggaaggcgcgggcaggagcctggcgaggatgcaccttcccctgccttggaaaggtagaactggggagtgcgggagggtgaaggtggcccggaaaagaacacctcttcgcaaccaaaaaaaaaaaaaaaaaaaaaaaaagaggaaatagaggaaaaatgtgttatttcaaccgccactcagaacccatcataattcagccagtcggtgtcatttttattgaattaaattttaaaaaagttttctttgatttccagagcgtttttgcgggaggaatatgttaaaacaaactcaagatacgaaatgagacttttgaagtgcctttgatttctgggtacggaaattcttttgataaagcgtgtgtacgttaagatttaggatgactttttttttcttttttgtaatacaggtctaatggaaatgacattctttatgaattagaacccaattatgttttaaagtttataataagtcaaatgattctctcagtccctatgtccgtattagtgaaattctatctccatattagcgaaatttgcatagatacacacctttttctttttgtcttttagtcttgctgcagtgtatcggacgagtttaaccagatatccagcactagccttctaacagtttctaactcagtggtgacattttttagttcttaactcccccaatccttcttagcctaacaaacctcttaattaaggtccatgaaagaccataaaccaacctgattatgcctttagcaaggctgtgttcacttaatctctaatcccatatcataaaagtccgctagtcactcctgacctccaggaacccacctaaccagggtggacactataagaaaacatgtgttttaatggaatgagaacttttttgagttgaagacacgctagcctcaggaagcagtgagctcaccatccctggagtgtgagtcaagcactagtcttggatgaccccttgataggaacgttgtagacaagattcaaatatcaaatagtatttggactagtgatttcaaagtctattccagacccctgtgaaactgtatttccaaccttggcatttctggatttccactaaattaagccactttccttgctcattagcatcttgtagagctgtgtggctatttgagcgcttgaatgtggctagtccaaattgagatgtgctatatgagataaacaccacgtttccaagaattagtatgaagagaaaatgttaaatatttcattaataattttaatattgattacctattgaaataatattttgtcatattgggctaaataaaatatattattaaaatgaatttcatctattccattttacttttttagtggagttactagacaatttacagatgtgtctcaaattatatttctattggacattactgttcaagactatcacctgtggtaacttgaggccccatctttaaaagtggtgactattaatactgaggagtaggtggtaacttctagctgccatcctaacttctcaaattaaagtgagacccaaactcagcctctgaaagctttattatttatttatttatttattcttcttcttattttttttaaaagatagagtctccctgtcatccaggctggagtgcagtggtgtggtcatgtctcactgcaacctccaactcctgggctcatgcaatcctcccaactcagcctccagaatcactgcaattacatgtgtgctctgaaaccttttttttttttttttttaactttgtagagagtcttgctgcgttgcccaggctggtcttgaacttctggcctcaaatgattctcctgccttggcctcccaaagtgctgagatgacaggcatgagccaccatacctagcatctctgaaacctttaaatagaattctgccaacatctaacacctactgtttaatctttaattaattaattaattaatttttcttttaaagacaggtctcactctgtcacacaggctggagtgcagtgggcatgagcatggctcactgcagcctcaagctcctgggctcaggagatcctctacttcagcctcccatgtagctggactacagatgtgtgccaccacatccagcagttttttttttacttttgtagagatggggtcttgctatgttgaccaggctggtattgaatgcctgacttcaaggaatcctcacaccttggcctcccaaagtggtgggattacaggtgtgagccactgagcccagcctgtttaatacttaatgtagggttcaagcccagactatgggaatatagtatagatatgtctgatgaactcagacttggtcaccacagcttttcacattatggcaata

SEQ ID NO: 1678 - DNA, 27509 bp, Homo sapiens
ccagcactttgggaggccgaggcaggtggaacacgaggtcaggagattgagaccatcctggctaacacggtgaaaccccgtctctactaaaaaatacaaaaaattagccgggcgcggtggtgggtgcctgtagtcccagctactcaggaggctgaagcaggagaatggcaggaaccggggaggcagaggttgtagtgagctgagatcgcgccattgcactccagcctgggcgacagagcgagaatccgtctcgaaaaaaaaaaaaaaatacacacacacacacaaaaactgtgttaatgcttaactacacaaaaatgataatcagataaatatgcatttatttagagaactgcatgttggtcagtccagtccctgcagagggaattcccagcatgacctcattcacttgtgaagacagagcaatccttgtgttttatttttttaagatggatctcactctgttgcccagactggagtgcagtggcatgatctcagccctctgccacctccaccttccgggttcaagagattctcatgcctcagcctcctgagtagctgagattacaggcttgtgcctccatgcccagctaatttttttatttttactagagatgaggtttcaccagtttgggcaggccggtctcaaactcctgacctcaagtgatccacccacctcggcctcccgaagtgctgggatgacaggtgcctggtcagcaactgttgtttagacatacacattttatctgctcgtccagcatggtcagccctccactttttaaattttattttatttatttttttgagacagagtctcactctgttgtccaggttggagtccagtggcgtgatttcggctcactgcaacctctacttcccaggttcgagcaattctcctgcctcagcttcccgagtagctgggattacaggcccgcgtccccacacctagctaatttttgtatttttagtagagacagggtttcaccatgttggccaggctggtctcgaactcctgacctcaggtgattctcctgccttggcctcccaaagtgctgagattacaggtgtgagccactgcacacggccttaaattttatttattatttatttatttatttatttagagacttagtctcactctgttgcccaggctggagtgcagtggcatggtctcggctcactgcactccacctcctgggttcacgccattctcctgcctcagcctcccgagtagctgggactacaggcgcccaccaccactcccggctaatttttgtatttttagtagagatggggtttcactgtgttagccaggatagtctcgatctcctgacctcgtgatccgcctgcctcggcctcccaaagtgctgggattacttattttgttttttgtagagacaggttctcactgtgttgcccaggctggtcttgaactcctgatctcaagtgatcttcccacctcagtctctcaaagggctgggattacaggggtgagccactgcaccccaccttccctctactttttgacggtttccttctgctatgaatgtgcatgtccagttgtctgcttcttagaactgatatttaccttcctcatccatcagccattggaggaggactgggaccgctcagattattgatctgacccattctttcggcagggtttcctggtggctgtcttccatcaccaaaactggaatcagaagagtttccatagccctttttttttccccacatctttgctgaagcagagttttgaaaaacaaaaccacaaactaagctattccccagaagaaatctgtaatcaaagataagctctgccgggcacagtggctcacgccttttggaggccaaggcgggcggatcacctgaggtcaggagttctagacctgccaggccaacatggtaaaacctcatctctactaaaaatacaaaaattagctagatgtggtggtgggtacctgtagtctcagctacctgggaggctgaggcaagagaatcgcttgaacctgggaagtagaggttgcagtgagccgagattgcaccactgcactccagcctgggcgacggagtgagacgacctcacaaaaatttacataaataaaataaaaagtaaaataaaaatacaaaagttggccgggtgcgtttgctcacgcctgtaatcccagcactttgggagggtgaggcaggcagataatgaggtaagaagatcgagaccatcctggctaacacggtgaaaccctgtctctactaaaaatacaaaaaattagctgtgcgtggtgacacgcacctgtagtcccagctatttgggaggctgaggcaggagaatcacttgaacctgggaggtggaggttgcagtgagccgagatcgcaccactgcactccagcctgggccacagagtgagactccatcttgaaaaaaaaaaaaaatacaaaagttagccaggggtgttggtgggtgcctgtaatcccagctatttgggaggctaaggcagaagaatttcttgaacctaggaaacggaggttgcagtgagccgagatcacacctctgtactccagcctggacaacagagcgagactttgtctcaaaaaaaaaaaaaaaaaaaaaaactaaataggccgggagcagtggctcatgcctataatcccagccctttgggaggccaaggcaggtggatcacttgaggtcaggagtttgagaccaggctggccaacatggtgtaaccccgtctctactaaaaacacaaaaattagccgggtctggtggcgtatgtctgtaatcccagctactcgggaggctgaggcaggagaatcacttaaacctgggaggcaggggttgcagtgagctgagatcgtgccactgcactctagccagggtgacagagtgaaactctgtctcaaaaaattaaaaaagaaattcagcaagtaatgagttaaggaattcgaatattaaggcgagtgacaaggaacgcccaggatgtggcccaggatggagtaggggggacactcatttaggagaaagctcaggccacaagacaggaggagccagccttgttggggttgaagggaagagcattccaggctgagggaactgcaaggcgtttgcatgggacactatgggatggcttctgcccttggtgggcagcctctggtctgaggccattctttggcctgcctgactgtctggcaaccgggaggaagccctgcccttcctggagacagaaacaaaggtctaggaaatatctgcttcccttttccttgaaaaacgcttaagggaacggaggactgggaggtgccgtctctctctgccagcctgccccctaccatagccatcccactcccatctcagaaagtgacccgccatcctccaaaaggctcggaccctgatcaaggagtcatcccccttgtcccagcacctccagttggcccagcctccaaaacggatgtcaaattcagccctttctccaaggacactgcccagtccaggccccactatcattcatctggactagaacagtcacctcctctcccatctcctggctgcagctcttgaagcctcaactgggcccctgtgaacacttgagttagggcaaggtccttcctctgctcagaaccctctatacctcccacctcgctgggcataaaagccaaagtcctggccaggcacggtggctcacatctgttatcccagcactttgggaggccaaggggggcggatcactagaggtcaggagttagagaccaacatggtgaaaccccatctctactaaaaatacaaaaattagctaggcgtggtgacgcacccctgtagtaccagctactcggtaggctgaggtgggagaatcgcttgaacctgggaggcagagtttgcagtgagccgagatcacaccactgtgctccagcctgggtgacagaacgagactggggttcagaaacaaacaaacaaaacaacaaagtcctcctcaggtgacaggaacttgcacctatctgccctgtcatctccctgcccgctcctctcctcgaatctctcctttgctaagcctgctccagccacactgttctcctggctgttcctttttttttttttttttttttttttttgagtctcactctcacccaggctggagtgcagtgcctctatcttggctcactgcaacctccgcctgccgggttcaagagattctcctgcatcagcctcccaagtaggtggaattacaggtgtgcaccaccacacccggctaatttttgtattttgcatagagatgggggtctccctatgttgcccaggctggtcttgaactcctgggctcaagtgatcctcccatctcggcctcccaaaatgctgggattacaggtgggagccgcgcccaggtggatttttgtctgactctgttcattcctgtgtccccagtacctggaaggacgccaagcacacagtaggcgcttaaaaaacattgagccacatgttgagaaaagaacggcaccattgtggctgcaagtgggacttgggccgcgcgggggagctcgcgcacctcgggccggggcaagagctcagtggaacccgcccgaggaagaacccgtggcgcaggattttcccaggccttctgaggaccaggggcgtcccccgtcccaccctgtgactttgctcaggccgttccggggcgggaattcagaactcctcagccccccaagaaaaaaatatccccgtggaaattccttgggaatgaccgaggcgggggaaatatgcgtctctggatggccagtgactcgcagcccccttccccgataggaagggcctgcgcgtccggggacccttcgcttccccttctgctgcgcgacctccctggcccctcggagatctccatggcgacgccgcgcgcgccccacaacaggaaagccttaggcggcgcggcttggtgctcggagacttaagagtacccagcctcgacgtggtggatgtcgagtcttggggtcacacgcacaggcggtggccaagcaaacacccgctcatatttagtgcatgagcctgggttcgagttgccggagcctcgcgcgtagggcaggggttcgagcgccccttctccctgcctcgcctctgcgcctgggggctgctgcctcagtttcccagcgacaggcagggatttcgagcgtccccctcccctccctcgtcaagatccaagctagctgcctcagtttccccgcggagcctgggacgccagcggaggggctcggcgcgtagggatcacgcagcttccttcctttttctgggagctgtaaagacgcctccgcggccaaggccgaaaggggaagcgaggaggccgccggggtgagtgccctcgggtgtagagagaggacgccgatttccccggacgtggtgagaccgcgcttcgtcactcccacggttagcggtcgccgggaggtgcctggctctgctctggccgcttctcgagaaatgcccgtgtcagctaggtgtggacgtgacctagggggaggggcatccctcagtggagggagcccggggaggattcctgggcccccacccaggcagggggctcatccactcgattaaagaggcctgcgtaagctggagagggaggacttgagttcggaccccctcgcagcctggagtctcagtttaccgctttgtgaaatggacacaataacagtctccactctccggggaagttggcagtatttaaaagtacttaataaaccgcttagcgcggtgtagaccgtgattcaagcttagcctggccgggaaacgggaggcgtggaggccgggagcagcccccggggtcatcgccctgccaccgccgcccgattgctttagcttggaaattccggagctgaagcggccagcgagggaggatgaccctctcggcccsggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcmgcctmgctatggctcccagcagcccccggcccgcgctgcccgcactcctggtcctgctcggggctctgttcccaggtgagtcggggtggggattgccgtcgggccagttctccgaagccccgggaggaccggctcccgggtcaggtcatgcatgcttaggtagctgtttatgggaaggaggggctagagacagcgattgaaaggcaacagccagtaggttcgaatccagaccctgcatacctccacgtgtggccttgggctatagattgcagctttaaaaaagggtagggggttggagatggaggggaggggcgggcctcgttttgttgcccaggccggtcttgaactccgggggtctagccttacctcctgcctcagcctcccgagtagctgggatgagaggtgtgaaccaccgccttgcttggctagattgcgtctcttacagtttctcagctgtaaaacgggaaacgttatagcggccacctggcagggtatcttggcccagcgcagcacctggccccaggactcgatcatgatggtttgggaacttggctctgtgccaacccaacaaggcttaagggacccccacccccctcaagatgtatattctgttcctcatcctctctgcccctggggaagtccagggctgcttctacttgggggaattccagagctgacttatccgtggcccaaagctgagaagtgggacgccccagcacaccctcccccagctccagcccagctagggaagagggaaggggtcagagggtctttcatggtggtgtaagtttggggaaccaggagggtgggagattgacagcttggttaacagctcaacaaagcctgagatccaggccagcacggtagttcatgccagtaatcccaacactttaggagccccaggcgggcgaatcacttaaggtcaggagtttgagaccagcctggccaacatggcaacatcccgtctctactaaaaatacaaaaattagctggcatggtggtgggcgcctgtgatcccagctgctcgggaggctgagggaggaaaatcccttaagcccacgaggctgaggttgcagtgaaccaagattgtgccactgcactccagcctgggagacatagcgagattctgtctcaaaaaacaaagcrttctgatccggactcagacccagatcgcactgctttctagctgagtaaccatttctctctatgaaatgggaatggtcccagaatctcccttggagaatgtatggagccagtgtcctcacacccccatccaagatagaacaaatctgagacaggaatctttgagtgaggcagtgctgggctcagacattttttcccaccttcggaggcagcagaatctgagggacctgatccaaataagccccttctttctttcttttcttttcttttttttttttttttttttttgagacggagtctcactctgtcgcccaggctggagtgcagtggcgtgatctcggctcactgcaacctctgcctcccaggttcaaacgattctcctgcctcagcctccctgagtagctgggactacaggcatgtgccatcacacccggctaatcactgtgttagccaggatggtctcgatttcctgacctcatgatctgcccaccctgcctcccaaagtgctgggattacatgcgtgagccacagtgcccaccccgtaagccccttctttcttacctgcaaggtagccagttgctacccatcctgtgctgagttacttgtattagcaagggatggggtggctatactcacccaccttacagatggggaaattgaggcccaaagagggggaaactacgtgtctcagggagtgaggagccagtctgattcctggagggctgactgtctccacctgacttcttaggagggaggagggcaccaacttcacattaaaatctggttggacacagtggctcacacctgtaatcctggcattttgggaggcttaggcgggaggatcacttgaggccaggagtttgagaccagccttagcaacatagtgagaccccatctctacaaaaatgtttttcagggccaggcgcggtggctcacacctataatcccagcactttgggaggctgaggcgggcggattacctgaggtcaggagtttgagaccagcctgaccaacatggagaaaccccgtctctactaaaagtacaaaattacccgggcgtggtggcgcatgcctgtaatcccagctactcgggaggctgaggcaggagaatcgcttgaacctgggaggcggaggttgcggtgaactgagatcgtgccattgcactccagcctgggcaacaagagctaaactccgtctcaaaaaaaaaaaaatgtttttcaaatattagccgggtatggtggtgtcctgtagtcccagctacttgggaggctgagatgggaggatcacttgagcccaggagttcaaggttacagtgagctatgattgtgccactgtattccagcctgggtaacagagggagacccgtttaaaaaaaaaaaagtgatggctaaagtccttccatggctccctattgccctcagtataaagaacacatgtggctgggcgtggtggttcacgcctgtaatcccagcactttgggaggctgaggcgggcggatcacttgaggccaggagtttgagagcaggctggccgacgtggcgaaaccccgtctctattaaaaatacaaaaattagctgggcgtggtggtgcttgcctgtaatcccagatactctggaggctgaggcaggagaatmacttgaacccgggaggcaraggttgcagtgagctgagattgcgccactgcactccagtctgagtgacaaagcgagactccatctcaaaaaaaaaaaaaataaaagaacacatctttagcatggccttcagtgctcacgggatcttcctgaattaatctccccctcttcatccttgctcactcagctccagccaccctgccccgggacatctgtacttgcctggaacttatttcccttttctccggacagccagccctttctcgtcatttagatctctgctgaaacattaccctgtcaccaaagcactgtctattctatcaccctgttttgtttttgtcaaagctcatattaacatcagttattaattatcttgtttgctcataatttttttttttttttttttggagacagagtctcgttctgttgctcaggctggagtgcagtggcacaatcttggctcactgtaacctccacctcccaggttcaagtgattcttgtgcctcagcctcccaaatagctaggactacaggcacgtcccaccatgcccagctaatttttgtatttttagtggagacggggctttgtcatgttggccaggctgatctcaaattcctgacctcaagtgatctgcccgccttggcctcccaaagtgctgggattacaggcgtgagccaccacacccggcctgctcatgaattttctctttaacttccacatcgaaggcaaagtattgtcttgttaaggctgtgcctccagcacccagcacaggctgggcgcacattcccttgatgaacctgatttgtaatgcctgtcgcctcttccctcgtttcttctaggacctggcaatgcccagacatctgtgtccccctcaaaagtcatcctgccccggggaggctccgtgctggtgacatgcagcacctcctgtgaccagcccawgttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactgtgagtaactgagcccggagggctggactaggcagaccsggtgggagagacgtgcaggggcacctgcagaggcctgggggaatctttgccacttgctcgtagggtcaaggaggggctccttgcagggcaggtggggacatccttggaaagtccctttgtgaatttctttgggtacaattaaagtatttacaggctgggtgcggtggctcatgcctgtaatcccagcactttgagaggctgaggctggcggatcacctgagatcaggagtttaagtttcgccaacatggcgaaaccctgtctctgctgaaaatacaaaaatcagccgggcatggtgtcaagcgcctgtaatcccagctacttggaaggctgaggcaggagaacgcttgaacctgagaggcagagattgcagtgagccgcgatcgtgccagtgcactccagtctggataacagagcaagattccatctcaagaaaaaaaaaatgccatctctctatgcctcactctttgaacatatgacacggtcctgcttcagacactttaataaaagatgcaaattaagccaagtgtggtggcttgtacctataatcccaactactccagaggctgaggcagaaggatggtttgagcccaggagtttgagaccagcctgggcaacagagtgagaccctgtttctttcttttttttttttttttttttgagacggagtctcactctgtcgcccaggctggagtgcagtggtgtgatctcggctcactgcaagctccgcctcccgggttcacgccattctcctgcctcagcctcccgagtagctgggactacaggcgcctgccaccatgcccggctcatttttttgtatttttagtagagacggggtttcactgtgttagccaggatggtctcaatctcctgacctagtggtccgcccgcctcggcctcccaaagtgctgggattacaggtgtaagccactgtgcccatccaagaccctgtttctaccggaaaaaaaaagtaaataatttagctgggcatcgtggtgtgcacctgtaatcccagctgctcctgaggctgtgatgggaggattgctttaacccaggggttcgaatcctaggagttcgaatccatcctaggcaacatagcaaaaccccatttttatttaaaaaaaaaaaaaaagatatgagttaaaactagccctgggatggcatttttcacatattggtaacaaacaaaagaattgatggccgggcgcagtggctcacgcctgtaatcccagcactttgggaggccgaggcgggcggatcacaaggtcaggagatcgagaccatcctggctaacatggtgaaaccccgtctctactaaaactacaaaaaattagccgggcatggtggcaggcgcctgtggtcccagctactcaggaggctgaggcaggagaatggcatgaacccgggaggcagagcttgcagtgagccaagatcgtgccactgcactccagcctgggcgacagagcaagactccatctcaaaaaaaaaaaaaaaaaaaagaattgataacagctgtgctgccaaggctattggaacgtaggaggtcctaggacagtgctgttgggagcataaataagcccaaccctgtggcgggaaattgggcatcagttctcaaaatgtcatgggctgggcacggtggctcacgcctgtaatcccagcactttgggaggctgagggaggcggatcacttgaggtcaggagttcgagaccagcctgaccaccatggagaaaccccgtctctattaaaaatacaaaaaaaactagccaggcatagtggcacatacctgtaatcccagctactcgggaggctgaggcaggagaatctcttgaaactgggaggcagaggttgcggtgagctgagattgcgccactgcactccagcttgggcaacaagagcaaaactccatctcaaaaaaaaaaaaaaaagaaataaaagaaggtatgttgaatatgagtggtatgccaccctcacattagggaagggcagtttcggggaggctgtatttatgtataaaatagccctaaaaggaagtgggagaaatgacaatattagctggctatgagaagagaggctgggaggctgtgggagagggcttgggtgtggagaattctttttgttttttcctttttttgagacagagtttcactcttgttgcccaggctggagtgcaatggcacgatctcagctcaccgcaaccttcacctcctgagtttaagtgattctccggcctcagcctcccgactagctgggattacaggcatgggccactacgcctggcaaattttgtatttttagtagagacagggtttctccatgttggtcaggctggtcttgaactctgacctcaggtgatccgcccgcctcggcctcccaaagtgctgggattacaacgtgagccactttgcctggctgagaattctttttttgttgttgtctttttgagatggagttttgctgtgtccccagcctggagtgcaatggtgtaatctcagctcactgcaacctctccctcccgggttcaagcaattctcctgcctcagcctcccaagtagctggaattacaggcgcccagcaccacgccyggctaatttttgtatttttagtagagacgggatttcatcatgttggccaggctggtcttgatctcctgaccttgtgatctgcccgcctcggcctcccaaagtgctgggattacaggcgtgagccactgcccccagccgagaatttctctttgcgtccttcctactttggggacttcgaatggtgggaaagagttatcaaggccaaaataaggaattcaaatgaaaacaaaacaaaatcaaagaagaaaaaacagaagagcactgggcaggctaggcacgtggctcatgcctataatcccagtgatttagaaggccgaagtagaaggatcgcttggaggccaggagttggacaccagcctgggcaacatagcaagaccccatatctacaaaaaataaaaaacctaaccaagcgtgctggcatactagtagtcccagctactcaggaggctgaggtgggaggatcacctgagcctgggaggtccaggctgtagtgagccgtgatgacaccactgcactccagcctgggtgacagagaaagaccctgtctctaaaaaataaaaactggccaagtagctttgggattagccttgggttccagtcccagcaaggcctttaatagcttgggacatgacttctgcatttactttgcaatcaggtgagacctcctctgatggggaaaatgacacggtgagtgacaaaggatgttctcctatcattgtgtcagggcaaggaagcctctgggtaaatgatcaaatgatcagctttgcttctgatttggagggtgggtgagcagatgctgaccttcccaggtgagggaagtccccgaacattcccagcagcttctggaaaccccagggaaacctctttgaaggtcttttctgcatctctgcctgataggtctttttttttttttttttttttttytttttttgacacacagtcttgctctgtcgcccaggctggatcactgcaacctccatctcccgggttcaagcagttctcctgcctcatcctctccagtagctgggattacaggcacctggcaccacgcctggctaatttttgtatttttagtagagacagggtttcgccaagttggccaggctggtctcgaactctagacctctggtgatccacccgcctcagcctcccgaagtgctgggattacaggcttgagccaccacgcgcggctctgcctgatagctgagagcatagaactccaggtttgagacctggctctgccacatttctccctctatgactgtgggtgccccactttgccttagtttttacctctgtgaaatggagcagatggctggcacaggtagcaaaggagtaaaagttatgtgggagggtggtacctgagagagactctagcttggtcttgccccacccctggtgtaaacataaagaagcctccctggatggctcaatcttctccaaaaaggttagaggtgtaattcctagaggaggcgaccactagctgggctttgaaggatgtgtaggagttcataaggacaggcattctgggcaggaggaacagcctgggcaaaagttgggagcagggagaaatcttgatggaggcaggaggaggaggaggtaggttggtgtrggccaggygcagtggctcacacctgtaatcccagtgctttgggaggccaaagcaagaggattgtttgagcccaggagttcgagaccagcctgggcaacatagcgagaccctgtctctaagaaaaaataaaaaaattagggtacagtggcatatgcttgtattctcaactactctggaggctcaagtgggaggatcayttgaacccaggaatttttttgtttttgtttttgtttttttgagatggagtctcactctgtggcccaggctggagtgcagtggtgccatcttggctcactgcagcctcctccacctcctgggttcaaccgattctgctgcctgagcctcccgagttgctgggattaaggtgcccaccatcatgcccagctaatttttttgtatttttagtagagatagggtttaccatgttagccaggctggtcttgaacgcctgaccgcaagagatcctcctgcctcagtttcccaaagtgctgggattataggtgtgagccactgagcctggtcaagcccaggaatttgaggttacagtcagctatgattgcaccactgcattccagcccaggtgacagagagagacactgcccctaaaaaaaaaaaaaaattgattgatgggaggaagggtgaggttggcagagccttgaatgccaggtggaggagctgggactttccttcttggggtgatagggagtcatggagggtttstgagcaggccagggattagatagctgaaggctggatttactggaagccaatgagcagttggctatggtccttgtccacgcggcccatgttgtgggcagtgaccgtattcaagaagggaaggacagacaagtatttgaatacttcagtgaccaggatttggtaaaggactgcaggtcagggtcaagaagaggtgagagcaggacagacttcctccccgctgcaccaggcagctgagctgggtttcctctaggggctgaggtttgagggtacctcaagttctgcaagagtctataggaggtggtaagagagaagagctggaggtcagagttttcttgactatatatatatatatttttttgtttttgtttttaacagcttaacagctttctgttttatttttagagacagggtctcagggtctcactttgtcacccaggctggagtgcagtggtacaatcgtagctgactgcagcctcaaactcccaggctcaagaaatcctcctcccacccttagcctcctgagtagcagggactacaggtgtgagccagcaggaagcccagctggttttttttttttctttggtgttttttgtttgtttgtttgagaccggagtttcgctcttattgcccaggctgaagtgcaatggcaggatcttagctcaccacaacctccgacccccaggatcaagctattctcttgcctcagccacctgagtagctgggattacaggcatgcgacaccacacaaggctaattttgtatttttagtaaagacagggtttctccatgttggtcaggctggtctcgaactcccaacctcagatgatccacctgcctcggcctcccaaagtgctgagattacaggcatgagccaccgtgcccggcctttttttttttttttttttttgagacagagtctcactctgtcgcccaggcaggagtgcagtggtkcgatctgggctcactgcaagctccgcctcccgggttcactccatcctcctgccttagcctcctgagtagctgggactacaggcgcccaccaccacgcctggctaattttttgtatttttagtagagacggggtttcaccgtgttagccaggatggtctygatctcctgacctcgtgatccgcccgccttggcctcccaaagtgctgggattacaggcgtgagccaccatgtctggcctggccaggctggtcttgaactcctgacttccggtgatccatctgttctggcctcccaaagtgctgggattacaggcataagccaccacgccatgccgaagcccagcttgtttttaatttttttttttttttttggagaaatgaggtcttgcaatgttgcccaagctagccttgaactcctggcctcaaatgaccccgccttggcatcccaaagtactgggattacagatgtgagccaccatgccccagccttgctttcttgagatacgatttagaataccataagattcatcccttttaagcacataattcaatgacttctgtacaaacaaccatgactacaatctaattttaaaatatttcaatcactctaaamaagaaacctcctgcttatgtacagcgactctgtctacctcttaagtgaattctcctacctttaatagccctattttacagttcaggaaactgaggttcagagagacaaagtcacttacccacagcaaagaagcaaggctgggtatcaaatgcaggacccccccggtcctgatgcttttttttttttttttttttcctctgagagagactctcactctgtcactcagtctagagtacagtggcgcgatctcagttcactgcaatctctgcctcctgggctgaagtaatcctttcctcacaagtaaacctcagcctctcaagtagctgggactacaggcacacaacaccacgcctggctaatttttgtatttttaggtagagacggggtttcactatrttggccaggctggtcttsaactcctgacctcaggtgatccgcctgcctcggccccccaaagtgttgggattacaggcgtgagccaccacacgcagcctttttgttattagactctgtcattactgactttttttttttttttaatagaaacagggtctttctttcccaggstaaagtacagtggcatgatcacagttcactatagccttaaactcctgggctcaagtgatcctcctgcctcagcctcccaagtagcagggactacaggtgtgcaccaccacacccagttaaccattcattcattcattcattcatttattttgagatggagtctcgctctgtcacctaggctggagtgcagtggcacgatctcagctcactgcaacctccacctcccaggttcaagagattctcctgcctcagcctcccgagtagctgagactacaggcgtgcaccaccatgccagactaatttttgtatttttaatagagacggggtttcactctgttggtcaggcttatctcgaactcctgacttcgtggatccaccctccttggcctcccaaagtgctgggattaaaggcgtgagccaccgcgccctgccaacctttttttratttttcttagagatgggggtctccctatgttgcccaggcttgtcttgaactcctggcctcaagtgaccctcttgccttggcctcacaaagtgctaggattacagcctgagccatcacacctggccaacaggtttttttttttgttttgttttgttttttaaagaatgtctaggccaggctcatttactttcacctgtaatcccagcactttgggaggccggggtgggcagatcacttgaggtcaggaattcgagaccagcctgggcaacatgctgaaaccccgtttctactaaaaatacaaaaattagctgggtgtggtgacacgtgcctgtaatcccagctactcaggaggttgaggcaggagaattgcttgaacccaggaggcagaggttgcagtgagccaagatcatgccatcaccctccagcctgggcgacagaaggagactcagtctaaaaacttaattaattaattaattaaaaataaaaatacaaaaattaacctggtgtggtggtgtgtgcctgtaatctaagctactcaggaggctgaggcaggagaatcccctgaatcccagaggcagaggttgcagtgagccaagatcgagccactgtttgcccagtctagtgcactgggctgctgaatttatttgaccagacacctagcaatagactttgaagttcttttccacttttcactctaagatgctgctgtcatgaataaggaatattttgatccccttcacaaacactcggggccctcttaccagttttcactgaagatcttgacattcctatctgcttaggtgtctgggcgtgtttgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaasgagctgaaacgggagccagctgtgggggagcccgctgaggtcacgaccacggtgctggtgaggagagatcaccatggagccaatttctcgtgccgcactgaactggacctgcgsscccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggacmgtggtctgttccctggacrgkctgttcccagtctcggaggcccaggtccacctggcactgggggaccagaggttgaaccccacagtcacctatggcaacgactccttctcggccaaggcctcagtcagtgtgaccgcagaggaygagggcacccagcggctgacgtgtgcagtaatactggggaaccagagccaggagacactgcagacagtgaccatctacagtaagaaggggcaggggcggagtggggcttcttgrgggtgtgacctgaacccggggcggggctcactgtgtgcctattccaggctttccggcgcccaacrtgattctgacgaagccagaggtctcagaagggaccgaggtgacagtgaagtgtgaggcccaccctagagccaaggtgacgctgaatggggttccagcccagccactgggccygagggcccagctcctgctgaaggccaccccagaggacaacgggcgcagcttctcctgctctgcaaccctggaggtggccggccagcttatacacaagaaycagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcrtgtttttccagatggcccccractggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcraggtgaccgtgaatgtgctctgtgagtgagccggcgggcagarctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccrggacagggcctcttcctcggccttcccatattggtggcagtggtgccacactgaacagagtggaagacatatgccatgcagctacacctacyggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggycccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctratcacattcaaggtcaccaggtacagttgtacaggttgtacactgcaggagagtgcctggcaaaaagatcaratggggctgggacttctcattggccaacctgcctttccccagaaggagtgatttttctaycggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcktgtgtgtgtgtgtgtatgtgtagacaagctctckctctgtcacccaggctggagtgcagtggtgcaatcatggttcactgcagtcttgaccttttgrgctcaagtgatcctcccacctcagcctcctgagtagctgggaccataggctcacaacaccacacctggcaaatttgattttttttttttttyyagagayggggtctygcaacattgcccagacttcctttgtgttagttaataaagctttctcaactgcctcagccttgtgtgagttgaggggaggtgtcacatccagctggagtcctttctaagcagccacagcctgatcctcccacttcctcccccaagaaaacattgtgggttgatggccataccctgaggttctggtccaaatcggactttctatgaccttctgggtctctagtgaaaactaaagactcctctccagaaaaaaacatttggtttctaatgaggcctggaatcttattcttgacctggggagcggaatccctttttgcagtactcccgggccctctgttggggcctccccttcctctccagggtggagtcgaggaggcggggctgcgggcctccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgttgttgttgttgtttttgcgatcactttctccaagttccttgtctccctgagggcacctgaggtttcctcactcagggcccacctggggtcccgaagccccagactctgtgtatccccagcgggtgtcacagaaacctctccttctgctggccttatcgagtgggatcagcgcgggccggggagagccacgggcaggggcggggtggggttcatggtatggctttcctgattggcgccgccgccaccacgcggcagctctgattggatgttaagtttcctatcccagccccaccttcagaccctgtgctttcctggaggccaaacaactgtggagcgagaactcatctccaaaataacttaccacgctggagtgagaccacgaatggtggggaggggagggtcccacggacatattgagggacgtggatacgcagaagaggtatccatgtggtggcagccgggaaggggtgatcagatggtccacagggaatatcacaaactcgaattctgacgatgttctggtagtcacccagccagatgagcgcatggagttggsggtggggggtgtcaaagcttggggcccggaagcggagtcaaaagcatcaccctcggtcccttgttctcgcgtggatgtcagggcccccacccaccgagcagaaggcggactcaggggcgctccagggtggctcgagctcacacacgctgagtagacacgtgcccgctgcmccctgggtaaatacagacccggagccgagcggattctaatttagacgcccgcgaacgctgcgcgcacgcacacgtgtcctcggctcgctggcactttcgtcccgccccctccgtcgcgtgccggagctgacccggaggggtgcttagaggtatggctccgcggggtcaaaaggagaaggatcagtgagagaggcatccccacaccctcccctagaactgtcctttccccatccagtgcctcccaaatctctcttagtccccaaatgtatccccgccctaaggggcgctggtgggaggagctaaatgtgggggcggrgctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgyctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagccccgctctggttcggggtggacagggcgggggcggagtccctggacctgagaaacggcctcctgtccctcccagctctgccctcgcctcgctcccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctgtgctgtgcaccatggtccacggactggcatcttccccactcgcggtccgcgaagactccatctctccaactaccctgactcagaggcgctgttcccgctccacccagarccctggcaaccgggtccctcagctgttcccgcggttccttccatgagcccagccttgcgtcccggckccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatggctctctgctaccacgtcccagagacaccctcgaggtttagactctgggagtgcgcctttaaaccggaggcctgggcacgacgcgggacgcctgggttctttccctggctgcagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctyggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggcgttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggatgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctgrtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtgkcccgagggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggctt

SEQ ID NO: 1679 - DNA, 25322 bp, Homo sapiens
  misc_feature (1)...(25322): n = A,T,C or G, or insertion/deletion polymorphism (see Tables 1-2)
gctgtcgctggctccctccagagccccagggaaccctcagctcaaggtgcccccaaattctaactttccaagaaagtgtcaggagggctctggggtcagcctgggtgttaatcccagctctgctgcttgctggccccatgaccttggtatggttacttcacttctctgagcctcgcttttcctgtttgtgaaatggggacaatggcagcatccaccgcatagggttgttacgaaggtcaaggtcgtcacgtgcacgcctggcaccatgcctgtgcgtagttctcaagttagagtgacgactgggttacggatgctgagcgtattaaaatgaaccaacgtgaatatggtgtgtgtgggagggtggcggcttgtcacccacccaggacggcctgtctccctggagagaaactgcggagggaactgggaaggccttggggcccaagggtatgcagaaggacccaggctcctgctgaggctctcctctcccgggacaggcggtggagggcagcgtcctggtcagctcctcctctgaccattccttgacygtctggaaggagctggagcagaagcccacccatcactacaagtcagcatccgaccccatccacacctttgacctgtacggcagygaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagccatggggtgaactgaggcttgtctttttttttttttttcaatagagatggagtctgactatgttgcccaagctggtctccaactcctggggctcaagcgatcctcctgcctcggcctcccaaagtgttgggattacaggcatgagccaccacgcccagcctgaggcttatcttgctggtggtgtcagggtggggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggagtgaggagcagcacagtgagggtgggaggcggcctgatgcagggagtgaggagccggacagtgagggtgggaggcggcctgatgcagggagtgaggagcaggacagtgagggtgggaagtggcccgatgcagggagtgaggcgcaggacagtgagggtgggaaggagcctgatgcagggagtgaggagccggacagtgagggtgggaaggagcctgatgcagggagtgaggagccggacagtgagggtgggaaggagcctgatgcagggagtgaggagcaggtgtgagggcgggaagcggcctgatgcagggagtgaggagcaggacagtgagggtgggaaggagcctgatgcagggagtgaggagcaggtgtgagggtgggaaggagcctgatgcagggagtgaggagcaggatagtgagggtgggaggcggcctgatgcagggagtgaggagcaggtgtgagggtgggaagcggcctgatgcagggagtgaggagccggacagtgagggtgggaaggagcccgatgtagggagtgaggagcaagtgtgagggcgggaagcggcctgatgcagggagtgaggagcaggacagtgagggtgggaaggagcctgatgcagggagtgaggagccggacagtgagggtgggaagcagcctgatctttgcacgggctgccaggcttctggttcatacagccccaggtcagtttccagaaccctcgctcttgggtaggggaaagagacattgctctggagtggcaggacggtgggagaagttgagtccctctcatttctcctccctcaccccctgccttccatcccagtctgaaggcagccaacctgatcctgggcttggaaggttgggggtgggcttcctatcctgggctctctgcataggctcttgtggcttcccctttcctcccctcaggagcgggaggcagctctctgggagaagaaaggacattgggagtgagaatctggatgtgcctcagcccagctctgtgtccttgggcaggtcacatggcctctctgagcctggctgaaccagggataatccacacctcgtggggtctctggaaggcttaacacagtgctaggttcctgtgctttctggatccgccctcttggctagccagatccagtctcttcaactctctcctcctgaactttctctttccaggctcggggggggggacccaaatatagggggttctgcgtggctgcctcagggttagatgccctggtgggaaaggggcttctggcttcaagatcaatgtttaactggatgtgcaagtcaatatttaccagaagagaaagcaatctgaacaggggttggctgagagtaaaggtcctggtgggaggggaggggtgggctgggccagctggagcctgggcagagagtgaggagcacccaagtggggccagaggaacgttgtgtgtggcagcaaggagcccgcagaggtatgaggggaggggctgctcggcctgctccttgggtaggagaggaggagggagctgcctccctggctgaggggtctgggatttattcaggaggcctgtcactccccagcctctyctgggacttgaaaaactggagcctgttcttggcaagaagattctaatgcccaggtcggagtcggggccctggccaagggctcttgtgtgggatgggggtggggccggggggaccaaaggatcctccagaagggttggccccaagatgggggtgggctggaggtagctgagacctgctctgacttatcctcctgagaccaacacctgcccttcccagagccagcctggagcagaggcctgtgatgctcctaagtgcagaggtggctctggccagagtcattcactgggctctgctgctgggtcaaaaggcagctctctggctgccttgccacccatggtgagacctcagggcctcacaggtatgtccagccttgtgggcaagacctgaccagcctgagaaagacgggttggggccaggcgtggtggctcatgcctgtcatcccagcactttgggaggctgaggcaggtggatcacctgaggtcaggagttcgagaccagcctgaccaacatggagaaaccctgtctctactaaaaatacaaaattagccaggcatggtggcacatgcctgtaatcccagctactcgggaggctgaggcaggagaatcgctttaacccaggaggtggaggttgcagtgagccgagatcgtgccattgcactccagcctgcatgataagaatgaaactccatctcaaaaaaaaaaaaaaaaaaaaaaaagacaggctaaatggatgcagcaggctgggtaggagctctgtgttggagctctgcggtggaggcttcagggcaggcttcccagaagaggtggccttgagccaagctgaccccagccatcgggggagtgccaagcattgtactcagggtttacaaagatggtcttatttatttttttgagacagagtcttgctctgtcgcccaggctggagtgcagtggcgtgatctcggctcactgcaacctccgcctcccgggttcaagcagttctctgcctcagcctcccgagtagctgggattacaggggcccaccaccacgcctggctaattttgtattttcagtagagatggggttttaccatgttggccaggctggtcttgaactcccgacctcaggtgatccacctgcccctggcctcccaaagtgctgggattacaggcttgagccaccgtgcctggtcacaaagatgggtttttgcgacgcgcaaaggctcccgaccggagcacacgccggctgacctgactcgaggaagaggagccttcacgtgcgtcctgcacccttggccctgcgagactaccgtgaaccccgagaagggatcaggcgccgatctgaccaaccggaggcgggataagccactccctaatannnnnnnnnnnnnnnnnnnnactgctgactctggggcaagggcagagaatggggcctcccaagggaggagacagccacaaagactgtgatggggaacgtgatggggcagtacccaacaggcaggagaagggcacgtagccacaaagatggtcttttgccgggtgcagtggctcatgcctgtaatcccagtactttgggaggccgaggcaggaggatcacctgaggtcgggagtttaagaccagcctgactaacacagagaaaccccgtttctactaagaaatacagaattagccaggcgtggtggtgcatgcctgtaatcccagctattcgggaggctgaagcaggagaatcgcttgaacctgggaggtggaggttgcggtgagccgagatcctgccactgcactccagcctggtcaacgagagcgaaactccgtctcaaaaaataaacaacaaaaaatcccaaaaagacggtcttattttggtcctcaccatgcatgtgagaagagtgagggacttgtgccaccgtttkacaaggtaaggccaagcctggtggagttacgggaaatgccgaggtcctttggcaagaggtagcctggattcagacacagatctgattcacagcgcagggccttgtagaatgagaacgtttttgatttggtatctccctcctattcaccaaaacaccctcagtgcatgaaatgcatgaaatatgaaacaccagaaactaaaaagggggagaagccagggcggatgtcccagctgcaggagtgggagccgctgctcgtgtgtttggggtctgttctgattctggagcctgcttcttccccttggcaatcatgacccaggacttggcgttatctgtgatcgcgtgggtaggattccctggcgggcgtggggatgtgagatgggaacagagctttctgtccctgccacaggaacatggygctgctctgggggctcctggtgctcagctggtcctgcctgcaaggcccctgctccgtggtgaggctgggctgaagtcaaggtggggtggggtggagggggaagaagaggggcgttggcatggagggagggcttggctccgaggggacctcctatcctcatccctttctccacagttctcccctgtgagcgccatggagcccttgggcyggcaggtactggggagtgaggagcctgtgatggggggaaggtcccgggggtctcactggtggcttgggcagggtggggggcctgtgggaagggtcggtctccatctgcttgctcctttccgcagctaactagcgggccgaaccaggagcaggtgtccccacttaccctcctcaagttgggcaaccaggtacaaccaggtggggctggggaagagtgggcggggctagagggaggagggcccatcggcaggggtcggggggtgggggcgcgtgctgaggctgaggctctggagtccagaggccagaagggagagagggtggggaggaccgaaggtgggcgccaggccccagaatgccagtgccctccgtctgacgctccctcttccctggggctgggacaaggccctgctgtcctcaggcacaggggctgtgacaaggccttcaacacagaacctggagctgaccccttgacctccctgacccctgatctgtccytgcaggagcctggtggccagactgcyctgaagagtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtaccctggcaccacttgtccagaccaagagagctggaggccagtaggaactcastactccartggttctccgcgggcggttcctccaccagggtcacgtggctgtttggtaaaaatgcagattcctaggccggggcggtggctcacgcctgtaatcccarcactttgggaggctgaggcgggtggatcacgaggtcaggagttcaagaccagcctggccaacatggtgaaactctctctactaaaaatacaaaaaatttagctgtgcgtggtggtgcgcasctgtaattccagctactcaggaggctgaggcagagaactgtttgaacctgggagttggaggttacagtgagccgagatggcgccactgcactccagcctgggtgacagagcaagattccgtctcaaacaacaacaacaacaaatgcagattcctgggcccccacccatctgtctatgtgaatcagatctcagggactgggccggggaatctgcttatttacaagtcctcctggtgattttttttttttttttgagacagagtcttgctctgtcacccaggctagagtgcagtggtgtgatctcagctcactgcaacctctgtctcccaggttcaagcaattctcctgcctcagcctcccaaatagctgggatcacaggcaccagccaccatgcacagctgatttttgtatttttagtagagacggggtttcaccatgttggccagggtggtctcgaactctcgacctaaggtgatcaacctgcctcagcctcccaaagtgctgggattacaggcgtgagccaccgcgcccggcccctcctggtgattcttatgcaagagtttgctagctacactctttcccactgtgctggagggtctcactgtgggaaacggaagcccagagagggaaggtaacttgyggggggtgaggtcacccagcctgtcagccacaggggtgagagycacgcagaacagatccgtggctgtggaaggatggcgtgtggtcccgtggacgtcctcgtcacgggtatccaggagggactggagtgggcagtgggggtgagaaaggacccgcagccgggcctcagcctgtgcggtgccctccaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggtaggcgctgatggcagggagctccctcagtcctgccctgggtggaggagggtgagagcaaggggctgggcctctggtakcgagtaggggcgtgtctggctgtggagcctggagccctgggaacagcttgtgctgcctccgtgcaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtgcgctcctcctcctctcagatcccccaccctgtaggctgagctgggacgtgcaggcctttttgttttttgagacaagtctcgctctgtcacccagggtggagcgcagtggcgcgatctcggctccctgcaacctccgcctcccggattgaagcgattctcctggctcagcctccccagtagctgggattacaggcatctgccaccacacccagctaatttttgtattttagtagagacagggtttcaccatgttggccaggctggccttgaactcctgacctcaggtgatccacccacctcggcctcccaaagtgctgggattacaggcgtgagccaccgcgcccggccatgcaggctttgttctgagggtctcctttcttcctcagtctgggccatgaggcaggaggctgtctgggtgtggtggggatgggtgcccaggagccagatgagttgttctagagtgaataccctgggaacaaatggtctgaaaagatgcaggaggggctgggcgcggtggctcacgcctgtaatcccaacactttgggaggccgaggcgggcagatcatgaggtcaggagatggagaccatcctggctaacacggtgaaacccccgtctctgctaaaaatacaaaaaaattagctgggcgtagtggcgggcacctgtagtcccagctactcgggaggctgasgcaggagaatggcgtgarcccgggaggcggtggagcttgcagtgagcggaggtcgtgccactgcactccagcctgggcgacagagcgagactccgtctaaaaaaaaaaaaagatccaggaggaggttcctaggagaattgcaggggttggggaaaacacaagcccagatttcaaaaatgctacgggaaagagacctyagatcaattggatgccagctagcattccctggggtcttggcctccaccgctgtctcatccttgaatggattctgggtgggacrggcaacgggctgggggtgcagagcccaagctggtccccatcgacgtgacccctgccctctgccccaagctggtccccgtcgacgtgacccctgccctctgctgggtttcaggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtcacccttggttgtccagcaggctgggcctgaggctgggaggtggggaagggagtggacaggctgtggagcaggcacagggatgggtggaggctgtctcgccttccttgcctccacgtcccctaggcaggcaactgcaaaaggtcccatgatcccccatcctacctggcaggaggactgaggctccaggctctttgaggtttagtaattcagtgaaaatatactgggcatttgctgtgttccagatactgttctaagcactagggtttttgtggagcatgagggaggccaggtctctgctcttaggaaggaggatacacagtgcaacagtgaatggacatcaacacaggaattccagacgctgggaagcgctgtggagggaaagctgaaaaagaaggtgattttggccgggagcggtggctcacgcctgtaatcccagcactttgggwggcccaggcaggtggatcataaggtcaggagtttgagaccagcctggccaagatttgaaaccccgtttctactaaaaatacaaaaattagccaggcgtggtggcaggtgcctgtaatcccagctactccagaggctgaggcaggagaatcacttgaacccaggagggaaaggttgcagtgagctgtgattttgaggtcaggagttcgagaccagcctgaccaacatagcaaagccccgtctctactaaaaatacaaaaattagccagccatggtggcgggygcctgtaatcccagatactctggaggctgaggcaggagaatcacttgaacccgggagacggaggctgcagtgggctgagatcgcaccactgcactccagcctgggagacagattgagactccgactcagaaaaaacaaaggctggccttgaactcctgacctcaggtcatctgcccacctcggcctccctaagtgctgggattacgggcatgagccaccaggcctggccttatttaggcattttagagtggtaagggagaattctgtgaggagggggcattgaattgagactcaggtgaccgttgttgataagggtttattacaagggcccatggactttggggcagcacagggaccaccccacggccatgtagccactcagggtctctgcagcccccagcctgggagattccacggggcgctcacacagtgctccttagaaaggaggatctgattggattggatttctcagcatcttgcgtggaacattctgattggataaacttcttttttttttttttgagacagagtcttgctctgtcacccaggctggagtgcagtggcacgatctcggctcactgcagcctctgcctcctgggttcaagccactctcctgcctcaacctctcgagtagctggaactacaggcatgcaccaccacgcctggctaattttgttcgtttgtttgtttgtttttgagacggagtttctctctatcgcccagactggagtgcagtggtrcaatctcggttcactgcaatctctacctcccgggttcaagggattctcctgcctcagcctcccgagtagcttggamtacaggcgcccgccaccatgcccagctaatttttgtatttttagtagagacggggtttcaccatattggccaggatggtctcaatctcctgacctcgtgatccgcctgcctcagcctcccaacgtgctgggattacaggtgtgagccaccgcgcccggccaatttttgtattttttttttttagtagagacaggtttcaccatgttggccaggctgatctcaaactcctgacctcaagtgatccgcccgccttggcctcccaaagtgctgggattataggcaggagccactgcgcccagctctgattggataaaattccgtgccaggctgtctcaggtgtggcctctcttgcttctagcctaaatgtggtccccttggcctgggtattgatccccgggccagacagctgtggctgagatggctgtatttgttagcttcccaaggcaagtgtgacacagagcacagccrcttctgcagggaggagccagaagccacttgggcagccctcctgggagggggctgtgggtgaggctggcccgggaacgcgtcctggcttccctgcagctcattctgaaaggccagtctgatccacctccccgaggctcccctttcctgcttcccctttcctccaggctgtgtcctgcgtactcttccttcatccttcgtctcctttccttaggccccgtcagcctttcttgtcctcaggccctctgcagacaggcccaaacagccagaacccggggcttatcctcccacgggcaggggttctccacacgggtactctgcctggaacccaaggagtcacagctgcaggaggccctcgagccctgtggtgtccacactgcttttgctgcagaatcccttcaaatcaaatcttaatggctgggcacggtggctcacgcctgtaatcccagcactgtgggaggctgaggcaggtggatcacctgaggtctggagtttgagaccagcctggcccacatggtgaaaccccgtctctactaaaaatacatcaattggccaggtgagatggtgagcgcctgtagtcccagctactcgggaggctgaggcaggagaatcacttgaacccgggtggcagaggttgcagtgagccaagatcatgccactgcactccagcctggacaataagagtgaaactctgtcttgaaaaaaaaaaaaaaagaggctgggtgtggtttacaggctcatgcctgtaatcccagcactttgggaggccaaggcaggtggatcacgaggtcaggagattgagaccatcctggctaacacggtgaaaccccatctcttctaaaaatacaaaaaattagccgggcgtagtggcgggcacctgtaatcccagctactcgggaggctgaggcagaagaatggcgtgaatccacgaggcggaggttgcggtgagccgagattgcgccactgcactccagcctgggcgacagtgcgagactccaactcaaaagaaaagaaaaaaaaagaaatcttaagccaaatcacaatatatttacacagctggcaaagtcacaagagggaggtgwgggagggtggggcgggcagcactcggcagtggctcacccacagaacccagctgtggtatgacagccagtgaccctgtctgtggtacatctggagaagctgagacaaagacaggcgattccttacgccgggtcacacggccagctggtagccggtgaagagagaaaaccaccaggtattattgagcaccgtctgtgacagcggacactgctacaatgttgttttttttctttttttgagacggatttttactcctgtcccccaggctggagtgcagtggcttgatcttggctcatggcaacctctgcctcccgggttcaagcaattctcctgcctcagcctcccgagttgctgcgattacaagckcccgtcaccacagaagcccagctcatttttgtatttttagtagagatgaggttttgccatgttggtcaggctggtcttgaactcctgacctcaggtgatctgcctgcctcggcctcccaaagtgctaggattacaggcgtgagcccccatgcccggccacactgctagaaactttaaaagcatctcattcggttacgtgtccgcctgcagtgggacaggtagtatgactccaccccactgtgaggaagtggaggagcagtggggtcagtcacacgcctggcaggatggccaggagccccattgtctgccttaggagcacctgctggccccacccccacttagcttcggggctttctgtcctcatgctcttcccttcccttttctgtaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggtaaggaggagggtgcgggcgagcccccgaggtcaggctgggcagggcgggtaaggaggaagcgtctggctggcagtggagctgagtcagagctgtcctgtgtcctgctcttttccagggcttcgggagcrgggagagggttgaatatgagcccccagaccctctgtcctagaggaagttggggtggcccggggaatggggctctgctttgctgcccaagacctcgcattgcaaggagagtctgggtagagagcctgggatggcatgtgagcctcgctggcttccctggaaggggaaggaggagaagctggggtgtcacactgttaaagaaatgctgggtggagtggctcatgcctgtaatcccagcacgttgggaagctgaagtgggtggattgcttgagcccgggagtccgacaccagcctgtgcaacacattgaaactccgtccctacaaaaaatacaaaaattagccaggtgtggtgcatgctactggggaggttgaggtgggaggccctcttgaccccaggtggctgaggctgcagtgagccataattgtgccactgcactccagcctcagcaaaagaactaagaccttgtctcaaaaataaaaataaaggccgggcatggtggctcacgtctgtaatcctagcactttgggaggccaaagagggtggatcacctgaggtcatgagtttgagaccagcctggccaacatggccaaacccrtctccactaaaaatacaaaaattagccgggcgtggtggcgcatgcccataatcccagctacttgggaggctgaggcaggagaattgcttgaacctgggaggaggaggttgcagtgagccgagatcacgccactgtactccagcctggatgacagagtgagactccatctcaaaaaaaaattataataactaaaataaataaataaagcatctatccttcagccatttgctaagcagctgctgtattccaggcactgtaccaggyaccgggagcccaccatgtacaaacagctgagtctaatggggtgggcagacgagcaatcacatacttactacagcataagcgataagacagagagggcttctctccagctcacctgggagaacactgaaaatgtaccttggttggactttagagctggggatcagggaaggcttcctggaggaggtggtgtttaagctgagtcttggaaaccggataggaatgaagcaggtatctgtgagttcaagctgttccctggccaggatctcagacaccctcccaagcagctccaggagcctgtgaggccaagggcagctctgaccagccatctctggccctgggcaggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcrtgaaccgccccttcctcttcttcatcttcgaggacaccacaggccttcccctcttcgtgggcagcgtgargaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaacckgctttgtggcactggggcaggggccgggggcagtctgagagaggccattctttcccaacacctcttggggagtttagggtggsggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggcctggctggtttgatgtcaccgttctgggcatgggtggggacaagtgaggatggtggggaaggcagggaggcggccgcagggtggactgtgctgaggaaccctgggcccagcaggggtggcagcccgcgcagtgccacgtttggcctctggccgctcgccaggcatcctccaccccgtggtcccctctgacctcgccagccctcccccgggacacctccacgccagcctggctctgctcctggcttcttcttctctctatgcctcaggcagccggcaacagggcggctcagaacagcgccagcctcctggtttgggagaagaactggcaattagggagtttgtggagcttctaattacacaccagcccctctgccaggagctggtgcccgccagccgggggcaggctgcygggagtacccagctccagctggagacagtcagtgcctgaggatttgggggaagcaggtggggaaaccttggcacagggctgacaccttcctctgtgccagagcccaggagctggggcagcgtgggtgaccatgtgggtgggcacgcttccctgctgggggtgcagggggtccacgtggcagcggccacctggagccctaatgtgcagcggttaagagcaagcccctggaagtcagagaggcctggcatggagtcttgcttcttgcaaacgagccgtgtggagagagagatagtaaatcaacaaagggaaatacatggtctgtccgaggatgagctgccggagagcaatggtgaaagtgaagtgggggagggggcggggctgggaggaaaagccttgtgagaaggtgacacgagagcacggccttgaaggggaagaaggagggcactatggaggtcccggcgaagcgtggcctggccgaggaacggcatgtgcagaggtcctgccgaggagctcaagacaagtaggggacggtggggctggagtggagagagtgagtgggaggaggagtaggagtcagagaggagctcaggacagatcctttaggctctagggacacgataaacacagtgttttttgtcttgtcaagtgtgtcctttttatttttttgaaagagtctcgctctgtagcccaggctggagtgcagcggtgcgacctcggctcactgcaacctctgcctcccgggtccaagcaattctcctgcctcagcctcccgagtagctgggattacaggcacccgccaccacgcactgctaatttttgtattttagtagagaccgggttttgccatgttggtcaggctggtctcgaactcctgacctcaggtgatccgcccgcctcggcctcccagagtggtgtgagccactatgccctgcagcacttgtcaagtctttctcagcgttcccctcctctccactgcagctcccagtgccccagtctgggcctcgtcttcacttcctgggatccctgacattgcctgctaggctctccctgtctctggtctggctgccttcactgtaacctccacccagcaggtacctcttcagcacctcccatgaacccagcagaataccaagccctggggatgcagcaacgaacaggtagacgctgcactccagcctgggcgacagagcaagactccgcctgaagaaaaaaaaaaggaccaggccgggcgcggtggctcacgcctgtaatcccagcactttgggaggccgaggtgggtggatcatgaggtcaggagttcaagaccagcctggccaaaatggtgaaaccccgtctctactgaaaaatacaaaaattagctgggtgcagtggcgggcgcctgtagtctcagctactcaggaggctgaggcaggataattgcttgaccccaggaggcagaggttgcagtgaaccgagatcacgccactgcactccagcctgggcgacagagcaagactctgcctcaaaaaaaagaataaaaataaaaaaaaggaccagatacagaaaacagaaggagacgtactatgaaggaaattggagagcttttgggatactgagtaactcagggtggcctttcccaggggacatttagctgagagatagacggtatgaagacctgaccgttcagaaacaggggaagaggcagcagcccgggcaaaggcctttggggcaggaaagggcttggatcactggagaagcagaaagatggccagtgtgaccagagtgtgacaaagtcagagaaaaccaggaagatggagctggagacacaggcggggccagatcacgagggtcctygcagaccagagcaagggtttggattttattccaagtatgaagggaagctgctgaagtgtgttttcctttacaatttgtagttgaaatataatatgcaaagtacacaagtcttaactatatgtaagcttaatgaatgtttccatgaaccaaataccgctgtgcaaccatcaccagctcaagagacgaacccttctccctcctcctgactgccagtaacatagtggttcagctcaagaaacagaactcttctgacttcccctaacatagcgggttttcttttttgttttgttttttgttgttttttaagagacaatgtctttattatttttatttttttttatttttgagacggagtcttgctgtcgcccaggctggagtgcagtggtgcgatctcggctcactgcaggctctgccccccggggttcatgccattctcctgcctcagcctccctagcagctgggactacaggtgcccgccacctcgcccggctatttttttgtatttttagtggagacggggtttcaccgtgttagccaggatggtctcgatctcctgacctcgtgatccgcccacctcggcctcccaaagtgctgggattacaggcatgagccaccgcgcccagccaagagacacggtcttgctctgtcgcccaggctggatggagtgccgtggtgcgatcacagctcgcggcagccttgacatcctgggctcaagcaaccttcctgccttggcctcccaaatgttgggattataggcatgagccactgtgcttggcatctattcatctttaatgtcaagcaggcaattgaatatttgatcagggatagaattgtctatttgggggtatgcagnnnnnnnnnnnnnnnnnnnnctggagtgcagtggtgcgatctcggctcactgcaggctctggcccccggggttcatgccattctcctgcctcagcctccctagcagctgggactacaggtgcccgccacctcgcccggctatttttttgtatttttagtggagacggggtttcaccgtgttagccaggatggtctcgatctcctgacctcgtgatccgcccacctcggcctcccaaagtgctgggattacaggcatgagccaccgcgcccagccaagagacacggtcttgctctgtcgcccaggctggatggagtgccgtggtgcgatcacagctcgcggcagccttgacatcctgggctcaagcaaccttcctgccttggcctccattggattaagataccctgcttggatattcatcaagggatatagagatgtgcttcatgtcatggaactgggccgggcgcggtggctcatgcctataatcccagcactttgggaggccgaggcaggcggatcataaggtcaggagatcgagaccatccgggccaacacggtgaaaccccgtctctactaaaaatacaaaaattaggcaggtgtggtggtgcgtgcctgtagtcccagctactcagggaggctgagacaggagaattgattgaacctgggaggcagaggttgtagtgagccaagatcgcgccactgcactccagcctgggcgacatgagcgagactccgtctcaaaaataaacaaaaaaaagtcatggaattgatggaaattgcctaaggggagatgtagaagaaaaggggtctcaggatcaagccagcagagaaggcagaaaaggtaaggtgtgtgaggtggcagaaaaagggaagagtgtggacagtgagggtttcaaggaggaggaactgtctactgcctcctgccaaggacggaggtgtccactgccagttgacataaggtcacccatgaacttggtgacaggaatttcagtggagaagtggccacagacacaagtctagaattgaaatgggagccgaggcagcgtagacaaaagaggaaactgctccttccagagcggctctgagcgagcaccgagaaatgggcagtggctttaggggatgtagcgtcaaggaagtgtcttttaaagaagtcgggggccgggcacggtggctcacgcctgtagtcccagcactttgggaggccgaggcaggcagatcacttgaggtcaggagttcgagaccagcctggctaacacgatgaaaccccgtctctactaaaaatacaaaaaattagctgggcacggtggctcgtgcctgtaatcccagcactttgggaggcagaggtgggcagatcacttgaggtcaggagtttgagaccagcctagccaacatggtgaaaccccatctctactaaaactacaaaaattagccgggagtggtggcacgtgcctgtaatcccagccagtcaggaggctgaggcaggagaatcactggaatcctggaggtggaggtggcagtgagccgagatggtacctctgtactccagcctgggggacagagtgagactccgtctcaaaaaaaaaagaaggtggggaaggatctttgagggccggacacgctgaccctgcaggagaggacacattcttctaacaggggtcggacaaaagagaactcttctgtataatttatgattttaagatttttatttattattattttttatagaggcaagcatttttcaccacgtcacccaggctggtctccaactcctgggctcaagtgtgctgggattatagccatgagtcaccacacctggcccagaaactttactaaggacttatttaaatgatttgcttatttgtgaataggtattttgttcacgtggttcacaactcaaaagcaacaaaaagcacccagtgaaaagccttcctctcattctgatttccagtcactggattctactcttgggatgcagtgtttttcatctcttttttgtatccttttggaaatagtattctgctttaaaaagcaaatacaggccaggtatggtggctcactcctgtaatcccagcactttgggaggccgaggcaggtgatcacctaaggtcaggagttcaagaccagcctggccaatatggtgaaaccctgtctgtaccaaaacacaaaaacaaaaacaaaaacaaaaattagccgggcgtggtggcgtgctcctgtaatcccagctactcaggaggctgaggcaggagaatcgcttgaacctgggaggcagaggttgcagtgagccgagattgtgccactgtactccagcctgggccacagagcaaggttccatctcaaacaaaacaaaacaaaacaaacaaaaaaacaaaacaaaagctaatacaaacacatatacaatagacaaaactgtaaatattttattatttttattttttttagtagagacagggtttcaccatgttggccaggatggtctcaaactcctgacctcaggtgatccacccacctcagcctcccgatagttaggattacaggcatgagccaccacacccggcctaaaattgtaaacgttttagaagaaagtatagatgaatcccttcgtgatctcggggaagaagagattttttaaaaaagataccaaaagaagcacaaattataaaagaaaagattgaaaatgttggtgttaaaattaaaaacttgttttaaaacaagcttgtgtaacccatgacccacaggctgcatgtggcccagaaaagctttgactgcagcccaacacaaattcgtaaactttcctaaaacattatgagattttttttgagattttgttttgttttgttttttgtttttttagctcattcggtatcattaatgttagcatattttacgtggggcccaagacaattcttcttccaatgtgtctcaggggagccaaaagattggacacccctgccataaacatgaaaagacaatggccgggcacggtggctcacgcctgtaatcccagcactttgggaggctgaggggggcgggatcacctgaggtcaggagtttgagacaagcgtgaccaatgtggtgaaaccctgtctctactaaaaatacaaaaattagccgggcatgctcgtgcacacctatagtcccaactactcagcagggtgaggcaggagaacctcttgaacccgggaagcggaggttgcagtgagccgacattgcacccctgcactccagcctgggtgacagagtgagtctccactggaaaaaaaaaaaaaagaacagtgtgatacattgacctaaggtttaagaacatgcaaactgatactatatatcacttagggacaaaaacttacatggtaaaagtaaaaagaaatgtacgaaaataataaaaatcaaattcaagatggtggttatggtgacgggaaagaactgaggcggaaatataaggttgtc

SEQ ID NO: 1680 - DNA, 15421 bp, Homo sapiens
aggagtttgagaccagcctgggcaacatagaaagaccctgtctctaccaaaaacaaaaacaaaaacaaaagataagaaggaaattatctaatccaacacccttactttttcttttcttttttttcttgacaggatctcactctgtcacccaggctggagtgcagtggcgcaatctcagctcgctgcaacctccacctcctgggttcaactgattctcatgtctcagcctcccaagtagctgggattacagacatgtacaaccacacctggctctttttttttttttttttttttgtatttttagtagagacagagttttaccatgttggccaggcggtcttgaactcctgacctcaaacgattcgcctgccttggcctcccaaagtgctgagattacaggcgtgagccaccgcccctggccagccaacactctcattttcagaggacttacctgaggcccagcgaagggaaggacttgctcaggaacatatcaattcagacctaggactttattttgagtctcctgatgccccagccctcacttttccctatgcacctggcacctttacagagtggaactgtgctgcactcttgtgataactactcacccagctcccagttcttctgtggtctgagaggctgtgggtctggtgaaatgggcagatattttagaattacacaggtctggattcaaatcccagctccaaaggaggggaagattgtatatatattgcaaacatgtctatataatatacatgcaaatgcctgtatatgcagagactctctctggaaggatatacaagaaacttgttatagtggtttatctccagagagggggtctggttgagaagaacttttaaaaaatttttaatttaattttaaaaaattgagacagggctctcactatgctgcccaggctggtctcaatcaaactcctgggctcaagtaatccttctgtctcagcctcctaaagttctgagattacaggcatgagccaccatgcctggctgagaataacttttaactgtataccttttgtgtgcttttccacttttttgaatttatgtgcaatggctttcgtgattttttttttttttttttttagatggagtctcactcttgcccaggctggagtgcagcggcacgatctcggctcactgcaacctccacctccctggttcaaacaattcccctgcctcagcctccagagtagctgggattacaggcacacgtcatcaagcccggctaattttttgtatttttagtagagacggggtttcaccatgttggccagagtggtctcgaactcctgacctcaggcaatctgcccgcctgggcctcccaaagtgctgggattacaggcatgagacactgctcctggccgcctttctgtgatttcaaaaacctgtctcctccatttattcattgaatattcctgggaaagccatttaactactctgaggatagcttcattaagatcccctgaagggggtggactgtgaatatagagggctagcagtcatatggggacctcactgggtgttgtggggccagatttgaagagccatattctgttggacttctggtagttggaagtcaggaaaactgtgacctaggctccttgacaatgggtgcaatagcatcctgagaagaagaaagcaagagggaagtggcaaaaaggggtaggcacactgatggaattgtttttttttttttttttttttttttgacaaggtctggctctgtcactgaggctggaaagcagtggcatgatctcagctcattgtgacctccgcctcctgggctcaagccatcctcccacctcagcctcctgagtagctgggactgtgcatgccatcacgcccggctaatctgtatattttttgtagagatgggtttttgccatgttgcccaggctggtcttgaactcctggcctcaagtgatccacccacctcagcttcccaaagtgctggaattacaggcatgaaccaccatgcttgcccagaagagccttctttgagatgaggcagtgggggcttggttggtgaaggagaaaaacatttcataaattcgcagtgtgtcactccccttctcttctttccagccccattctcatgcagcctacaaggggtgcagggaccctccccttcttttttcttttgagatggagtctcactctgttgccaaggctggagtgcagtggcgcgctctcagctcactgcagcctctgcctgccgagttccagcaattctcctgcctcagcctccagagtagctggggttacaggcacacaccacgcaccaccaccatgcctggctaatttttgtgtttcacttgacctcaggtgatctgcctgccttggcctcccaaagtgctaggattatagacagtgcctttttttttttttttttttttgagacgagtcttgctctgtcatccagcgtggggtggagtgcaatggcacaatctcggctccctgcaacctccacctcccgggttctgtgcgattcttccacctcagtctccccagtagctgggattacagatgcccgccaccatgcccagctaatttttgtattttttttttttttttagtagagacagggtttcaccatgttggccaggctggtctcgaacccctgacctcaggtgatccacccgcctgggcctcccaaagtgctgggattacaggcgtgagccacggcgcctggcggggatcctgcctttctttggaagtattgtgatagcaaccacgcacgttgtgctctgtccttggtcctgaagagaccagcgtgcgtttcttgagaccagggacactggttagtgactcttctctcggtaactctgaaccaggtgagaattgccatttttaaccttgagatatagcagtactgtttgcatcttgcaaccctcctctccttgggctgctggctgtactcactctccagggattgtagttatagctcctgactccacatagcaagcctgcagggcacacctaccagccttgaccccaccacacccagtgagcacatattttatttgctaccccctccaaattcatggcctatccccatcatggcaacggatgtcagatgggaggttaatggcttgccaaataagcagaaccctatcttggtctcccaacctaaattgcttcattcatgcatttttgacagttgtatctttccaccaatcaccaggtaatttttttcttttcgaaaatggcaaggaaaacacccccaacccactcccttcacacttgtgagagctgcatgagctgaaagtgactcttccaaaaactcttctaagcttgagaagctggagacttcagcatgagactggagtgtgacagcttggtctgctctggcatcagaagggagggaaagtgagtccttggaggtcttcatactccaggagagatcccaagagacatgcaagagtggcaaccaggcctctgtttgaccctcttgcggcatcttggtgctaagtggggtgaagggagagaacacacactctgcctggtccccgccgggctctgcaccccggtgtcctcttcccccacccatgcctcccagcagaaaactgtttcccatcagcagctgcagaatgagatcatgtctggcctgttgcaagaaccagaatgaaggatggagcagaagttggattggggcggcaagaagggagtaagcagcctcaggccagcacgccttacagcctggggaggagggaaaggagaggtctccctccctcttttctgagcgttgtgtttcccttcttctctcattgggagagggatgggatgatggcgagagaaggtgtcatagacgggaacccaagccggtgggaaggagagctgtgggcttggggggcgggggagagggagaattggcaataggatgccatctccatccatagagccagggacggactcctgtcctgtaactccattcctcaccccactagccctgggagcaaatcttagttcactgtgatccactgagcaagtcactaaactttcccaaggctcagtttccttatctgtgaaacagacaggctgacccctaacagagatgtagtgcaggcagtcagagaggtgagggaggcaaaggcacggcgcaaggcacacgggaacgcaggcgcttaactgtccacaccacgcggcgctctcccaaccccggcctggcgcgctcaccggttctcagccaccaggatctgctccagcaggcgcgcggcctgcacacgcgtctccaactccggcgcctgcagcagccgcaacagcaggtcgaggccgccatcgaggcggatggcgtcgcacagaccctgggctacctcgcggcccacggccgcagcagccaggcctcctccaccagttggaagacctcggccaggccggcgcccacggcccgcgcgccgcccgcctgcttcagcgcggacaaggcctgctgcagctccggcagcgcgcgctccagggcgtcctgcacctcggtgcctgcccccggcgacactttcgcgggcccgggccacccgcagcccaccatgggcccgtgccaccgcccccatctggcccaggcaccgccagccgctcggcgcccsgccgtgggcccgacatggcgaagaagcgacacagcttgtaggcggagagaagcagcgtcaggaccatgggcgcggggccgcgggggacatccccggcctggaggcggggccacgcggagagacccgggttttgggaaaagagggacccgagaggggtcggggaaagaagatggagggggaggaatggagagaagggtaccaggcaagggtgccggtcagaagtttgggggaggagtgtcggcaggatcgggggagcggttggcaaaggtgatgcaggcccagatgcagggagtgggcgaaaggagagagcgagcaggcgagggatggctccggacgccgtagggtagaggaggcggcggctggaacaaagcgtggcctgggcacgggctcggctgagctgggagatgctcggcagcagccacgccccggaggagcagcggtccccgggccgacgccccgcctctgggtcccgcggggctcctccagcctcctgcagccacgccccggaggagcagyggtccccgggccgacgccccgcctctgggtcccgcggggctcctccagcctcctgcgcagccccacccccaagccgtccccagccacgcccacgcccctggccagccttccctagcccctcagtcagtcgcagccacctccccctgcgctggacttggaggaagggggtggagaatgagaggacgctctccgttctccgccccgcctccccgccccacgtgacatcggtacgtgggagcaacaccgctggatgccccctccctactaaatggttaaaacaatcatcataactcttaaggcccttttatggctgtttcttagcgaaacctcacaacatgcctatggggtgggaattgatgttccattccacagctgactccactgaagcccatgaggaagaaattggcccaaatcacagtcccctctgattacagaacagaaaaagtcagctaaaatctcaggatcacttttttcaggtgatgggaggatttcagaagttctgtggacacctgaaattgggcacaaaatcaggtgtttcatgccagtgggcattttccaggtagagggatcatatttctctcgagagtctaaaagtgtgttgaacaagcccactctttacagatggggagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagasataaagctgttgcccaatgagccttctttctgccctccagayccacggtgctaattccccttccgatgacctaatgattctgagcttggcaaaggtcttatctcccagctckcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaaggtacaggggagtgttggtggccatctgggtcaatgtagggagggcgagggtggtctgggcttggtggcaccgactgacactccttcctcatagagtcatgcaagggccgctgcactgagggcttcaacgtggacaagaagtgccagtgtgacgagctctgctcttactaccagagctgctgcacagactatacggctgagtgcaagccccaaggtgtgttcagagcccaggtgggtgggctggggtgccccctgctgctggagactcactaccatccactctctgcagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagagkcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaayggttccctctttgccttccgaggtgaatccagggcaggtactggggatgcgggtctgccccaggagcrtcccygctctcacaccatctcctccactctagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaaggtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacctggacctgggaacggctgccttagggcaagggactctgcctctgtgcccagccagcggcctccataycccttttcactttccccacctcttagggtagtcagtactggcgctttgaggatggtgtcctggaccctgattacccccgaaatatctctgacggcttcgatggcatcccggacaacgtggatgcagccttggccctccctgcccatagctacagtggccrggagcgggtctacttcttcaagggtactcagggggyggtgggagactgagcaggcagtggagcagtcttggattcctttcacayttcactggggacaggcctcagcatgtgcccacccctgacccccacctcatgctgggagatcctaacttcaacagcctctgggatctccagtcttgccctggcccagccctcctaatgcccaccacccygctcctcagggaaacagtactgggagtaccagttccagcaccagcccagtcaggaggagtgtgaaggcagctcyctgtcggctgtgtttgaacactttgccatgatgcagcgggacagctgggaggacatcttcgagcttctcttctggggcagaacctctggtatggagagagggcaagtcttgcttctccctcaaaagggctgaaaccccttggtattggtagagccaggccggctggagggggctgtggttgtggagctatcgatcaaagtctgtttgctcaggccagactttgcttctgttgaccttttggggaaagctcagctctacctggaccccacaccttggactttgcctagcacagctgagagcacagccagcagagggaggggctgtggctgaggagtttagggggcctgggggggtggggtcgagacaccagtgatatggtggagggaaagcacagggggaagggaattggactgagagtcaaaggcctggctctgccattcgctgctgtgtgtctttgggcaaggtgcagcagatgaactctaatggccccgctggaaggggcaagattcggacccccaagacctctcattcaccccttccctgccacagctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaycagaactcccgccggccatcccgcgccaygtggctgtccttgttctccagtgaggagagcaacttgggagccaacaactatgatgactacaggatggactggcttgtgcctgccacctgtgaacccatccagagtgtcttcttcttctctggaggtaggagccgctgccacccctgaagctggtctagcttgggttttccttgctgtccctggtgcacaagggctgaaygcagcctgcaagtagtgaccacagaaagccaggccagaagtccttagctgcatcatggatgttcactttcccttctgggagagaccctagacttctcaagggaagagtgggcagggccaggctgggcctcacrcatcctctgctttcctctcttccagacaagtactaccgagtcaaycttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagyccaataaaggtcccttagccccgagtttaaaattattgttctgactggggtagacacatccctgtctgggtaaaggagaggaagctggactgtcagaatgggttggtgagggggacagagaagggacagagaagggcctcgccgtgtccaacccatgttgggctcaggacctctctgtgctcaggacctctctgtgaaccggtttggggctggggaaggcctcctgagagctacccttcctcttgagctaagcagcccccagcaacccaccagcagctaagcagacacttgaactcctctgatgatgacaaagttaccaggccagcctccgtgggtgaggcttgctttgccccttggagttgactagggtctyggaggagagagaaggggcaagagttggtggggttctggctcagcttttttgtccatcctgatctgaaatcctagtagctctgactcctgagcacttggggaaccagtcactgtgcttccccaaacccacccctagggtgagcctttcttgaggtctctgtctagggtctaggatggggagcagcaagaccaggagagatagtgaagggcagaaactgaaaggaaattcaaaagcacacacttcttgtggaaaagtggcccaggagcccaggagtttgaagctgcagtgagctattattgtaccactgcactccaacctggggaatagagtgagactctrtctctaaaaacagaacaaaataaaaaagggggggaatttttgtctgggcatggtggctcatgcctgtaattccagcactttgggaagccaaggtgggaggattgctggaatcccgaagtttgagaccagcctaggcaatatagcaagacaccatctctacaaaaataaataagttagctgggcaacttatgggtggtgtgtgcctgtagtcccagctatttaggaggctgaggtgggaggattgcttgagcttgggaggttgaggctgcagtgagcagaaatcacaccactgtactccagcctgggcaacagagtgagaaaaagaaaatttaggccaggcacggtggttcatgcctgtagtcccagcactttgggaaaccaaggcgcgtggatcatgaggttaggagttcgagaccagcctggccaacatggtgaaaccccgtctctactaaaaatacaaaaaattagccgggtgtggtggcaggcgcctgtaaccccagctactccggaggaagaggcaggaggtggagttgcttgaactcgggaggtggaggttgcagtgagccaagatcacgccactgcactccagcctgggtgacaaagcaagactccatcttgaaaaaaaaagaaaaaagaaaaaaattttcaaaatttaagaaaaagtggctcagaatatatccaaggaagagaatactgtacacataaacatctttatcatctttcttagaacccctcaactgcacctgtggaacctcctctggttccaggttccgaaccccaggaagtccatctggctcttgaggggccagagagagaaagggttagatgaggcaaagctctaaagcagacctgagggcaatctggtggtgacatctgttccccagtcctgctgacagcggctggctcccattcatcccgttgacaccctaccatccttctcatcctgtcccacttcaccagcccagtccccagttgtgggagaggactccactccctctcccctgaaggtagccaggttcagagcactaagggctccagaaggggcagccagtgcctgggagcactggagagatggttttctttggctgcctggaaggacccctgggaggattttcatgaagtataggatttcaggcacagactgccagtttgaggtttgagaagggatgctgggtccagcttcctttgcgaggccttggaggggcagggggtatacaatttgccccacccataccctcataagcccaacccggcctccagcctcccttcttccccaccgagacttctctgccttgcttgagctggactctaaacctctccactcctgaaggcggggccagccaccctgagcatgataaaacccaaatgggggggtctggtgtgggcacagccctggcatggccctctggcacggccctctggcaccttaccctttgccagctccatgcccagccctgtggatgcatcctcagcaggtgatctgatgggggaagtgtgggcagggtgagaacgcaggccatggtaggatgaggacggttggagaggggtgggagtagggacttcggggttgattgagggctttgaggctgggtggaggctcttgcagggagtcccagcttgacccccaccatggcctgcagacggtggcagcgggttgggttcccaccggagaaagcggaccaccttcagcaaagggcagctrctggagctggagagggcgtttgcagcatggccctaccccaacatcagcacccatgagcacctggcctgggtcacttgccttcctgaggccaaggtacaggtgagctgtgaccccttctcacacagccaacatctaggcttggcccacagccccttcgctgggtagcctgccttcaggttgtttcccctgtccctgggtggaggggatgctggggccagaacagaccccttcttctttcctagcaggtgtggttccagaagcgctgggccaaaataatcaagaacaggaagtcaggaattctaagccctgggtctgagtgcccccagagctcctgttctcttccagacaccctccagcagccctgggatccccaaatgccaggccaacctccaccctccagcggcacacctcagcgcacctcagtgtgtcgacatagctcctgtccagctcctggcttgagtccacggcagggctgggaaggggctaaagctgtagccccatggggatcagctggggcttcagaggtccacccttctttagagcgagctactccccagacttcactaggcagcctgtctgacctcatctatgcctyggccattgtcgtcaatgtggaccactcctagtctttgtccagaacttgcaaggcccctcctctgactcctgtggcccaccctgcccctcctgggattgaacacatcagaagtggattccctggccccactttttatgcaaagggattccctacgggaaaggagtttagctcaggcatccctcccttccactggcctccaggccagcctagatgcaggtcctaagcagactggggcctggctcctgccaccccacaccctgacccctttggggcatatgctcattgttgtggcaggtggtaccttcagaaggatgagatgagggtcatgttttcctccactcttgccaggcctggtccccagttctcaccagctgatggcctcctccttctgaaggggcaggctcctgtctcctgaggtctctccaggccattaccttgctaactgctaagtgaggtaggagaggagagtgctgctcctcatctagactgctggagagccaacttctttatgggtcagggccccctctcttgaccatcgaccacctggacaaattaatcagaactacggatgtgaagagggagtggcattaaagtaatgaagcaaagataggaagctggggcttatgttgatttaattttcacaaagatcagattggatgccctctgatgtggggctgtggagacaacctgacagatctgggatggaggcaggtatagcagcattgggttttggtatcaccatcacctgtaataccaactaatctccaaataaaacccaaactctgtaccttaatctggattgttgtgctctgcaaacgaacggggacgagggccgtttgccatggaaatttatctccatcacctaatccctaaatagggccaggttccacacagatacctcttggtgggaggtattacccaggcttcagctgggattagagggatagttaattgaagggtttaggactctgactgacaagaccctggggagatgagagcctctgctagcacccccagctcctggtcccactgaatctaggacattccagtcacctccacctctggagctgctctgctttggagagaaaaccatggtgtttgcggtctgcactggattcaaatcctgactttgcgatgtaactgtggcaactctggaactctatgtgactaaaaaatggggatacttatttgctctctgtttggggtataagaaataatgtaggtaaagggctttacatggtgtgtaacacatcgtaaaaactcagtaaacgctagttccctctccagacaggccctaagaaactgggaaggccctaaacttcttgttcttcccacctcctgccaagcagtccctggacccagagtgcattacagaaagcatggcacagtgaggcaggagtggctagcagatgagagagctcccttctatatgctgagaactggaggatagggcatttggttctcccctcccagtgccccctgctttttcattgagacaaggtctcactctgtcatccaggctagagtgcaatagcatgatcttggcttactcagcttactgcaacctctgcctcccaggctcaagtgatcctcccaccttagcctcctgagtagctgggactacaggcgtgcgctaccatgtcagctaatttctgcgtttttttgtagagatgggctttcgccatgttgcccaggctggtctcaaactcctgaactcaagcatcctcccaccttggtctcccaaagtgctgggattacaggcatgtaccaccacgcctggctaktttttttgtatttttagtaaagatggggtttcgctatattggccatgctggtcttaaactcccaacctcaagtgatccgcctgcctcagcctcccaaaatgctacgattacaggtgtgagccacctcacctggcccagtgtagctttttaacacaaattttatatagctcaggttactggaaacactgtaaaatgccacctactttttcttttcacagctgacacttctcccaactaacagaaactggcaaacattgtagaggaagtgtccactgagtgaatgagtatataatttatgaaaacagaaaagtgctttggaaaaaaaaaaaaagacaacaggagtacatacagtgaaccaaaaagagtgtaccaggaggagcagaccctgaacagttagaactatggaaatcgctatgctttgtgttgtcacaggagttaaaataggaataccctgcatacaataaatatttattggataaataactaagcctgatacccttttcaatgcgttatacagactctatcatcacaccactaatctaagttctcagaagttaaacattacaagacttcagaacaacataggcgtctttggctccatttaacagaagaaggaccatagtgatcatttaatctctatgagtctgtcttatcttctggaaaaggggcctaacaccatttccttttgcaaaaaggtagctgccttgcttccagttctaccatcctctagcaacccatctttctcttatttgatgtctctgatcagctcctcttccagcacaaactggagaaaggggatcctttctgttttcttggaggcttctgaactcaattacaggtctgcattaaaaatgtatggagaaagctggtgattagtttgtacatatggacaagttcaaggcagtatggtctacttctgggaaggcctggattccatttgctcctgatggaaaaaccctagtcccagcagtgtttagaatgaactggagaaggcagatgggtaccagattcaggaagaggtactgatagaccaagaccagttctttctgttttaaagatgtgttatctcaatctcctccaatgctccctttggaaattcacagaagattagggctccccacagaaacagcagctggcctgggctggtcttctgactaactggagctgaatacaaaaagtctgatgggttgactgagtcggtgactgccaattggagcctgaagcccccaaagtcttct

SEQ ID NO: 1681 - DNA, 154799 bp, Homo sapiens
ggaaatagagagaacacaataaatggatgctcatggataagaagaatcaatatcatgaaaatggctatactgcccaaagtaatttatagattcaatgctattcccatttaactaccattgacattcttcatagaattagaaaaaacttttaaaattcatatggaaccaaaaaagagcccgtatagccaagacaatcctcagcaaaaagaacaaagctggagacatcatgctacctcacttcagactatactacaaggttacagtaaccaaaacagcatggtactggtacaaaaacagacacggaccaacagaacagaagagagcattcagaaataagactggatacttacaaccatctgatctttgacatacatgacaaaaacaagcaaaggggaaagaattccttatttaataaaatgctgggagaactggctagccatatgcagaaaatcgacactggactccttccttacaacttatacaaaaattaactcaaggtggattaaagacttaaatgtagaacccaaaactatgaaaacccttgaagaaaatctaggcaataccattcaggacataggcacgggcaaatatttcatgccaaaaatgccaaaagcaattgcaacaaaagcaaaaattggcaaatgggatctaattaaacttaagagcttctgcacagcaaaataaactatcagagtgaacagacaacctacagaatgggagaaaatgtttgcaacctatacatctgataaaggtctaacatccagagtctacaaggaatttaaacaaatttacaagaaaaaacaatcccattaaaaagtgggcaaaggacacgaatggacatttctcaaaagaagacattcatgcggcaacaagcatatgaaaaaaggctcaacatcactgatcattagagaaatgcaaatcaaaaccacaatgaaataccatcttaggccagtcagaatggtgattattaaaaagtcaagaaacaacagatgctggagaggttgcagagaaataggaacacttttacactgttgctgggactgtaaattagttaaaccattgtggaagacagcgtggtgattcctctaagatctagaaccagaaataccatttgacccagcaatcccattactgggtatatgcccaaaggaatgtaaatcattctattataaagatacaggcatgtgtatcttcattgcagcactattcacaataggaaagacatgggaatcaacccaaatgcccatcaatgaaagactggataaagaaaatgtgatacatgcacaccatggaatactatgcagccagccataaaaagcaacaggatcatgtcctttgcaggcacatagatggagctggaagccattatcctcagcaaactaacacagaaacagaaaaccaaacaccgtatgttctcatatataagtaggagctgaacagtgagaacacatggacatggtgggtgagggggagagtatcaggaaaaatagctaatgcgtgctgggcataatacctaggtgatgggttaatctgtgcagaaaaccaccatgacacatgtctacctatgtcaccaatctgcacaccctgcacatgtaccctggaagttgaaggtgaaaaaaacggtgcaaaagattgaataggcatttcataaaaaatatactaagcaaaaggcacaggaaaaggacctcagaatcattagtcatcagggaaatagaaattaaagccacaatgagacactgctacattctcactaaaatgacagattaaaaagcccaaaaataccaaatgtttaggagatgtacagaaactggaactcttgtacattggtggtggaaattttaaatggtccattttggaaaacagtttggcagtttctcataaagacgtaaatgggagctttctttacaataacacaaaactggaaaaaacacaaatgtcttaaaagacacaaattttttatcccccccttttggggataaaaccaaaaaggaatgatctagaaatacacacaaagacatagatgacttttaaaaacatgctgaaggcagatacacaaaaaaatacgttctatgattctatttatatcgaattttagaacaggcaaaacttatctaaagacgtagttctcaactggggcaattatgccctccccttccctgggcaatgctggagacatttttggtggtcataactggggtggcataggtatgggggtggttgctaaaggcatctggtgggtagaggtcagggatgctgttaaacattttataatacacaggccagcagccacggcaaagcattaccaggcccaaaatgttgaaagtacccaggcccaggttgagaaattctgttctaagtgatcagtggtggtctagatggaagtaaggatattgaatgaaggaattctggggataataaaaatgttctgtattttattttatttacttttatttatttatttatttttgagatggagtcttgctctgtcgcccaggctggactgcagtggtgggatctcggctcactgtaacctctgcctcctgggttcaagcaattctcctgcctcagtctcccgtgtagctgggattacaggtgcccaccaccacgcctagctaatttttgtatttttagtagagaaggggtttcaccatgttggccaggctggtctcgaaatcctgacctcgtgatctggctgcctcatcctcccaaagtgttgggattacgggcgtgagccactgcaccctgccgatgttctgtattttaattgtggtagtgactgatttgtcaaaactcaccaaactgcacacacttaaaacgtgtaaattttactgtatgcaaattttacatccaagttgatgctaaaaagtatagtgcctgtataagactatgttaaacagtttaatccattttttgttttttaaaacacatgcacagaaaagacaggtaaggcaactaccattaaagacaggaaaagcaaataccattggtgggattatggataattttgaattttttgtcctgttgttcatttgcttagtattaagtaaaaatttaataaacttgatgtgtacacacacacatagagacaaacacaaacacttatatatccagtacctaaaacaggtacaaataaatgaggataatagaaaagcacaggtgcacatgaatatttaattgtgatatttgatcataagactctagttatttcaagaaagtataaaaatgtataatgcaaaggcacttagaagtaaggttttactctaaaacactgctaaactatttaatgagctcaattataattctttcaatacaaaaagtttgcaaggaggaattttcactagaaacaatgctatgatagccctaataagacagggtgaaaaggtcaagaaattctttaaaattaaatgaataaagttaccaactaaggaataatccatttcactgtattaatacggttgaaaacacagcagatacaattcagttatgttcatcaacagccagggactgagcaaagtgtgagaaatttattataaaaatgtctctgaagaactgaccaatggagaaaaatggtattgtcaacaatcacatacaaacgggctaaaggctatgatggaggtttgaaagtgttaacaatgaaagaaaccaagcaactacctaagcctggaggaagcatgtacaaaggtgacatcttagctagaccttgtctggtgaaaaatcatgagataatttagaaatcttagaaataacacaaaaaccaaaaaaaaaaaacaacaaaaaaaaaaaacaaaaaaagacccaccaccacacataacaattttgttacactactgtctcattttatagtcttaaaggtcagcaatgagaaaatcttttcccgaaaaagaagattatcctacatattgggtaaggaaattataactactgagaaaatcccatatccaagggggaaatatatttaagattcaccttgatagaaaatgcactccctaagcttccaccacgtctacgtttggcaatttaagtctctggcactattcaaaagcatagtgattaaaaaaaaatcaattaggctgcagtttaaaaattctatatgaatacttgttaatatagaattaatatatggcctcatactaaaacatctccatacattagtaagggaatatttaagatacctcccaaaagggagacactgggaatcctacatacagtacactacatctttgacagtaagttttcaagccataagagatgcttacgaatatatggggtaaacgattactctatgctgctaaaaatcattccaaggtaaaaaggtcaattcctatctaatgcaaagagaaaagcctgcaaggtggtgggatggtgagacagactgctggtagaacctgtctgccttgctccttggatttcctgtaattttggacattacttaaattaaggcattgaaactgaattacatcaactttatctcaacagaacaaattttgtgcagcagaaaacccaattttggcggtgaaaaagtcgtcccaaagacaaagggtcttaagtacatctgacttttcggagacagcagcagtgtgtcctattctttctctcctggctcagactcaaagaactactgcaggcaattcaggtaacactatttcctggtagtgtgattcaggtaactggagaaaaaggaaaatgcttaaagcaataaactagtataaaagggaaccttctggagtcccgtaatagccagtgaactagaaactcttgatattttatagatactgacaccagtaggggagccaggagccaagtgcaacaccagccaagggttggaagcaggcagagagaacagtcattgcctgatcctcttgcttccaccgcaaaagagcgcccccaccccaatactctcgttccttaaaatgtccctatcgggacccacgcagaaataccccctctcccctacagtaactccgtacaatcccaaataccctgccggagtgtgacaggctgcgtccacttactgagctgtcccccgcccgacgctgtactcggttcccgacctccagcgcccccaacgccggctgctccagggacccctggcgcccccatccccggcggggttccactttgcctctcgaagttgcctggattggagaagtagtcgcgcagccgaggcagctcccggccactctctaacagctcggtatgcagctccagggcggtcagcaagtattgatcgcgcaacagctgagcagcgatcgcatcaattgataatcgggccggggtctccccggtgccccccagggccactgcagccgccgacgcctccccagggagccctggccgcgcactgcttcctaaggccacgggatcctgtggcgacagcgagcccgcagagccaggatctaggccacttccggcgcccagccgaagtactgcccgccgttcctctgttgcagctacctcgtcatcgtcctcatccgaatcactgagaaatggattcacgccgccaccactgccactacctccaggcgccatcgccgccatcttatcctgtcaggagtgtgggcgcctccctgactggttccgacgggccgcagcccgaatcctctaggcctcaggggacacagcgcacctccacagccccggcctgaccacgtcctgcctcccgacttagagacaaggagtacgctccaaggcaggagatccggatgcagctgcacctgatgcctcagcctctgctgcaccagcagcccggctctgcaggcgtcttcctggtctccagtctcgcgagaactggagcgtgccctgcccctctccccgatctagccccgccccagccccgccccagcccacttcagctccgcccattcccagcgccagatagcaaagattgaaggccccgctctccgctcaaaagcaaaactccacccacgactcctccatgattggtcagagaaggaaggcgtggagcggactgacgggagactggcccgagaattatcgcgatagcagcagcggccgggcaggtrttgggggcgttccggaattgaggggtggttgtagtggtggcttaggaataccctcccggctatcgcttcagtgggtagaggggaccactgcccgagagctttaatggagctgggtcctgccttcgcgctgaggagcccycgttttcgagatcaggcctgaccgggataagctccaggtaaagttcagggaccagtgcgcggagggtgtcggcgcccaaactgtggtgtcgcgcccgcggacgcgctgtttccctactgcgctgcactttttctcgctatttgctgccagtggtgacattttgtccccatggatagcaagtgcccaggcctgtagtcggaatgtgacttcctttcttttcccttctctgccacatgcttgcacactcgggaggcctagcgacagcacgacttctcagccccggaggtggtcctgcctgtgggtggggacgggggctggagagactaaacggaaaagggaacgctgaggttggcatttgcctggatctgggaacatcgtcgagttggaaaacaaattgttaggtactcaataaacgcttaggatttaatacacgatttacacaacagggacccttcagaatatctaatgctgtctcaccagtagacagataagtaaacttaagccaagagtggttgttataaaatcagctccacgccgggcgcggtggctcacgcctgtaatcccagcactttgggaggccgagccgggcggatcacgaggtcgggagttcgagaccagcctgaccaacatggtgaaaccccttctctactaaaaacacaaaaattagttgggcgtggtggcgcaagcctgcaatcccagctactcaggaggctgaggcaggagaatcgcttgaaccccggaggcgaagattgcagtgagccgaggtcgcgccactgcactccagcctgggcgacagaacgagactccgtctcaaaaaaaaaaaaaaaaaaaaaaaaaaatcaattccgctaataaggagtcaaaggaattaacatcatttctcttatgtcccaaacgattctttatccactgtctcctgcaacatttctgactcgttcatgcaggctagaatcaaggttttggaacttagaactattttaaaagttgaatgcttcagagagttttgatttttttgatgaaatgttagcatataaagtacatatcctaagtttagaagatcaacgtttatcttttatgtcattccttgattatgatctgaaaaggtaaaggaatttccagtcaatacaattagactgctatttcttatggctcctatttttttcacacacaaatgaccacttttccaggctttagatttcctttcttagtgtacaggtaagtgacatattacattcagtgtgtagtaaacattccacagtaaagtatctcccgttagctccatggaaaaattaaaatagacgattcttacataaccttaggtcaggttattggtttacatgtaaaagtatgccaacagttaagagtaggctttaatttcaatatacccaggctcaataaactaaaattttcatttgaatggggatttgggtttttaaaattttatttttgctagaagtttaaaaaaaaagtaccaagaatttaaactatttttttataggacattagttcccaatgttttaatgataaatagttttctgtgccatatattaaaagtaaaacatggggaaaaaaatccccccaaatagaattgaaatggcaaatactgtatcctgttagagatttcttagcaaaagggattgctgatccgtattttagttggattttccagagagattaaaatggaaccaatttctggaatccaggaatggaggattagtgaatggcatgggaagggcatgattagaaatggattgtttatatacaatatttccatctccatgattgggaaattgagaaatctcctgcatttaggattcctgaagaggattatgcttataagatagaaaagcttaagttcagatcccaattctactcattatttattgtgagaccttgaaaaagttacctaacttctcagcctcacttgcattcgtctatcaaaggggataaggaaagtacacagaattgagaatgttcttgtcccagtgcctggtacctgctacacaataactrttactgtggtcacttattaattattgaaatattagtatgtgttgagaacatttgacaagtgtttaaaaataaaactaatatcaatcgttttggcagtgcaagcctgaaaaagcaattaagtcagtagggctgaagggagtatctttaatttggggtctcagttctaaaacacaagttgaaaatagatttaaaatgtttcctcagagttgtaagaacttgcatgtagaggaattcttcccatacaaatctgtggttttctgcttctatttctgcctcctatcctataaccatgaacttgtgtgtttgatcttgtaagcccattagaaatcaactgcccagtcttcccagtatgtacttttcttttccacaatacacagaggtttggttattcgtgaataatgtataagtaacacacactggaatattaaaaattaccgatcactacttataataatktattattaatagtgttgggaaatttcctttctacttagtaagattttcattaatctaggcccttacaactaatgtttcatctgactaatgatagttattaaagcttgtgccttagcaatgaagatgtaaaagatgccttttttcaaagcacgtcaatcattttagtatttaaaaaattattttaggttttaatagtcttaaaagaaccacaagtaatattctgaatgcaagttttggttgacttgaggttttagtaatacctcatgttttattgtttttcagtgtgtggtaaacatccacagataaactagataacttgtattggtacatgcatatatctttttaaaattttaatagttatgtgtttgttttggaggtatttctttttcaataaatctgaataaattgtgattttctttaaagagaagtattaagtaatatttagtattaagcaattaaactaattaaaataagtagttagtgaatgctgatattttgtaataactgcaattttatttacattaatagtaaattactttatcataaaaggtttagtttttttttttttaaagtattttcagtcttcacatcttgttctggaggaacaaaaacagaagcagggcatcctctagtggctgtagtgcatattgcatttacccttgaaatgataattctaaataatttattcagcaaacatttgagtccttactaagtgcataagactctgatgggtgttggagatgccccgtcctgctgtcatggaattgtggtgaagtgacagagacagacattaattcaaatagtcgtagacaaagctatgtaattacaaactgaagtaaaagttttcgtttctgacttcacctgcatagtccctgaggaagtgatgcttgaaatggaatgttaggagagagtggaagataggttgcaagtacattctgcagagaggaattgagcctacaaaggtcttatagcagtgggatacttgaataaaagaaggggccagtgatgtgagatgttacmaagtaaaggggagtgctatgagacaggtttagaaaagaaggcagaggctagtctataaaagaccttgttagtcacattaaggattttagtctagattagtaggtgaaaaggcactggagagttttttttttccagctgtgacttcatttttaaatttattttttaatatacgattttatgtattcattgtgtacatgatgttcttcagtttatatacattgtgaaatgctcaaatctagctaagtaacaaatgcattaccttacacatagttatcatttttgtgatgagaaatttgaacatctacccttttagcagttttcaagaatacaatatatcatcattaactagagtcaccatgctgtacaacagagctcttgaacttattccttctatctaactctaatatgaatgctttgatcagtatctctacaattgccccccgctgtggaactaccccagcctctggttaccaccattctgcttctaattcagtggggtcaactttcttaagttccacataggagtgaaatcatgcagtatttgtgtttctgcacctggcttatttcacttagcataccaggcttcaggaacatccgtgttgttgcaaacgtgtcttttgactttaaagacagtgaatgcttcacagaaggcactggagagttttatacaaggggtaagatgttcagattttcttttgaaaaaagaaaagcaagtaatactctggctacatggcaagaaatggatcagagaagggttagagtatataggggtgacctattcctgcattgcagtagttcgcataagagatggtatacatcttaaattatagaggtgtcaatggagattaagacaaatgaacagattcaagaaacacaaagtggacaattgttagattaaataaaggggaagaatagggtgtaaagaacaatgcctatttctcagacttacatacttggtgggaaggtggtgccacctactgagattgtgaacactaaggatttagtaggtagtagacaaggctcatgggaaatgttatgaatttggttttaaacctacttagttgagtgtctttgaaacgtccayktagatttataaaggttcgagttacatatgtggatttggagctataatttgttgaggcttttgcatattaggtaataactgaagccacagatatgatgaaacttgccaggatagaaagtatagagtgagaagaaaagacagctgaggaccaagttttgagtaactccaaaatttagtgatcagatagagactgttcaacattgrtcagaggtgtaggtgaaaaatgaaagcagtaatgttcatagaagccaagtgataacagcctattaaaaaggagaaggcagccgggcatggtggctcatgcctgtaatcccaccactttgggaggatgaggtaggtggatcacctgaggtcaggagtttgagaccagcctggccaacatggtgaaaccctgtctctactaaaaatacaaaattacctgggcatgatgctgtgtgcctgtaatcccagctacttgggaggctgaggcaggagaattgcttgaacccgggaggtggaggttgcagtgagccgagatckcgccactgcactccagcctgggcgatagatagggcgagactctgtctaaaaagaaataaaaataaaaaggagaaggcgactgggcccagcaactcacacctgtaatcccagcactttaggaggccgaggtgagtagatgacttgagcccaggagttcaagaccagcctgggcaacatggcaagacccccgctctacaaaaaatacaaaaattagctgaatgtggtaaacatgcacctgtggtccccgctacttgggaagctgaggtgggaggatgacttagcccaggaagcttaggttgcttagaaaatgaagactaaaaaatagctattagattttgcactgttaactgtctttactttcttatgaagtaatgacaataaggtttaagttgtttgagatttaggtggtcaggaaaaaaaagaggtcacattcagccttttcaagaagtttgactgtgttggggagaaaagggcaatagatgtttaaaattttttttattaatactgatatttatgagatgtatccttttcagaaatatggtatttcattatgaataaacaatttatctgttccctatggttagatattgtttccaattttttattattacaaatagcaaaagccaagatttgaatgtaaaggtttaaaaccttttwctttctgatgtgtaattttatcatagtaaattctacactagtagcagtactaatwcttgtgagctggttaaaaacataagctgatgtctacctcacaccatatacaaataattatttttgtttcagaggacacaaaccaacacaaataaattttaaataatgaaaggtaaaaaacaaaaatctaaaactattagaagaatatatgtgacataagaaccaggaaagttttcttctatagtacaagacacaaaaaactcacaccagaaaggataaatgtttgacaaattttactgtattaaagttgaaaaatttattttaacaaaaggccctatgaacaacatttatatataaatgtgtatatctagctatgtataaacatacacacactatataaacatacacacacatataattgtaatgtacaagtcaaataaaaggtcaataaccctaatcctatctgatcaaargatatgaataggcagttgaaaggaagagagacccaattggccaataaaaacatgaaaaaattttcatactcactagtaatcaggcaaatacatattcaaataacaggatgccaatttggcctgttcaaattgtcttaaggtaaatatgacagtatcaagcaattagggggatttagagatatagaagctttcgtacattgctggagagtatgtaaattagtatggacamtttgccagtcacttgtaaagttgaaaattttgtttattagagcaattccacttatagaggtggctttcaatcttattggtccatagaataatttaaaataaaactttcagtacaggttatgtacatgcaagaatattgatgcgtggatacacaggaaaaaaacacactttttcaaaataatcatgtactacttctgaagtactttgtgatgtgatatattctatattttatccratcctattgtactgtattctatttcattttttaaaaaaaggaaagaaggctaattgcagtccatgaaattattttgttatgggtcactactctacagtttgtaaaaattctaaaaatctccacctttaccataagagagcagcttaattgccatattatttgtaatcatgacaactgcgagtgatgttgatcagcaggatagtgttcaattaaattgtaatagagtcatataatagaatataggtcttgaatgtttgagatcatttataaggcttttttggtagtactgattagaataagcttataaaagaaataatggctttgcatctatactggtaaaaattaatttcaagtaaggtggggaaagcaggagtggaaatgatgatgattataatattaatgtaatcttgtagaatgacagatggcttttatttatgtatgtatttatttattttgagacagggtctcactttgtcacccaggctggagtgcagtggcgtgatctcagctcactggcagcctcgatctccggggttcaagcaatcctcctgcctcagccccacaagtagctgggactacaggcatgtgccaccatgcctgactaatttttttgcattttttgtagagatggggtttcaccacattgcccaggctggtctcaaactcctgagctcaagtgatccacctgccttggcctcataaagtgctaggattacaggtgtgagccatcaggcctgaccgacagatggcttttaattacacaattgactgggtttaacatatatactcttcatacagaagaacatcaatttatgtaggtgcctcgtcatctcaggaggtggagtgtaactcctcactctttaagtgttggctgcacgtagtgacttcctaccaaaaactatagtatgaaatgggggaacatttacatggagaaactttacagtgaactttacagaggacaaactgaacaaaccgcctcagccaagtggtcaagttttatattaacagtttagtaagtcatgttgacagtacccttaatrtgatgtgaagaaaatggtactttatgtatgtatgtttcctctcctgaacccataaccccagacttaccatgagaaaaacatcagataaatcccaatagcaagacattatacaaaatctctgaccagtactcctcaaaactcacaaggtcatcaaaacaagcaaagtctgagaaattatcacagccaagagaagcctaaggagatatggtgactagctgccctgtggtatcctggtagagtttctggaacagaaaaaggatgtgagatacagataaaagattttgaactcaagtgggcaggaatcatctaaagaactaataacctctagtctacttgccatgagaaaatttgaaaattagttctcatatgggattttgtaaagtcacatagagtttacaattaaaaatgacataaatcttgatgaaaaaatatataccccagaataataagcaaatgaactagtgctaattatatggcttaatagtttatctgataatcttgtgtgcaggctccmagtactatcttacagtttttctttcctcttcttctttttttttttttaagtgggtcttgctatgttcccaggctagccttgaattcctaggctcaagcaatcctctcgcctcaccctcctaagtagctgggactaccagctctgtcttacagttttggctggttttacttcacatcgtaggtttgtgtatttttagtaaatgttgaagtggttaagaacacaatctctaggtgacattaccgaaaatggcagagtacggtggtttattataagggttagttcctccactgaaacaagcataagggggcagagtgacaggatcaactgttttgggattctaaaatctggtctgacatttacagcaaccaggagactgcataatgaagaagagggcagctgaatttcagagtgctgtggcatttaatccactggattaccatcctcattcaccattgtggcaatggcagcagctgtggggactatggcccacatttctggtgtgacttgcttgtatttagtatggactttgttcttaaaatactgtggttgtgcattttgatctgtctagtggtttcctgagtgaccaatgtagaggctgaattttgtcccatctttatcccccgcaaaaattacatgtaatgcattcccagaaagatcctgagaggtgcctacgcttctacctttggaagatctgtgagcactagacaagcagaaggtgaaggctaaggcagaagtgtaggtggccaagcttagtgtgagagtacttcagctgagagccagactacaaaaacttgggagagtactatttgtttttgttttaggcatttaaggaaatctaaatctgccattggctgatcagtaagataacaaaacagagactttaatgaccataaacaaaaggaataaagtctttgcaaaaatagtttggaaaagttactaaacaaaaggctgaacccttcaaaaatcaaaagaaaatgccagaattctggaatctgatttctagaattactgcattataatattcgaaatataaatttcaacagaaagttacaaaaaagcatataaagactcaggaaaggatggcatattcacagaaaaaaataaacaaattggtggaagccacccttgaggaagtcctgacattggacttagtagacaaagacgttaatcatctgtcttaaatatgtcaaaatgctatgggaaaccatagacaaagaactaaaggaagtcaggaaagtgatgtatgaacgagataagagcatcaaaagagatataaattattagaatgaaccaaatagaaatactggagcttagcagtacaataattgaaacaaactgttcacaagagggattcagcagcaaatttgaacaggtggaagaaagagtcaatgaacctgaaaatggggcaattgcaattatagaagcagaaagaaaaagaaatgaagaaaagtgaacaaaaccatagggacctatgggacaccatctttaattcataagctttttaatatggtttatgccaatgtgaacattaaatcactgatagtctgtaagtttagcaaatcatgtttgacaagaacaaaggttacctgaaatcagagctatccataaaacttgcggtggtttataattacaacagtgtatcttttgagtatagattcagactccaatttttttttttttactttttatttaaaaataatgtttagatctgtggaaaagttgcaaaaacagtacagagttccagtacaccctttactcaacttcacctaatgtaaacatcttatgtaaacatcatataattatcaaaaccagtacattagtatttgtataatactattaactacagatcttagttgaagttaactagtttttccactattttctcatccggtttcccttgttgtgtttaggtaagtctctttaacctcctccattcttttacagagtacttgtccattattttgtaggctgtctcaatttgggtctatctgatatattaccattattagattgagattatacatttttaacaagaataccacatgttcttttgccaagactaccatgttttgcctttctcggtgcatctggtcagggttacatgatgttagtatgtcttactattggttgtgttaaccatgaccacttggttaaatggtgtctgactattttctccattgttagtatttttccctttgtaaggaataaatatttggagacgtttctttaagactgcaaatatcctgtttccctgaaactttgatccattgattttagcatttatcaatggatcttggtggcaataattactgtgatgtttgcctagttgtaattttatatctccctcattcctgctacctgaattaattgaaattattctgtaaaaaagagatatgggattctaaactcattaatatctcattgtattctggtagagataaggataataagtcattacttgttaaagcaattctctctaacataatgttagagaaaattatcaattatattctcacttgattttcctttctggaattttagatactcttttatagcctagttatatatctcattaaataagttatttaaaaataaaaattgcctgaaacttcttgttcatttcttaccttttctttatctgaaatttgagacaatagagcctgtacttcctaattggaaagattaattagctaatgatggttcctaagatacctagggggaattttagaagctttcaaggactttttattagctctcttcctgccatattccccaaaataagtaaaatttctctttgacttgatgctrcattaactgtactttttagtgaactrggggaaaataaataaagttcaaatatatactcattccaccaatgaatcataaagtgactgcactatgccgttaggtggtgagcatgagtgaacagaaacacagtcattgccttcattctagcttatattctagtctgaggatacatattagaaacatgcatttggccgggtgtggtggcttacacctgtaatcccagcactttgggagcccaaggtgggatgccataatgaggtgagagaggtatgcagggccacggaggtagtggaagaacacaggatattactcttggaacaatggaaagctactcacagactttaagaagggaaaagatgtaatctaatttacattgaaagggaagaaaatggaaattttatggggaatgggttaaagagttttaacctttaatctgagttttggggtcagtacctgtgtataaaattcctgaagaacaattagaatgaagtatagtgaacaagtgaaatgtwctacaatttgtagagtaaaatatgtaattactttagatgaagggagaaacttacattgtgtagttttctgcagtttggtagggaaaccatttggaagttgttgaagaggtccaggtgaaaaataatggacttaggtgatggcagtgaatgtggagaagtgaaaacacgagttcctttgaaaacaaaactcaactggacactgagttttatatatataatgacataaacattatatatattagatatatwaaatatatatatttattatatataaaaatatatatttataatatatatctaatatatataatgtttatgtcattcatgtttagtagtgaacactgtgagtctgtaatcaagaaattttattaatttgattaggggagttgttttcagatcctcttaaaagcttttttgagggggaggggattgaattgcatgacagtttaaaaatggtctcattgtctcrtagccatgatttttataggaactaagtaattgtataggacattcatttttctgttcagctagttgctatgtatgtttttaaaaatattgtgcttacctaaaccacttttaaaaataatgcattakcattaatttaaccgatttaattaattaataatattgggaatttaataggatcagagaaaatatgaataatataagcttctattggataatgcaatggttaaaagtaaatgtgtctatgatggtagttaagtctttataattgtttactcattcatctcgcctaattagatttttactgctgcatattaaataacagtatgagctgagacctcacttcatgtctctggccttcagcttgttcttttgtgaactcaaagtttgactcaattgcctttgctttataatatgccatttcttcatataggcaataaacatttactaaggagctattaatgggtcagtcacargtggaagaatgttgtgaatatagaagtgamtgggagtgtgtctaaaagatcatataatttggtatgtaaaactgaaaaagtaagtaattacagcagtgaactaggagctaccatggaagtgtttctaaggcagacaatgagaagatgagaaatgatcagtttttttttttttttgagttggagtctcgctttgtcgcccaggctggagtgcagtggcatgatcttggttcactgtaaactccgcctcccagattcaagtgattttcctgcctcagcctcctgagtagctgggattacaggtgcccgccaccatgcccagctaatttttgtatttttagtagagatggggtttcaccacattggtcaggctggtctcgaactcytgacttcgtgatctgccctccttggcctcccaaagtgctgagattacaggcgtaagccaccgcacccggccgagaaatgatcagttttaatagtgaaattatggaaggctttttagcttttgccmcctatttgttgctcttccttgtgttccaattggaaaggatgaagggagagaattaattaggtggttgaattggcagaatttagtgaccatatgactattcttatttcataatgtttaatttatctttgtgaagcaaaactgaagtgttatcatttactgagtgccaagtgttgggctaggtacttgacatacgtttattctaatcctcacaaccatttttatagttcatcagtattatctgcattttacaggtaagaaatacaaagtttgggtaattttagtaatgtacctaatgccagaatccgctaaggacatgatctccaagtgcatccaaaatagacaccaaggctgggtgcaatggcttacacatgtaatcccagcactttttgggaggctgaggtgagaggattgcttcagcccaggagttcaagaccagcctgggtgacacagtgagacccagtctctagaaaaagtaaaataaaattagccaggtgtagtggcacaccttgtggtcccggctactagggaggctgaggtgggaggattgtctgaggctcggaaattgtgctgttgcactccagcctgggtggcagagtgaggctactgtctcaaaaataaataaacagaatagacaccaagttgcgttttaaaattttgtagaccgtaacctaataaatggctgaatagagttattgtcaaaatgcttgttatttacagagtttatttgcatgatttggatcaccaataagaagtcccaatcttaattaccaatttggcaggaaaatatatctttgtctcttctattgctttcttcagcataatgtaaagtcaactatttacaggttgattttaaaaatatgagttgggttgcttcacaatctagttatttttagtattgctaatattttgtgttcgtatggtgtcattggggagtctacttatttcccataatacttctgtaatggagtagggctgacagtgtctttttttatggataaggaaacagtaacagtggctttactagaatccactcttattatgtaacagaactagatttttgtgttggctattataactttaagatggtcaaagttctgaaataaaatgttttgttacttcagtaaaccttggaaaatttatattatcttttaacacataaactttgatacttaacttagcaaagcagtgcagtggcaaatgggacaagaaagaacatgagcccagggagttatttgtaaatgcaaatatacatttgcatttacatttacaatttacaaatatacatttgcatttacaaatgcacatttgcatttacaaatacatcttaatgtacttataagttaagtacattattagagtactaagttaagtacatatgtgtaagtacatattagagtactaagatttatttccatgataaagaggaggtgtttaaatcaaagtgaacatctgtaaatctaaatatgccatatgtactttagctctggatagaatttaagatctaactgaaaggaattaagtacttgaaaaatgacttattttgaataactaatgtgatacttgcccttagactggatcctggactgcaggacaggaaaaagggataataggtaaatattatggacaattttagtcaataaatttgacagttaggatgaaatggacaaatggataaattccttaaaaactacgaaagcttacttaagaagtaatagataacctgaatatctatatgtgtttatctgtatctatatatgtgaagacattggatatatggttgaaaaccttgtcacaaagaaaaccccaagccagtggtttcattggtgaattttgttattcgataaaggaagaaataatacaaattttacacaaactcttccaaaaagtacaagaaggaacagcatttcccaactcattgtctgataccaaaaccacagaaagatataagaaaagaaaattatagtcttatatctttcataaactttgctgcaaaaaatggtaaaattttaactaagaccaacaatatgtagaaaggataatacttaatgactaagtggggtttattctgggaatgtaagatgcgtttaacatttgaaatttaatcaatattaattcaccacattaacaggccaaaatattaattcaccacattaacaggccagaaaaatcagatgatcataattatctcagtagatacaacaaaaagtatttgacaaaatccaacatccattcatgatttaaagctgtcagcatattaggagtaaaaggaaacttcctcagcctactagagggaatctacaaaaacctggaaaactgacagcattcatcctaatattggaaacaaggcaaggatttctgctgtaatcacttctattccacatcatactggaggttctagataatataaaaagcataagatgtaaataaaatacataaagattgacaagaagtacaattgtctttattcatagataacctaattatctccagaaagttaaaaagcatatacacaaaagccaccgtaacagttgatcagtgttgcagggtacagggtcaatatataaagatcaatgttgatttaagaattaacaaggagaaattgaaataaaaaataacattacaatagtaccaaaaatatgaaatttgtaaagatggtatttaaaaatgatgtacaagacctattaatttgaaactacagaacattgctgagggaaattaaagaagacctaaataaatggagagttatactgtattcctggacagagagactaaatattgttatcagttcttccccagttggtctgtggatttaactccattccaaacagaatgtcatcatgcttttttatagatactgacttcgcttctgcagcttccttacctctctcagccttcatagattgaaaagagttagggtcttaaactctggattaggctttggcttgaggaaatgttgtggctggtttgatcttctatccagaccactcaaattttcttcatatcagcaataagactgtttaactttattatcattcatgtattcactggagtaacacttttaattttcttcaagaacttttcctttgcatttacaaactggataactgtttaaaacaagaggcctagctttcagcctgtcttggctttcaaaatgccttcttcactaagcttaatcatctctaacttttgagttaaaatgagagacacatgagtctttctttcacttgaacacttaggatgccattgtagggttattaattgtcctaatttcaatttagttgtgttttggaatagcaaggcccaaggagagggagagagatgggggatggccagttggtggaaccgtcagaacacacacatttattaagtttgctgtcttatatggaattgtctcaaaacaattacaatcataacatcaaagatcactgatcgtagatcaacataactgacaatagtaatgaaaaagtttgaaataattgcaagaattacaaaatatgacacagrcatgaagtgagcacatattgttggaaaaatagcaccaatatacttgctcaatgctgggttgcttcaaactgtcaccttgcaaaaataaatctgcgaagagcaatcaagtaaagcacaataagatgtggtatgcctgcatctagaatatattaagaaccattatggttctgtgacaagaacacaatctaattaaaaaattaaatccrtacaaatggtagatcagtaagcctatggaaagatactcaataatattagtcattagggaaattatattaaaatcacaacaagctaccagtacacacccacttcagatgaagtttgaaagattgacaatgccaggtgttgctgagaattagagccactgaaactctcatatattgctggtgggaatgtaaagttgtacaacaattttggaaaacaactagtttgtcagtttctgaaaaagttaaacatggctgggcacagtggcttacacctgtaatcccagcactttgggaggccaaggcaggagaatcacttgaacccaggagttcgagaccagcctgggcaacatactgagatccccccatctctacgaaaaatttaaaacttagctggcatgctggctctcacctgtggtcccagctgctcaggaggctgaggtgggaggatcacttgagcccaggaggtcaaggctgcagtaagccgtgatcgtacgactgcactgcagcctgggcaacagagcaagactttgtctcaagggaaaaaaaaaagttaaacatatatttacaatttgacctagccattttattcccaagtgtttactgaagagaaatgaaagcagtgactcacgcctgtcatctcagcactttgggagtccaaggcaggaggattgcttgagcccaggagtttcaaaaaaaaaataataaaaaaawwakaagaagaaatgaaagcacacgcccatacataagctgttacgtgattcttcatagcagctttatttgaaatagccaaaaacttttagaaacaacacaagtgtctgttaacatgagagtgawtaaacaaattrtgctatatctgtgcaatggaataatgctcaataataaaaaggaacaaacatatatgattctaaaagtatttatgctcagtggaagaattcagatggaagagagtacatgatgcagaaatagatttttataaaattcaaaaatgcaaacaaatctayagtggtagaaaatacattagtgggctgggcatggtacacctataattccagcacttgggaggccaaggtgggcagatcacttgaagccaggagttccaagaccagcctggccaacatggcaaaaccctctctctactaaaaatacaaaaatagctgagcatggtggtacacgtctgtagtcccagctactcaggtggctaaggcatgagaattgcttgaacctgggaggcggaggttgcggtgagctgagatcatgccactgcactccagcctgggtaacaaaaagtgagaccgtctcaaaaaaaaaaaaaaaaaaaattagtggttgtctaggaaatggggtaatgttggattacaaagactcataagaaaacttttaggttgatgggtttgttcattatgactgtgattattacactttatgtacagttttttggtcaattatgcctcagtaaagctataaaaatgctataaagaacattattggatcacttcacaaaattggaatatggatggtagattaaatattacattgatgttgaatttactgaattgatacctatactgtaggtgtataagagagtatcattattcctaggaagtaaacactgaagtatttaggaataaagagtcatggtgtatataacttatcctcaaatggttcagaaacaatgttatgtgatcagatatatacagagaaaaaggacaaagcacagaggcaaggctgggatggagcaaagcagagaaagagtgggaaaaaagaacaaataggggaaatgttaacatttaggtgaatatgctaaggggtatacaggtgtctgtaccattctcgtaactttgtttgaaattattttcaaataaaagatattaaaaatgtgtaataaagaaagcatggttacttacaatgattccatagttgggacataaaatataataaccagaaagaaaagttggtaaattgaacttaatcagaatttttttttttttgagacagagtttcacttttgttgtccaggctagagtgcaatggcgcaatcttggctcaccacaacctctgcctccggggttcaagcaattctcctgcctcagcgtcccaagtggttgggtgcgccaccacgcctagctaattttgtatttttggtagagatagggtttctccatttttggtcaggctggtctcaaactcctgacctcaggtgatccaccagccttggcctcccaaagtgctgggattgcaagcgtgagccaccgcacctggctgaacttaatcagaatttaaaagtactgtttttttatatacaccgttaaaaaaatgagaagggataaaaagatgagactaaaaaatgtccattaaacatgtgaaaagttgctcatgatcattgatcatcaggaaaatgtaaatttcataatatattatctacaataagttatcactacacttctattgtgtgtgtgtgtatatatatatatatgtagagagagagagagagagtgtgttatggagacatataactttgttttttttttgttttttttttttgagacggagtttcactctgttgctcaggctggagtgcagtggtgcgatcttggctcactgcagcctctgcctcgcaggttcaagcgattctcctgcctcagcctcccgagtagctgagaccacaggtgtgcaccaccacacctggctaatttttgtatttttagtagagatggggtttcaccaggttggctaggctggttttgaactcctgacctcaagagatccacccacctcggcctcccaaaatgctgggattacaggcatgagccaccatgcctggccaactttgaatacacacacacacacacacacacacacacacacacacacacacacacacacacatatatatctctatatatctctatctatatatatgtgtgtgtatatatatatagagagagattttatatatatacatagagagagagagagagagagagcgctcctgctctctgtcaatagacaaggcatacgggagagaacgaggtgtcagtctgtgttcttaaggagcttacattctagtggaagagatacactaaataaatatttattttattttttattttactttaggttctgggatacatgtgcagaatgcacaggtttgttacgtaggtatacatgtgccatggtggtttactgcacctatcaacctgtcatctaggttttaaaacctgcatgcattaggtatttgccctaatgctctcccttcttttgtcctccacccctgctacaggccctggtgtttgttgttcccttctctgtgtccatgtgttctcattgtttaactctcacgagtgagaacatgtggtatttgtttttgtgttcctgtgttagtttgctgagaatgatggcttctggtttcatctatgtccctgcaaaggacatgatctcattcttttttatggctgcataatattccatggtgtatatatgccacattttctttatccagtctatcattaatgggcatttgggttggttcaagtctttgctgttgtaaatagtgctgcaataaacatatgtctgcatgtgtctttatatagaatgatttataatcctttgggtatatacccagtaatgggattgctgggtcaaatggtatttcttgttctagatccttgagaaattgccacactgtcttccacaatagttgaactaatttacactcccaccaacagtgtaaaaacattcctatttctccacagcctcgccactaaataaatattaacaatagctacagaatgtatgtttgtttggatcaaggaagatggaggaggggcctacttcagagtgatcagaagaacctttagttggtgacgtttgagaaggggcatgaaagatgagaagaagcctgctgcagggtagagccaaccagagcgcaataccagtttgcctgcaaccaatatgtttctctggctgctagactttcagtgctaaaagcaagaaggtcctgcgcaaactcagagtagcccagctcctccacttgtgctctccattccatcccctcttgctatcctgagaatttaactccagctttctgctgcatcattcatatccttctatattctaaattattcctcagcacacaaatcttctagtctctaatagcttaggaaaaccctttactgaccctacatcaatttttatttttcttcttttcttcaaagttagtattctcccaaagagttgtgctcattccactctcactccctcacctcccatttacttttcaaacaaccactttaatgggactcagctcacacgactgtttaaacttctcaataaagttaacaagaactccaagctcctagattactcattactgtccttactccagcctttaagcagatctgacagttaaccacacccttcacgcttgaatcactgttcttttaatttcaagggcccctcatctggttttccttctacttcactggctaatttttttctgtctctagtagtggctctctctaggtcattcttgtagttaagatatcctctcttgagtttcacagcaactgtctgccttattatggcatctcgagcttaaatttaatgtatcaaaaagaaaatgctcaatactttctccctcagctttacgtccccccatatcctgtaaggaaatcttttccttctctaagttaaagaccattcacatgctcaaaccagaaatctggaagtcattttttacctctttacccatatccttttattgaagccccaggtcttagtttattttgtgttgctataacagaatacctgaaactgggtaatgtataaagaaaagaggtttatttagttcacagttctacaggctaggcagttaaaggacacggacctggcttctggtgagggcttctgtgctttgttataacatggcagagaagaacaaaggggatgtgagcatgtgtgaagagggaccgaacaggaggaggaacctcactttacaacaacccattcctgagaaggggagttaatccattcccagagagctaattcctctgctccagagtgagaactcagtgctgtgagaatagcaccaagccattcatgtgggatccaaccgtgtgacctaaacacctctcactaggctccacctcccatcacagccacaatggggtcaaatttcaacatgccttttcgtggggaaaagcacaaaccatagcaaccttccttatctccctccaaagtataactcgattatcaacttccttctgttaacttccactgcactaatttatactaatcaacaataatctctttcttggcctattttacatactaactagctttctaatagtctccttgattcatttctttacccactacaatctgctctctacattcagccagtgtaattaacatatgtattaacatatacataataatgattatgtgtgataataatcaacataatgtatgtattactgtgtgatatggtttggctctgcgtccccacccaaatcccatctcraattgtaatccccatgtgttgagggagggacctggtgggaggcgattgaatcatggggtggatttcccccttgctgttctcctgatagtgagtgggttctcgtgagatctgggtgtttgaaagtctgtggcatttcccactttgctcactctctcttttgctctgccatggtaaggcgtgcttgcttctcctttgtcttctaccatgatttaagttttctgaggcctcgcagtcatgcttcctgttaagcctgtggaactgtgaaaccacttttcttcataaattgcccagtttcagatggttcttcgtagcaatgtgaaaatggactaatacattatgttatatattatagtatgaaatatgtgtaaaaatatgtctgcagcagagacagtgatatttaccaaatatttcctcagttttccatattttccagcttcttgtaattaagtggatctacatgactgcctttggtcaatacccaatgtttattttaaaacaaaactgattgtgtacccatgttcataatatcactcacagtcaccaaaaggtgcaggcaactcaaatgtctatgaataagtgactggataaccaaaacatggtatatacatgcaatgttctgatttcagtcttaaaaaggaaggaaattctgatatgctacaacatggatgaaacttgaggacattatgctaagtaaaataagctaatcaaaaaagaataaatactgtataatttcacttgtatgaagtagcaagaatagttatacccatggaaatagaaagtagaacagtggttccccagggttaggacaggggcgaatggagagttgtttaatgcgtatatatagaattgcagttttgtaagatgaaaagttctggagattggttgtacaacactgtgaatatatttaacactacagaactctgtgctttaaaatgtctaaaatggtaaatgttatgtgaattttttaacaatttttttaatgttttatgttctagaaacagtattatgtctcagtcctgtgcaaagtgagatgagctgtagcctttggagacctataattttgaacatagatgttccttaaaagctaaatctttttgaacagatgatgataaacctggaaggtaaatttagatatagatacttttgcatttcttcttcgtattctctgagggtattttaagtagttgacccaacaaaatgctcttgaaacaaaattgaaaacaaaaaataccatgtgccacaaaggtaactaatctaggtttcttcggggaccagaacaccatgcaaatatgagctttgaaaataacgtaataaaggttatctccaacaggaaaatacaactgggtcaggtttattattaggtgtaccrtagtccttttttcgttgggacctctgtgttgtttctagagtagaaaaggtctaatgtctaaaatctactataataatcaaaacaaaagagcaagtcatgaagaactgtaagtaggaaatcagtatacacccttactggctagcaggcaagcaaataaaaatggatataaatttaaagtactgtaatatgactgatgcactaaaaagattactgtcaattttcagaactttcagatttgggtaaacagttatttacatgtttctaatggaatcttaaattggtttggtaatttgaagaatttttcacaatatttgaatctttaattctacattgagaattatatttaagaaaataacacaaatatattcagaattattttacattcayattgataatttagcatttaatgttcattaggttgtttagtaaaaaaacataaaatttactttttaaaaaaattaaggacagtgattattattctaaactgcctcagaaaatggaaagttgatttgtagtagcacagaagaggggagggaatatgctatatgacacataaagattctctttgtcagttagctatgagatgcaaaatagcatctacttactaaggaacttttgtactttgtagaatatctttgatatttagttgacccttggttctcaraaaataagtggcttgtaatttgaccttttgctctatcatgttttcttttttataatctgcttgactttgatgagtgtttttccaatgtttcatttgtttttgcaaggttattttgccatcctttccttccatgatgtgattcttcaggccaagaagaaaaagatgtgtctgtagytaaaattacctcatccttggtgtttttcagcctaggatcactatatgtagctaatgccgttacattacaactaagacaagttccaatacttttttttttctcctcgatctgcagagattcaccaacaatagcaaattacasactggcttggaaagyactcccatgttccgtttgatcttggcartttaatggtatcttcttttacagttttatttaaatgtttcatattgcttcrtttttcttccttaagtatttgtaagttcatcagctctgtgatgaacttacagagaactcgatattctttatagtaccccagcacccagttatgcatgtgatgtgtgcacaaaacatttttattgagtggataaaacataacctttttgattgattcagggaactaaaataaaatgtttctttaataagtacaaattttctgaagcacagatgaaatttaacttcatatgattctgccaaatgtgatagaatacatgtttcctgctcaatrtggtaatagtcaagagagccagaataccaaagtaagaagaaaaaaaaaatcacaaatatttgaataatttaaatcaattcagcaacatctaaataattataactgatttaaataattaaaaatccgttattggcaatgattgtcatatgtacaaccaagagttgcacgacttatattttctttttgtaggatttgacttggctgaacgctaactctttttaggactgatttaattatttatttgttctttggtcctgtgctaatttttatgagcttattatgcagttaaattcattatagtttatttgtcccaattacttattatacttgaactttttctttttgcttagatgtactttattacatatttgatttcagtattatgtcacattattaaatagtrcttattgttaccaccacaaatgaaagtaaagttgtgagttatataataattaaaaatatatgtttcatctacttgtgatcatcaaartatgtgaaaatacatatgaatgcattaagatttaccccaatttaattttgttctctctttcagctgttcttgaagactaattagttacactggatatgctgctgttctttactttgggattgcttatacattttgtgttcttcgcctccatctttgacatttattttacatctcctttggttcatggaatgactcctcagtttacaccattgcctcctcyagcgagaagattagtgttgtttgttgctgatggccttcgagcagatgcactttacgaattagatgaaaatggaaactctagagcaccgtttattaggtaagcatgtaaactgatacagagacatctcttaaaatgttattctgagttaagtaaactgcaaaatatcttactatttatcatgcactgggcacaggggtgatgatgagaaagagaatagggcacttgtacatttgcctttgtcttatgggtcagcactagatgctactttatttcctcctaggtgttatttctggtattgttgaagctgataaccggtgaattgaaatggataggcttagctgcttaagctaaattgtcctaatttcccaaacttggctcaagactcactatattatttttttcttaaaaaataagtctgctggctgggcacagtggctcacgcctgtaatcccagcactttgggaggctgaggcacagggatcacctgaggtcaggagtttgagaccagcctgaccaacatggagaaaccccgtttctactaaaaatacaaaaaattagctgggggtggtggcacatgcctgtaatcctagctacctgggaggctgaggcaggagaacctgcgaggcagaggttgcagtgagccgagatggtgccattgcactccagcttgggcaacaagagcaaaactccgtctcaaaaaaaaaaacaaaaaaaaagtctgctaattttacaaaataaagacaagcataaatattaatgaattactaatttcaatgatgtttaagtacaaaatatagacttcaaattaaaacacaaccttctgtaaaagaatatagagccctttcacttctatatcactgtttaacataactttggcttctgttaagttgctttaaaaagaaatatttaatttcttggacttacaaagggcctacaaacaattgctctttttctgattagtggcaactcctgaaaggccttgtaatgctgttatggagagattaaaatagaattcaagaggaaatttatctaaaatgttgtgtcttcccccatctccatctgtcatcattacctcctatcattttactctgttttctttttctttttcttttttttgagacggagtctcgctctgtcacccaggctggagtgcagtggcgtgatctcagctcactgccagctcagcctcccaggttcacgccattctcctgcctcagcctcccgagtagctgggactacaggcgcccgccaccacacccggctaattttttgtatttttggtagagacgggatttcaccgtgttagccaggatggtcttgatctcctgacctcatgatccacctgccttagcctcccaagtgctgggattacaggcgtgagccaccgtgcctggcctgttttatttttctttatagtacttccatcatgaaagttccatgagactggggacttatccaccactttatctccagttcctataacataatgggcaattaacaaatatttgttgacagctagaagaatggatgaactctaatgctgtgttgaattttcagaactaaatttacgatagctcagagagatgcataacatattgaaggataaaaataaagaaaagagagactcaagtcaatagacgaacattgtgggaaaataagatcaaaccaaggttaagtacagtacacaaaaatctgtaacaaatttctagaaataattaaagtatttgggtgaatttcttagttgccaaaggaaagagagaaatatacttcatttcaaaattaagaggataaaaatatactggtaaaataaagtcaagcttttctggtggcacttgtttctcctttggatcttactaacggaagctctgtgggctcaaacagttgatgttttgtgttgtgtgccattgtatatttacaatgtcaggaatcttctagcttcttctaagcctgtttttgaaaggttttttgttgttgttatttgttttgagagggagtctcactctgtcgcccaggctggagtgcaatggtgcaatcttggctcactgcaacatctgcctcccaggttcaagcgattctcctgcctcagcctcctgagtagctgggattacaggcacgtgccaccacgcccggctaatttttgtacctttggtagagackgggtttcaccatgttgaccaggctggtttcgaactcctgacctccacctgcctcagcttcccaaagtgctgggattacaggcgtgagccaccgcatctggcccaaaatttgttttataaaaacgtgatctaaactaatgtttttaaatacagtatctaaactaatgcttttaaatagagtatccacatttctttatacctcccctttctgtttaagtccagttttcattatataactcaagaagttaaagaatatttctcgttaatatttggtccagtggttttgaaactgtttacttattatgaatgtatttcaccaaaactgcttttattattaggtaagtcaatagtaaaagaactgacaccagtagttataaatatttttctttagaatgtattgagaggcagatatttatcttgaaaaatgttattgttgagtttactattttataacttattgctctgctggcctttcacctrtaatagcaccacttgtagttttgctttcttccccaaattttgcaaatcactgtggatacaacttaaataatgttgacatcttttagcaaaataatctttttgcctgttttaatctcaaatttggggatataatttaactcctaattaggagtgtagccattttccctccccttagttttttaagaatttttcaactaaacaaatttgaaaggattatttgatgaacatctgtataccctttacctagtatgacaattttaaccttttttcataattgygttcaccctctcctggcccctctgccaccygcaccacaggggtrcccatgtatgtccatctagttataattattttttccttaacaattcgaaagcaagaaactttaccccaaacacttcagcctatatctcttaaataaccacaatactattatcacacctaatgcaatttaacattgatataataatatatgttttatctctggataacaaaccatctctgttttgtggcttaaaacaacaatcatgtattttgtttcatgattctgtgcagtggttgaatggttctttgtttggtcttacatcagcaaattcatgctgctgcattcagctggtagatgctaggaatsggctcacctggaatttgaaaaattcctttccttcttaagttttgacttaagttttttgcttttgattccttctgtaataatcttatgtktctaaagctttatrtgagagtatctaatcatagtctrtgttaactatttgtctttaatatcttttaggaatatcataatgcatgaaggcagctggggcatatctcatacacgtgtgccaacagaatctcggccaggtcatgtagctctgatagctgggttttatgaagatgtcagtgcagttgccaaaggtattgtctatttggacaatcttatgaaatgaaaaatttgtcaagtaaatattagtcctttaccacttaatcatgtcacaaagtgaaggtatgttttgagatattttggacaaatgttttagcatgctttgctgacatgaatacccactggtactgactccagaattgaarctttagtatttcattatcctgtgttattgaaagaatttgggttggatggaagcataattttcctagatattactcttgaaagttcaaaaataattttatatttcattaagaagtaaattatctattgttagtttttttttaaatagtggtataatatgcataatataaaatctattagttttgcatttattcactgactaatgtaattgttattatttgaagaatagttctttaggggcttattgtaccatgtgtatawaactattactgcttgcttgctttctgaaggatggaaggaaaatcctgtagagtttgattctctttttaatgaaagtaaatacacatggagctggggaagcccagatatcctgcctatgtttgccaaaggtaagagtcactgattatgtttcctcagatagtaaatagggagtaagtcaatatggtagttttctatttttatgtatgtaatgtatgtgttgatttttacacatatttttacatttttaacatttctgaaatagggatgtttaattacagtawttttttttccttcttagttatacttgagatattggcacatcatacagttagatagtattttggattcaattaagtggtatatagcactatcksttaacagctatataatcttgagcaatttatataacctctctgagcttcaatttccttttcataaaatgtgataatattagtttctgtctcatagatttatttttataattaaattatgtaattcatgtgaaatatttagcatagcacttttcacataacttgattataaatgatgatgttgaggtgtggttcattatactttggtaaattattttaaaagttagtagctaytcatataaagatttaaacattggctgggcacagtggctcacacctgtaatctcagcattttgggaggctgaggcaggtggatcacttgagctcaggagttggagaccagtctgggcaacaaggtgagacccacatctctacaacaaacaraaaattagctgagtgtggtggcatgtgcctgtagtcccaactactcaggtggctgaggtgggaagagtgcttgagagcctgggatgttgaggctgcagtgagccatgattatgccactgcactccagcctgggcaacagagcaacaccctatctcaaaaaaaatatttaagtgttaaaatatatagttataattcctrttttaatacatcgaagatgccatatattctggcatttgatatatatggcatttaacatataatttatttaaattgatatttaatatactgaatgtagcatttagatttattgtttatatgcatgattctgcaaatattgggacatctcttaattagaaaattcatttatattattttctaaaatcagttggatgaatttcatgtcattaaatgcttttaagtgggagcagaaagattgatcatttcacttatcagaaaggatttgtaacatacttagtcatgagtgtaattaaaataatgggaactattgaagattattatgtgtccaggaagcaaaatatatattgagaattttacagatgatagtcatagaacattattatactgggcggaccaaaaagccccaaactgtttgccatttatatattgccttctttggaaagcagtttcgtttttttgggagctggtggtggtaagggtggattcagttgctatggcttatcaaactaacattcctatttctggctacaatggatgggagaggacaaataattgaattagagatagtctaatgttccatatcttgtagtaaacagcaaacccagtcagacctttttatttgggatgtgggaagaggaatggctgagctgtggaatagggtcattagagctgaactggtgctataaagattgtattactttattatatatctctctttttgtttttgtttttttgagacggagttttgcccttgttgcccaggctggagtgcagtggcacgatctcagctcactgccacctctgcctccttggttcaagcgattcttctgcctcagccccctgagtagctgggattacaagcgcacaccaccacacccagctaatttttttctctttttagtagagacggggtttcatcatgttggccaggggggtctcgatctcccgacctccggtgatccacctgcctcggcctcccaaaatacagggattacaggtgtgagccaccacactggccatatctctttcttattacctgcaagagcctatcaaactcagaaattcactaaactgtttagattcttaatacactcttgcaaatatatgagattgtcatatctgttgaccccttcaaactctttggcaataagcaatatttattctcttagaagttgagaaaaatactcatagtttatgaataagagaagtgaaatatckgaattttcttcttatgttaagaaggtttgtacaacacacatcatctattttagattgtagcattctaaggggcacacatgttttgaatagtttaatccttaaagggagacaaatattgtgcttatttttgttatattgcttattagagttgtgattttggtgtgttaattaacatataatgaatctgcgaaattaaaatatgttatttttgaggacaaaaagcaatagaatacattaaagtatgtagcatggtccatagcacataacataaataaatgttaattattcctcccatttttctcttccccatcataatgaacaatgctttgtgaaaattctggttactcacaaaaatctgtgaatgactagytcatattttatgatagtttaaaagattttgtaaaaagattattttttccaaattttcttttcaggtgctagtggagaccacgtttatacatatagttatgatgctraaagagaggattttggtgctcaagatgcaacaaaactggatacgtgggtttttgataatgttaaggtttgtgctattgagtggttaatatacaaaaagcatatttttacctgaagtattggagactgtatcccacgttttttctgttttcatgagctttgaaagttctatgttgtagcacactgttctgaattctaagatttaattctaaaaaattacacattctaaataaataagagaagttttaaactcctttgtttctattagtaaaatgagccctagattaggatttaggaaacctgtttttcgtttctagtttgtgattcatcctgggtaaattttgatctttcattgaccatggaatcagactcytgtagtaatggaccatatgagatgtaggaaagcctttgggaaaatgctgttcaaatgtaatacatttataataacaaagtggatgattttttaaaaaatactttaaagaaaaattagataagcagattatataggcaaaaacaaattagcaaattgatcataataaaaatctatggttcctttaagtactagttttttgaacattttataatgacaattatcatagtttcatgaggaatacgatataatttatattctcaaaaagtgtgtgaaaatctcaattgtggacattggctctcttcttttaccagtgcattattcctcatctccaaataacaactcataattcatccattataagaagctttgattgatacttcttttttctagtaatgtcttttgaactgactttgtggacttctccatgatatagccatttttgtttgtttgtaaatgtactccttagtatatatctgcctttttctttgtatttgcttagcagaaattaagtgctctaaaattcattgctaaaccctatttttttccaagggtttttcccttgaaattttctttttacttttaatatatacttttgtcaacagggaaaactttcaacttaaataaaatctgtgtaagaaaatgattagcaaaytattttgctaatcatcacttcttaacttaatgtgctaatattaatatctgcatgaaakcytttggcttctaatttcatatgtgtagctaaaatccctccaaaatcatggaattgattccttgtgaatgtacatacatagctggtagctggcctgattttcatgtctttcttcctttctttatttcaacactactagtcttgacacggtagtgaacagaaaaaaagatttgcacatgacttcataaaatatggtagatatatattaaccaagttataatgaaaatatgaagtcatcagcattggtaagtgatgtgaaggaaaaatacagaccaagaatatatcttcagaaaattctaatctgtgctgggtagttaggggaaggctaagaggtttgagataatctctgagcaggtacaggagacaaagaaatggatagggatggattggtatggaaaggtattgcaggccaacagcattatgtaaatcttggtcaagagccagcataatggatytgaggaagtgagaaagaagggaggttagtgtggcaggaggactgcctgggagccaggtctcagaagaggctagagagtgaggtaagggttttactcgaacttcatgtcctggctagagactcatgtttaattcaagccaaacagtttccagatccatgcagttttctactcacctgtttttttgtaactgtggttaaaaaaaawaatatatatrtatatatatgcaaaatacagaatttactgtcttaagcattttaagtgtttgcagacagtccccagcttaacaatggtttaacttaygattcttttgactttccaccagtgcaaaagcaatacatatttagtataaaccggacattgagtatccatacaaccattttgttttttactttcagtatagtattcaaaaattacatgagattgtaattattatctcacttatttcacattatcaacactttattaaaaaataggctttatgttagatgattttgcccaactgtagactaatgtaaatgttctgagcatgttgaaggtagtgtaaaccaaaaataaaattctaagcacctctcccccaaccccccaactatctcaatggactttctcagccagggcgcttttaaaatgtaacctgagagactgattcaggccataaggggaagtgggtgttggacatgcctcatwatacctctctggcattaacgtcaacacagaccttaaagtctaataagaaacatgtaccctaaaacttaaagtataataataataaaattaaaaaaaaaagaaacattttacaacctattctctctgaagcctactatctgaagggttcctctgcaaataagaactttggattccacaatctcttatcttaacccagacattcctttcttttgatcccaagtctttagagaaactcaaccaattgccaaccggaaaatttttaaatttccccccaatccccactttgagttgtcctgcctttctggaccaaaccaatgtattccttaaatatatttggttgaagtctcatgtctccccaaaatgtataaaaccaggctgcaccccgaccaccttgagcaaatattctcaagatctcctgagcactgtgtcatgggccatggccactcatatttggctcagaataaatctcttcaaatattttatagagtgtgactcttcgttgacagtaggccaggctaagctatgatgtttggtaggttaggtatgttactggcacaaggtatctgaattaccggcaacaaatctgtaaggatctgcagcaacctcaattcttaccttcccagaagaaaaacttcgactgggggtcataaggcagaagaagagaccaaggcagcaatggaagtttatttacaaaaactttagaacgggaaagaaaggaaagtatgcctagaagagtcccaagtgagcagcgaggtcaagtgcagtgtttaatcttgatcctaggactttataggctggccgctttccatgattcttcccttagggtggggcgcccgcatgcacagtgccctccttaaccttgggaggtgagcatgcatagtgtgtttagaaagttgtacacatacctatccgaggctttctttccttttctggtggagtgccccctgacaggcatactatgccatttggtctattaatgcacatacctgagaagttgcatctctctggtgcttgcattcagttaacactttagtgcagcaagtgtagaccatcaggaaatggcctctccctggtgccagctgccaatctaccacttttagagaggcagtgtgataattgctgaatcatcacccgacattcctagtggtcggggaagacccctcccttgccccactcatgcctgtctaactacctgtaacaggtatattacatgcatttttgacctacaatagtttcaatttaggatgggtttattgggatataaccccattgcaagtgaggagcatctgtaatttagtagtgttaagtatgttcatgttgttatgcagctaataatctctagaatatttcatcttgcaaaacaaactctgtacccattaaacaataactccggccaggcgctgtggctcacacctgtaatcccagcactttgggaggccgaggcgggtggatcacgttctcaagagattgagaccatcctggccaacatggtgaaaccctgtctctactaaaaatacaaaaattagccgggcatggtggcacgtgcctgtagtcccagctactcaggaggctgagaggcaggagaatcgcttgaacccgggaggtggaggttgcagtgagccgagattgcgccattgcactccagcctggcgacagagtgagactccgtctcaaaaacaaacaaacaaacaaaaaaaataactcttcatttccccctcccccaacgcctggcaaccaccattctactttctatttctatgcatttgactactctaggcaccttatatcataactggaatcatacagtctatgtctttttgtgattggcttatttcacttagtataatggcctcaaaggttcgcctgggttgaatctatttactttaaaaaactcagttcatgcatcttcttctctattaggtcttctgtgacttctctttgctttgccctatttccagttcgacttagataaccctcctctatattcccttaatactttattgtgctatactataactgttcatacattgacatattccccttcaatatacgtcttgttggcacagatactgactttttcacactgttaactttaaaccctatcagaggctgggcgcggtggctcacgcctgtaatcccagcactttgggaggccgaggtgggtgaatcacttgaggccaggagtttgagaccagcctagccaacatggtgatatcctctctctactaaaaatacaaaaaaattagccgagcatggtggtgcatgtctgaaatcccagctacttgggaggctgaggcaagagaatcgcttgaacccaggagacagaggttgcagtgagccaagattgtgctgctgcactccagcctgggcgatagagactgtctcaacaacaacaacagcaacaaactcttatcagggaattgtttggtacatgaataagtatattaacttagattagatcatacctgtgtaatatggaaaaaaataacttaaaagtttacttctatcttagtaaagataatgctggcagtaggcagctgagcattgatgcagtccaggatgctatagtggttctacagtatcactgacacttagtctcctaaagttttcctctaacttcagggcatgagttttatcttcaaagttatgtcatgacccaagataatcctggagttcccgcccttatgttagtgttataggtcaaaaatatgaagaataaaaaaggaccttctttcctactgaattatatttatttcaaaaagccttagatccacatagctttatgactgaaatgtttgacttaaatctcattggccaaaaccacaaaggcacatctagctgcaagaaaggataggataggcacatctagctgccagaaaggattacatagctgaatatattgtaccagccatagaacaaattatagatgtaattcaagtcatttgctcagtttttttgttttcagctctcaattatgtgtttaacttttaattcttttctcttaaagagcttattgtttttatctagatttaaattttcttaggggttaagtagaatgtatatgaaagttagggggcaattttatacttttgagaaggatgataggttatatattgtattaatttatttctrttcttgaatagtttctctaattgcaccatttgtgttttttaacatagtagtgaagagttatttgaaaaaaatacttaaatacttcagacttttgttgaaaagttaaacatatcttgttaaaagttaacatcttctacagttaaaggcatttatgtgaacaacaaagatgtatcttggatagcctgttaacttatttaaaataatttaaaagtagtcttcatagttttgcacccatgttcatgcatatgtgaatacagggtgaatcatttgccttagaagggtttatgaatctagtttatcattatttaattagcataataatcttcaaattttattttaattaattattcccagcctcaccctgccaagtartattttattaattggttgcttttctgttacatgatttgaagaacacattctagctggggcaaaggaagtaattaggaggctatttgcaatgttctacattagagattayggttggactaggttgatagtacacaggacaatgaaaagtggtccagttctgaaatatttaaaaaaataaattattcttaaactggtaacagtattactatattatttttgactcttgccaaaatatgtsttcaatctgctgtattttattaagttagatgtgggattaacaacattatgagatctctatgaaattatgatcccctttctaacatctttttttggccttattataacagagaaaacagctaactcattatttgaacatagatgtctgaactgatagcaaagacgttgtgttggtaggtcttgagcacagatttaaacaacgtgagataatttaattttgtacttatgcataaatttaaatgttttcatcagtattatttttaaaataaaacaaatgaactaaatatttttaactcatttgttatatgtaggacttctttcatcatgccagaaacaaccagtctttgttttctaaaataaatgaagagaaaatagtttttttyttacatttattaggaatagatacaaacggacatgctcatcgaccatcctcgaggtaatttaatattgtgtttaattgtattttttagggcaacagctattctattgaactttttattataaagttttctttggaattataacaacagagctaatattttaaacaactactgtaatgtttattaagttctcaattatatgagatttccaatatagtsgtttaaatcatatgtgctgtatccagatggcacattaatataagtaaaatatatcctgtacatattacataatcttcatttactgaagcagagaaaaaaattatctaaaatatctatatattttagaaatattttcagtgaatcttgaaaatataaagcattttatggtattaacttttatatcaccaaaagatgtaattatttattccttgtgtattccctttaattagtattgtatctagcaaataaattgtatacatttttgtataccataattcaataacactccttatatatracagcaagtatttttctcacttttgargaccataagtaaaaggaagataccatgttatactcttatttctgactttgcatttggtttaaattagcctaacagtggctgtaaagcctattgggttagctgccagtgatgaatacctcacaatccccttcttaaacgtgatgcactgctgtaattgatggaatattcatatcgaatgaaccttgttsagttgtgtggcagtcttaaatataatgtgttcaaaacrtgatattatattttatatcaaaagcactttagggaatgaaaatattctatacttgaaatgatacttktaatgtggccaaacagtttagtttatgtagtaagagtgagagacatgaacgtcatctatctcatttaggacctaaaaagggtttattaaaatatatttgttaatcattcccctccttttaagccatctttgaaaactatttcaggttatttagcttcattaaaaggagaaaaaattattttaacaatctagagtactctgattttaaaatattaaagatgaaatctaaaagcatttcagaagttactgattttgaatgtaatgaatccacgttgaataaatttgatttctccaaattaatttaatttgttcctctgtttctttacaaatagagactacaagsacaatattaaaaaagttgatgatggagttaaagaaatcgtgtctatgtttaaccayttctatggaaatgatgggaaaacaacatttatctttacctctgaccatggaatgacagactggggttagtgtgtctttaattgatatgtaccttacaattaaagtagtgataaatgtagctggtaaatattttatgatgttgagaggattagatgtcttgctgtatacaaaatgtctagcacataattctgtgcttaaaatgttagcctaaaaaacaactgatcttataaaaaaatattttctctaactaaaaaacgaatatattctcatttacaaatgacaaactagagaaaagtggagaagaaaataaaaagtagctattatttatctacagagaattaactgtatatgatggcaaagggagtgacgttaagatggtgttactgagggaccgagggctgctgaaattctgtcccgggtaagcctgtgcgccctgtgagattcccaaggcaaatgcaatgtgtgcacagagaacaaaataaagcaaagatgagatttgtccccaaatcacaatatggatttctagtgatttgagttccactttataaaggacttcttttggctctacctgccagagtggcctggaagaaaaggacccagagaccttgccatcttctccagaaagacttagtctctactgcttgccccaagcttgggtggttactgcccaagggagctctctgttctttctgtctgcagtgctgctctggcagcagcaacatttcttccatgtcttattgttattatttctattctttcaaccatagttactcagcaggcagtctggttttttgttttactttatgcctgtttgttgttgtttctctaacttgctttataggaatattgtcaaactaattgccataaaaggttgtaaccatttggtaatgtagtcactagaattaactatatatggatcaactctttaaaacaaactattttaaaaaatatttagttgtaagttagttcttctatatttgtcttattattctttatatcttawttgtaggttcccatggggctggtcatccttcagagactttaactcctttagtcacttggggagctggaatcaagtatccccaaagagtatcagctcagcaatttgatgatgcatttttgaaaggtacaagcatttctttactggtttayaaatacaacctcttaaaataagaacaaagtttaaatttttaagaaatcactcttcaaattttagttgtaaatccctcattttgacatttgtgccattactatttctatacaaacactacaaggggttgttggcttctctcttctcacagagccatttgttgaacccttcccagcacaccactgctaataactagactttctgaatgtctaaactgataaactgaacttttgatgttcttttattaatttattaatttgaatgtgaggtagagtaaataaaaattaaaaaagaggaaatttaaggtttcatagaggtaaataatcagtttttgagatttttcaacccaaacaaagtacatgctgtcagttataaaatcaccctacctacaagatatttctattagataaaaagcaagaggtagtactgagctatttcaaccccaggccctaatgaagacagaagagcacagtgaataatgcactcaacagcatgtcttcagtaagtaatggtgcatttttcagagggcgatttcttatatatttgtaagtgctaatggagagcatcatgccacatcayaggtccacaggggagacattgacaaaaggccagaacagtgtaaccagtacactgccatgattatttccagatttatttaagcatgaaagaaaaagaagctagtggactctttttttcatctactacatatctttgagatagcccctgctttctcagaacttaacattctagtaggagaattaaagcaactataaacaaaacttacacattatgataattttatgaagaaaattagggtgatatgataaaagaggaggtaggacygggctcctttctccaccctgccccccccgccagtttccttagagacaggttcttgccgtgtctctaaaggaatggaatgggctggaatgtagtagctgttcacaggttcacaggccagtcgtagctcactacagcctggaactcctgggctcaagcaatcttcctgccccagcctcccaagtcgctggaaccacaggtgtgtaccatgcctgactcagtctgccacatttttattaagatatttggcaaaggaggcaaaatgcattggttttaaatgtatagctttatgaattttacctgcatatatataccatgtagtctccatccagattcaccatacatttataccctagaagtttcccttatggagcaggatacattttatagagtgggctaatagaacatcttttcacagttaggataagagggagccattcatatgaaggttagggcaggagtgttccaggcagagggaatagcaaatgaagaggctaaaaatagaaagagcgtagcttgtttgaggaacagaattggaaggctgatgtggctgagcactgtcagctgggagcagagtacaatgagttgagagttggagaggtaaacaagaggtagatcatttgaggcaccaaatcctgggtaaggagagcatgaagtatgttccgagtgcagtgctctatcattaaagcctgttagagcattgccaacattccagtttgccataggagctacctttctgactgctctgtggtaaatggattagattggatcaaaatagaaagtagggtaaatagtatgtttgtatttatgagatttaactttattttggcatttgatttcatgttgaattgacgttttagaatcacatgatttcaagaatcatcagaaatgtattttttctcatatgaatattaaatatcatacattttagagaaaaggaatggrcattttttcatcaactgattagtgtgaatttttggtagagtcagaaacgtatttttaaactttaattagcttattgaatgaaattttattatacaaatatcttataactcttttggcagtgtatcctaaagccattaaatcaagacggtctctcataatcacttgtttagatttccgtttaatgcaatttctgaatttatgtgtagaaaaatggaagaatgagcctatctttgaagacaattttaataataactcaatatactatgttaacatttgtgattagtgactacaggaacatcacaactacagttttaggtgttttgggaggaactgccatcacagagaaaaagagaagcttgaattaattaacttcctatgaattgccttaataactctctagaacaggattgtaatgagttgtcaatgctgacagttgttaccattgtgctttttcacttccatctttccttcctcagcctctgatgttttgaaacaattatctcccagtaaacatttaagaagcttaataaatcatcacaggaaacaccaaatatttactttttgttttttttaaattctttaaaaaaatacacctttgcctttaagcatgatttttattcatacttggcttaaaatagacatttctaacacctatgttttccataagtattggccactcctaaaaatcaaatgatttattcttttttaaatcttaacatcagatcttgtgtctgattgtatctttcagagtggagattggagaaytggaagaggctagatgtcaatcaggtatccagttcgattttattacattcaaatttaattttatcttctrtaagaaggttagacaaaaactatgaaaaagagataatattaatattgacaaagtctttttcaaaacatttcagttactaaggggaattcttttagtgcaaatattttagcccagctaatctctcttgtggcaaaacaaacaaaacttgaagtgaaaataaaagacttcttccaaataacattggataattatttgttatgtaaattgaaatttgcatgcctcttaaatttctgtgattgcttttcatggttgtattgcttaatttaagcacagatctattaaaattcctgttatgggtttgtttcctatagtatgtcagttaccttttctttttgttaacacatattttacctttacttctaaccagcaaccttacaaatgcaatggggaaaaaaatgatgagattataaattactcagctagaaaccttctgttagaggaaaatgtatagccaatctgataaagttagatcagtagcattgtctgtaaatatgaagcacagaattttcattgttaaaaacatgctaccttaatagccatcttcactatttgtagaaggtatagcatcattgggatatggcttccaaagtggcaggagtatcttgccttccaggtcaccacacaagctgagattacttactgtggtggacaaaccaaggtctagggtctcattttcaggcctgtggttgtagaaacttgtttcttcccagcaaaataagaatagtcttctcctgggatagatgcatactacccaagtaaatgaacatgaacatataaagtcagaatagcagtttattaatttgccattaaaaatcactgtcaaaaagacgggaatgacttgaagatcacaaaacaagaacatcccttattcatagccagaccagatcataatcagcaattgaacatagattcagttattgctctctgaattgtcagtctgttggcaaacactcctgcttcaaatctccatcaaatgagaatctctttktctattcattccttctactaacactgtgatgtgtctgtggtgtgtttcaactttgtgctaagtctaagtatttagtggtgagttaaggcagacataatccctgtcctgggaaatgtataccttaggggtaagaacagatactcatcagtctgttgtacaaatacatgtaaacttatagctgtggtaagtactgcaacagagatttgtgcagctgtgagactgtagagtggatgtatatgatagactgtagtcagcaaaggcttcctgagaagtcgaggaatgagctgagattgatgaataagcaggaattagcaggccaaggcagtaggaggagggcttttcaggcagaggaaatgtgtacactaagttctggtgagagggtacatggtgtattaaagggtcttgaagaaagctgttatatagcaatagaaaccatggggtggtgtgaggcagaagaagggaggcgcagccccttcagggtctcatgggccttgtgaacttaattctgaaagttcaaagaatccttgaagagtttgaagcctagagagtgacacgatgtggttttttgtgtgtgaaagaatacccctggctgcagcatggagaagagattagaggtggccgacagtggattctgagggaaaaggaaaaggtgactaggaagactttggagatttccagttttctggaggatggtacctggtaatgacaatctaaatagtagaaagtgagaaagactgagagcctgggaacaaacttgatgaattccaactttaaatgagggactagcgaacgtatctgaaaaggaggagccagtgagatagaagaaactcagctgtgtggtgttgaggccaagaaaggagtggcctatgccatactgctgaaaggcctagtaatgccagcaacaattgtagctaccattatcacaggcttattatgtgccaggtactttataagttttatctcatttaatcctgtcacacctctgtaagggaaaaacttgcatttatttttttaactgataaaggaatcaagcaactggagggttaaaaaacctacctgagaatttgaaactgggcattctcaattccgagtactttattgcctgaaaaattataaggacttacataaacatagtcaattagatttagaaaatggggttgttagctctcttagagagagcagtctttggaatgataaagggtcatagtgagtcacagtgggcagaagagtgatgggaaggtgaggaagcgaagatagaaaaagcatgaacaactcttccgagaaattgaacttaaagaggagatatccaaaatggtatttgggatcttttgactaaagagcctcttctctggtttatgtcttttctggacatcactggctggtcaaacctccttctgatactttgtttttctacttaatatatacatttctccagttaaagtctactcttgatattcattttatgtctaaataaggcatcctttgtataatactgaaaaactgttacataaaatggtcaaattcttagctaataggataagtaattttttgttttagtatgttttacatttagggcctttagtggtttcttttcaaaattttttttataggttcatatacatctagcaaatgacacttttagagattaatatcttttttattaaatacatgtttgaaggtaactgattataacaaatatcatggttattttccaaaatatggttgcattacattatttaatttctttgttgatgtccatagacttcttagaattgagcttttttatttgtaggctgatattgcaccattgatgacttcccttattggagttccctttcctcttaactcagtggtaaggaataaaattttrttatcaactctcagtataaaaaaaaactatcgcacagtaaaatgtactcttttttatgtgtttctgaataatctgggttttttttttagatggggtcttgctatgttgcccaggctggtcttgaacttctgggctcaagcagtcctcccatctcagcctcccaagtgtctgggattacaggcatgcaccactgcttccagcttatataatctttgattacatttaaaactatatattcctgtatatttatttctaaatatgcaatacctcatgattgcttgtgtattatattctataacatggaacatgagccaaatagcttttctttaaatattttaattttctaaaatgtgtatgatttatatctttgtattctggttataattgatagaaatgtataagtaatttttttattacaagcagcaaaaactgacttcgtttaaagggaaattattgaaaagatattggtgatttgctgaaacaaagtggtgcttgaaaaccagccttgtaataacctggaaccaggatatctggagacttggaagaaggaaccacagccatgatcccatggcagagctgttctcagggcactgacatgagggtagagtagcattataccttagtttctatcccttgactatcaggagtcaaattccagatggtctagcctgggttgtaatcagcaggtccctggattataaacctaacatgctgtatataatgggcaagatttctcaacagaaaatagtaatgctgttaagaatgggccctggatactgaaatgccaaaaaataactatttcaaccagccactcttattagctcttcgaaatcaaatgtactcttaaaaaataatgttatttaacccagaatgctaagtaatatgaccccgacagtcatagtgtttgtgtatatgtataatgaaacaaaagtttaacagaatagtccttactcttattatgtacagtacactctgatatgtctgaagtcttttattttaagtatgctggctgtggcctaccattgtaattgttttttgtgcgtgaagcactcagttcactacctagcacgtagttatctctcagccaatgccaggtgttactgaatttaattcatctcttgctttgcttaccttaatacatctactttgtgagaaaaataatagaacatctttcagttatagttttaaawagatttttcatttaactatttcaattatttatttgtccatatgccttatctttattgcttttaagtctgttttgttttataaggatagcctgagctgtctgawtactatcaataagctggtgtttgttattttcagggaatccttcctgtggattatcttaacaacactgatctcttcaaagcagagagcatgtttacaaatgcagtacagattcttgaacagttcaaggtaaaaaaaaaattcaaaaaggcacrcacaaaaatggacaatactacaatttaaatattgaatatatttagggaaaatatttgattttgtttttaactatttccctgtaatttacctttaaattttatgtatttgacttgtgtttcacatttctgaagggtaggttctatggctcagtctgaggacataaaattgtgtttgaggagtatgactgcatgtaagattaccacatatgcttacaaagactacaagtcaattctttaactattagaatttgccccatagaaatcatattagagattgcaacatttcttgtcattccatgtatgttatgagattccttaagaatttaaagaggtgaccctttgactaaaaccttctgttattcttaatgcttttaagaataagcggtttggcttgttttattttcagagttaaggaagtacagttttaattacagtatgttactttgcaagattgatatgtttaattctcagcttattgagatartaagaaaatgttaaatttttctttaaatatttatgaaacaatatagtaacataaaattccatttattttcaaagtggttaaccatccctaaagaatcattttaatggatgtttatatttcaaaatggaattcattatttttctcatttgtaatattttcatacttggttcccaggtgaaaatgactcagaagaaagaagttactttaccatttttgtttacaccatttaagtaagtcccttacatttttttattaacttgaaggaaagaattttccactgagtttgcaatttttcactgagtgataggattagtttacttatacagtttgccattttatrtacattagtgtaaactccaaattgaaatcctcttctattgctgttgttaaataatgagccaggtgctagataactttgaatggctggaagagggatgagggaatggagagatacatgagaaatattaagcaggtgaactccacagggcttgactggttggctaggaaggtgtgggggcaggaacgagtgtgacttcctggcacttggcttggttgattaggaagatgctggtaccatatggctttttgaaagaagaactagttcaggagacaaagatgaatgttactaagttcaacttacatttgaagatatcagttaattaattagaaagaggggcttgggtctcagaagatgtatgttgcttgtgaagattttgaagccgtgagaataaagataggctgggcgcagtggctcattcctgtaatcccagcactttgggaggctgaggcaggcagatctcttgagctcaggagttcgagaccagcctgggcaacatggtgaaaccccgtctctagtaaaaatgcaaaaattagccgggcatagtggtgcatgcctatagtcccagctactcgggtggctgaggcaggagaattgctacacatgtaggaggctctagaattctgggagacatcagcttctactgggtgggtgtattagggttctctagagggacagaactaataggatagatgtatatgtgaaggggagtttattaaggagtattgactcacataatcacaaggtgacgtcccagaatagaccgtctgcaatatgaggagtaaagaagccagtctgagtcccaaaacctcaaaagtagggaagctgacagtatagccttcagtctgtggccaaaggcccgagagcccctagcaaaccactgrtgtaagtccaagagtctaaaagctgaagaattcggagtctgatgttcaagtgcaagcagcatccagcgcaggagaaatatgaggctggaaaactcagcaagtctgctcattccacattcttctgcctgctttattctagctgtgctggcagctgattagatgatgcccacttgagggtgggtctgcttctcccactccactgactcaaaggttaatctcctttggcaacaatgtcacagacatacccagraacaatactttacatccttcaatcaagttgacactcaatattaaccatcacagtaggcaaagaagagagctgactttggtgagcagcagattttgctgtcccaggtccaggaagatgtgttttccttgcatcaggaaagggaagatctagatcacagacctggctctgcactactgactgcatatgtgggcttgcatctttgaggttcacattcaattagcaaggattttgctattgaccaattaaatagaaattgttttatctatgaatcttaaggatgtgattgaatgacttcattggagttatttttgacaacttctgttgcactagtgtgatattcataaattagaaaggcggccgggcacggtggctcactcctataatcccagcactttgggaggccgaggcaggyggatcacaaggtcaggagtttgagaccagcctggccaatatggtgaaaccccgtctctactaaaaatacaaaaattagctgggcatggtggcgggcacctgtagtcccagctacttgggaggctgaggcaggagaatcgcttgaacccgggaggcagaggttgcagtgagctgagatcgcactactgcactccagcctgggcaacagagcgagactccatctcaaaaataaaagaaaggcataaatattacattaccctctgaatactgtggttgtatacttgagtttttatgtgtgtatatatatgtgtataggagagtaaaaataaaatgaaattaggattttgcaagttataatcatataaaattgattaccctaaatatatcattaggatattatgttatttacatctcttatgctaattctaattttcttttattgtagtatagtagaattgagatttgttaatggaattggttctgaggaatatataaatgttcatatgtttttcaagaaatattgattgactagtatgtgttttgcggatatagcagtgaacargatagacaaaggctttgcattcatagagtttatttgtacagtagtgtcacaggcaaactataaccaaatgaagaagtgaataaggaatacattatcaattccttttatgaagaaaatacaccggctgttgagagtgagaataagtgagggttactttagaccagccactttagaaaggctggttaggagcctggccagtgtggtgaaaccctgtctctaccaaaaaatataaaaatgagccaggcatggtggcacctgcttgtaatcccagctactcgggaggctgaggcatgagaatcacttgaaccagagaggcagaggttgcagcagtgagccaagatcccaccactgcactccagcctgagcaacagagtgagaccctgtctgaaaaaaaaaaaaaaaaaaaaagacaaagaaaaaacaaaagaaaagaaagaaaggctagttagggaaggactcttcgtcaagggttcaggtgcacactgctacccctttttccacgtggcatggtaactgatcatagacttcccctattttgatgttcagtgtctgcctgcacatacatattcaaagccactgtgtcctctgggggtctggcgggatggctgattcccatgtactggttcacccactctagagcatagtgaccagccctgcctgtagacctgtctggctaaaaatcaccacttgctaaaagcctgcaatatggtcaaaaaaatctaagataacatgagaaatggactcttgaggtcatatgaaattcaaggaacagaaccaaacctaaaaacattaaaattctcagaaatatttaagaaactattgcatccataaaacaaaagcagcattaactttgcaaaatgtagaaaggtactagatgcattaaaaataacttctacatttaataagaaaataaatatttcataagaatgcaacaaaaaacttaaagataagttgtataagaatggtccaaatgagaggcagatcctccaaattagaataggaagtgagtggacctcaaactaaatgaaatgaattttaagtagtagatggattgagtaagaagctggaggaaattaaggacatgatgtatacatagaaagcatacatttcttcatccgcccgcccatcaaaaaaaacaatgacaatcagaaacttaagggagaaagaaacatttcaaactttacaagaaagcatgcttcaaatataaagcaccctcagatgtggcatgattttgaacagttgctaggagtgtgagaaagggaattcatttgaacattgtcatgtggatcaaggctttaaagaaatagatgagaaaatctaattgtagcataaaactttgtttttcagtggacagtatttaaatagtcatgtgatataagtattggttttcagcttttagagtcaatccttggacaaagcagggaagaatgaattatgattacagaatagaatgcaaatgttagcagccttgaaaatgtacaagtgcagttaacaggttggaaggcagagagggaaggaaatgtacatggaatagtagyggtgctattgtcttcatgaaatagaatatggagaattttatctttagttgaattcgtcagaggtttaggtattagtttttgttttgttttgttttgtttgagactgactctcgttctgttgctcaggctggagtgcagtggcgcaatcttggctcactgcaacctctgcctcctgggttcaagcaattctcctgcctcagtctcctgagtagctgggcttacaagcacgccaccacgcccagctaatttttgtgtttttagtagagatggggtttcaccatgttggctaggctggtctcgaactcctgacctcgtgatccacccacctcggcctcccaaagtgctgggattacaggcatgagccaccacgcccagccttaggtattagattatgaaagtaaccaaggtcaccaaaagaggaggtaaaaatgtgatatagccaaattgagtggggaggaaagccagagacaacaaggggtcaacaaaaagtacccccagtcatcaagtcaagaaaaagtaagaagaacatgttttttaaaaatgtaggcaagtaccggaataactaaaaacaaacacatgtaaaagtttttggtctgggttggtgaactgagaaatgaaaaagagttattatgcccttgtgtagtgtttgatttttaaaaaatatgtgcatatattgctttgataaaacttatttttaaaagtatgtttatcaaaataaatagatattctaatcattggcacaaattcagtagaatatktaattggaaaaggatactattcataatagaaataaaatacccagcaataaaataatgagaaatgtatattgtaaagaaaactgtcaaattttattaaggacataacaggcaatataaacaaacaaatgttggataatactgttcaatactgtaaaaatgtcggtcctctccaaattacttactgaatatggtattataacaaaaggatttttgtataactcaaaaacataattttaaaatttatatcaaaaataaattctcaagaatagcttaattagttttgagaaagaagaacaagataagagatttgctctgctagataacagaacacattctaaagctattataactctaaaaaatgtagtattgatgcaggccaaacatatagatttagtggaactgattcgtgagtacataaagagataagattcacttgtctacaacrtgcaccttgacttatgatggggttacatccctaagttgcaaataatgtaagtgcaaaatggatttaatacacctaacctactgaacatcatagcttagtctagcctacctttaatgtgctgagaacacttaacattagcctacagttggtcagaatcatctaacataaagccgactgtrtaataaagtattgaatatctcatgtaatttattgaatactgcattgaaagtgaagaacaaaatgattgtgtgggtactcaaagtatgctttctactgaatgcatatcacttccatgttagctgaaaaatcctaagtcaaactctcataagtttgggacaatctgtatatgggatttggttttgactgaaggtagtgtttcaaatcagtaggagaaagatttgtactaagaaaattgaccatttggaaaaaataaggctagctcttgtaacctcatttcattcacaaaactaaattctacattgattaaagaactgaatatttaaaaataagtaaaagtgtgaggtctataaaatataaaatttaacagtcatatggaaaagatattagctagcatcataatcagaattttattttatcatttttttttaatagagatgggatctccctatgttgcccaagcttatcttgaactcctgggctcaagcggtctgcctgccttggcctcccaaagtgctgggattgcaggtgtgagctactgtgcctgactgtaatcagaatttattaattatatcagttacataaaattggaaaatataccagaaccaggtggaatactaaattgaaaattattttttaatcatttagggagatgtgaaccacagaaattatttgttaaattatttttaagagtatttagtttcactcattaaaaatttcattcccccttgaggtattttgaaatagaatatttaagggcattgactaaatgttagctctgcattacaagtctttaatgtttggtgttatcagaaaaaacagttatcaccatttactgagtaccatcgaccctttatttctttagtccagtgggtttttttcacattaacatcatatatttctttttaatcacttttatatatgcacataatgtcagcatgtcttcttagaaactatatcaagtaaatgtgggcctataaacataaaagatcaaagagtactgttgtcacacatgcttttagcaaaaaagataacccaggttcttttcacaaactattgtgtaataaagtctttccttttgtataagcatcatttttttttgttcttagaaatatattgttcacttgtctgttcttaacttgagaaaattcatctaggacattggcatctgaaaattcatagtatcaaaattttcgtgacatgattaatttcaccagcattattagattttagtttaatggtatcttcaccatttttccattatcttgttcagtcttttctagcatagttatgagtaattggtgaataataaaataattcctagggtaatgaaatagcaaatgtttcaggacgtaggaaaaataaaattgccaagattctttatcttaggcttgtaaaagggtctaacagggccatgtggtaattgcatatcctatttttttgcaaaaataaataaattttctctttgatattttaaagacctctaaaaagaataaaagtcataaaacatccattctgataaagagaactgctaaaaaacaaacacctgaagctaaaattgggtctggcagaccctggtgatggtatgctgaaggatgaccagcaggtggagctacatgaccaggagaggcataaaaggatcacccatctgtaaaaggaggaaaaacactttatgtttaaaattgtatactttagaggctggagtaagacaagaaataatttaaaagaaaaaatgccacagaataagaagaaagcaaaaaagatctcttcagagatatcttagggggaaraatacggaattgggaaggrgatatataccttgccaatagaagcaaaaatatttgttacttttttatttgaaaattattatataaatttgataaacaaagaaattttaacaaaaaactgtattttctactaaaatggcaacagtatttggtttctcttataaaatttgtttcttttagctgataaaggcccttcccttagacccaacttaaatactagcttgtatgtgaacctttctaccagtttacctatctgatttactaattatttgtaagaaacataattttctgcttcaaaactgaaatttatctttaaaaaaaacttctgtgcatcacatacctacatagaaaaatattattcatttattcacttatgacatgaagggtgataygattctatatcattggtcatgctaaaggaatgaaaattattctagaaataactttttatcctgctttctctgtctttatactcttaaaatatttttccctttaaatagacattctaaaaaggaatagacaagtattactaaaatattaggtcatgtgtagatgaaagcaaaaaaaatttgtaacaaaaatcagagtaagaaagggcagcattttaggagatcttgtcctctaaacactagctgaccctgaataattgataaaattcttggtaatcctaaaatgtggtttaccttattctatagtattaagtaaccattaaaaaaatgaatagtaacaattacagcaaagtaatgtgcacagattaagacaactcatttctctctttttttttaacttaaacatgacatgtttatagattctttaaaacttgatattttcaataaaaacaatttagtcaataaaggaaatttttcctcacaaattactatgtagaatgttgtatttcaaacatgttgctttttaagttaatacttcattagtttatccatatctgtaactatgcatagattaaagggaaaatgaamaacaaatagtaaaaccatcacttttccttgtgggcaatctgaatttgggcagttgataggaagatatattagttttctagggttgccataacaaactaccacaacctacatggcttagcataacagaaatacattctttcacagttctagagactaaagtccaaaattaaggctaggagtccaaaagcaaggtgtcaccagaaccatgctccctccaaaggcttagagtagaatcttcccttgcctctacctagcttctgggggctgcaagcaatcctcggtttccttggcttgtagctttatcattctactctctatctctgtcatcagtggtcttcttccttgtgtctctgtctccagatctccctctcaaggacaccagtcactagatttaaggttcaccctaatttagtattaatgtgctttagcttgatgatgtctacaaagacactatttcaaaatcaggtcacattcccagataccaggggttaggacctttttgggggacacaatttaactctcaacagaaattaatagtttacatttgtcatcatttcagccattgcagagtaattatcttacaatgcttcattgatttacttaaccagtatttattgttttcctactgtgtcccaggcactatactggatgttggaaaagatagacgtagtgcctgcccttgttggacacaaagtctaatgggaacatatagacagtatagcaaatgatacagcatgataagggataattcaatgtattatgagtgactgtttttgtaagaacagttgaggagcaccaaacccacagatgagggatgcaaatttataggaagttaaataagacaacttcagtgaaggcagtgttggaaagagaacttttgatttgttgatacctcagagagcagctgagatggagacgcaagaagtcttcagctcaacgcacttctgaggtagtaacagccaatatactagctttcattaacttgacactaattgctatgggctgcagtgggtctgagacagctaagaatgtggacttaaggtgggaaagtatggcagtgatgtgctaacaagagactcagctctctgagagagggaaagactcccattaatagcctttgccaatttcattggtataaatacgctcactatgatcaatctcaagctaccaaggatgatgcgactagagaaagggaagagttgtacaccatctgctctcgggagctggtgtgagcagccctcagcacgccactgagggagggagagaagggagtaaggaattgaggcaaggggagagaaagccaggtgttgagagctaatagaaagtgctttccaatattggctttgcattgtccttggaagggaattttgcagggagtgagtggggagatctgcatttccaatgaaacatcgttgtatacttatattttaatatttctttatgatgacttcttattttgaagccaaatagaagaaacttaatagtttatttttgccttacatttttcatgttaaatatattaaagaaaatgtattttagctaagggacagtagatgcaaatgtaataataaaatattatagccctctagaaataatgggcttatagaatttaatgaatattttaaacattttattaaaatattttaatgactcaaaacccacttttgtaatgtgaaaacaaaggataattttttcctcatatcaacctaaatgaactcttctacctttttttcttttcttttttttcttgatctctgtggctgcatgtgagtatccagctgtgccctgagctaacactgttacctatgcagtgattctggagttgggtagcttttccccctgatctcttatggaccccatctgttctaaagttccttgtttaaatgtaaaataccttccgtggcctagtggttttaattatgttactagctctgtggtctgatcatttaggagtttctttggcattcctcctggctggcttccagccatttctttgtttatactttttaccacaagcaaatctcatcatctccaaagatgatatctctgaaagtcctcagtttgtcacaccagtcacaagtatctgaaaagaggggaagaaaataatcaaatccttttccccaagtttgaaattcaggaattttatatatttttttggtaatgtcatgaatagtatagtgatttttaaatgtatagttgttttatatatgatatttttaaattcaggaataattcttgtgggaattataagatgtttttgacattataaaagtgggaataaaaaatattttagaagataaatatcctaaaccaagagttagaaaatttcataaggatttttcataagtttgttggtatgttttccatgtgtagtttcccatgcattttcttgttgggaaaatagcaccatgtatttttaattgccatttccatcatcagtcctatcttctccttccgcyattatgtatgtttattatggcctggataattggagtaagaaaaatgccacaggatataggtcccagctactcaggaggctgatatgggaggatcacttgagccaaggagatcaaggctccagcgaacctcagtcacaccactgcgttccagtctgggtgaagaagcaataccttgtctcaaaaaacaaaacaaaaaaaaacacacaaaaaaaccagactgttgcagttgttcaagcaaatgataaggtcttgcaccattgctttcctcatgactacccgctcacagttattatgtacttagtgtatgcaaggcactgttttaaataatttatcagtgttcgctcatttaattcttaaaacagcctgatatggcgggtactgttattacagatacttcggctgcagtggtttgacttaggatttttcgactttatgatggtgtgaaagctatacgcattcaatagaaaccatacttcagcaacagtattcaataaattacatgagatattcagcactttagtataaaacaagctttgtgttagataattttgtcaaactgtagcctgatgtaaatattctgagtacatttaagataggctaggttaagctatgatgtttggttggttagatgtaaatggaaattgacttaagatattttcaacttatggtgggtttattgggatgtagcattatcttaagttgaggagcacctgtatctcattttcacatgaggaaactgaatcagaatgatacttcccccaagtaacagaattagtaaacattgaagctaggatggaacccaggcagtctggcacagaatctatcactaaccagggtaagatttatccttcccagtgtcctccttgagaaatactgctttaagattgacaagataggaatggaaggaagttaggggtttaaggtacaatggaagttgaatcattaaggtacaatggaagttgaatcattcaacaattaagttgaacggatgttggacatatattatgatttactaaactgctgctcataggatgagggtcaagttcagttgtggatctgctgagtttgagctgtctgtagaacagcatcatggtgtgactgtatagacaatcggaaatctgaatctaaagctcaggagcaggaatcaagctctaaatatagattttggaaattatccataccctagtattaattgatgctgtgaggctgggtgaaatccctcagttaaggatactagaggctggaatattgggcaaggacagagggaaagcgtaggaagtgctaatattgtttttccctatttttacattttgtaaaatagattttcaatacatgatgaaactgggatgcagagactttaaaaagttcacatgaagcttttaagcacatataagcatttcattacagtgatttttatgttccttgatcatagtttacactagttcttttgctccagcstaataaatcactcagcacctgtaatataaaatgatattttctgtggtaaaattttagaaaaatgacataaacttgtcagtttgcraacactatagtgtttaccatgaattcatgacatcaatatttagtttatctggcagaatgtagaaaaatgtattaatcactagaaagtatgataattattatttaaatgttatatatgttgaaagaatcttaggacaaacaggtgaagtcttatggtattttgtgatatatataataatatttttgaaactgcttttgtttgttaataaaaatagaaattgcatggagaaattgcttggccaaaaatagatacaatgactgatccagatactcttgttttcagatttttttctcatgctgttttaattgtaaactgttatacaattgggttactaaaacccttgatgggttctagyaatcaccaactagtaagtcataaaacttttgtaacttactgtatttcagaattgttattcagattttccaaattattctttgtgagttatgtatgatgtcatgaaaacactgatttttgtgtttttcattcgtattttaaaatatttagttattctagttttataactttaacatcccattttaaagcaagacttaaaaaagttttttcgtaatagaatatacaccaaacacaaccttagtatttatcaaagaaaaacaaattcaagttagacatacttttttccatttttgaaattagcaaaaaagatttttatatgattatgttgctaaatggacacaaaatgctgttgtagtatacacgtatataatcactcttttggagagtaaattccacactgtaaagaaccttaaagtatttaaaatctttaaccaagcagttccatcgtgtgatacagaacttcaggaagtgaatgtgaaaaagtctttgccccaaggtattcatcctaggattgcttataatcaaaaaaatggaaagccacataattgaacaataataacatgtctactagaaagactatgcaaccattaaatgttctgttttcagattctaatatgtcttagaataatgtttataatataatcatcaacaaaatgcaacttacaaagttacacatttggtatgattacaactacattaaaaattcgtgtgtgtgtgtgtgtttatacacatatatacaaacgtgtatatttatatacacatatrtacaaacgtgtatatttatatacacatatgtacaaacgtgtatatttatatacacatatgtacaaacatgtatatacacatatgtacaaacgtgtatatttatatacacatatgtacaaacgtgtatatatacatgtatgtacaaacatgtatatttatatacatgtatgtacaaattgtatatttatatataaagggaatttaatgaaaaatgctaacattagtaagatatgtgctctggcagtgatttttattttttactcatgctttttttgtatttaactattaaaaataattacatgttttttgacgagaaaaatatttttaaaagagaagtatttctatagtttatagttttctgaaataggtttacataaaggcacataatgagacataaagttttttagcaaagaaaaataggcaaaatgtaaaataaattttgcctgttttcccatgcacacacattgaaaggaaacacaacaaaaatttcaaagcatgttggagaargccctaaggcatatgatgtctggtatttgaagaagtgcaggaaagagcaaaagagaggaatgggcaggggccatatctctcctcataggcaggtttagcatttttactttgtcctcaaagtagtggattttaaggcatggttagatttgcattttacgcatatcattcacaggtacctgtgagttgtgggaagcaggttttcctccactttagagataataaacctgaaactcccaagtccttagttaccttgctagtgagatttacagctaaaacttgaatctagacagtctctctcctaatctggtatctttttttgccattccttctgcctcaaatgatatgtaatttagtacctttatgtttttaaagggaataccatcagatcttttggtaaattagtaaatttagtgaaatttggtaagtattcytttaagcagatttagatcacatgtatagttcagtaatatagtaaataatggtatttctgtggaatgcttggtctactaatgttgctgtggtttatttaatcatttttctcaaaatctgatcttaatggcagctcattatatagacatagtcagtttttattgttaagaagttattccatttctgaataaggagttgtcagggaggtaagccaacaagtttagtgtcataacacctttgtgaaaatttgagtgtttcagtctctctatatgatgcttcatgcattagggctcataattagttcataaaagtagaattttgagaaaccttttctatacagttttgtctcactttttttttttcatttttatagtcacaraagatataatgagttataatatgtgataaaattagtggatcttcttcttctctggccttccaagtttcctattgtctgcattccagtatcctttcctattcytcattatgctaactagttttcctaacataggaaccaaacattcagttaatattttagatgccccttactattcaaactctcccttaatatctaaaattcaaaaactgaatagatgtggataataccatattttcttgttaaactaacttggtatcagactcttattatcttaattcaaaaggtgaaatgaattggatattcattgtacaactgctttctaatatctttcagtttcctcactcttattttcatcctgattttaggaagaaaaatcatcctgatttggtctatggaataaatggtaatattctttgaaagttcttatcagcaaattaatatcatgatagctttttttcagccatttagttcttaatgtgccttctttttcactcaagacatggtttgttttttctcatcagtagacagtatgtttttattatcctcattttccatcatcttgtaggcatttaagtgcagatttgatcacttatgtaacttttcagcaattattaaggctttaagaatttttttctattatagtctttcatttttttaaatttcatttttagaaagagggtcttacgctgttgcccaggctgcagtatagtggcccagtcatggctcactggagccttgacttcctgggctcaagctgtcctcctgcctcagccttctgagtagctaggacaacaggtgagcaacaccatgcttggctaatgttgccaaggctagtctcgagctcctggcctcaagcaatcctcctgtcttggcctcccaaagtactaagtgcctgagtcactgcacccagcctctattatggtcatttttgttaatcaaaaatttacattccattgctggcttattctttataagggcatgagagttaattaacgctgcaaatatcccagagactttatagatgaataatttatcattattatactatattatatctaaaacttgtattattttggaaaaagargaaagataggtctagagggaactggaaggaatctaaactctttggtgtcaatgtttaaactgctttcttgaaaagaaaacatattctctgaacaaagattcttgtaccaagtaaatcaatttacttttcacaagtaagagtaactaatcagggtcttttttattagcatctgagaacatattttcattccagaagtcttctcttcaccatattaaattatgtagttccttcatcctttccttagggaaagttaattttcaaccctgtatttgatcttgctgctattctgaatccactccagatgtccttgtcgctgtttgtgctatcaacctagaagcaaggaagtgctaggcatttgcattcattaagagggaactgataaaaatttgctattggattctgaatattataaaaraaatattaattgaaataaaaataatataaggaagttaagtagaaatttagcttatatgagtaatctaggaattttagtttgaaaattttctttgtaaaattgatacattacatacatattttaggggtacatgatacattcatataatcaaatcagggaaatttggatgtccattaccttaaatagttatcttttctgtacaccaggatctttttaattattctgttccagctattttgaaatgtataatatattaatgttaaccatrgtcatcctactgctctattgaacaccagctcttatttcttctatcaaactgtgttatttatacccattaatccacctctcttcattgccttctcccctctacttttctaacctctggtaaccaccagtctactctctactccctgtgtactgttggtgggaatgtaaattagtacaaccaccatggaagacagtttggaggttcctcaaaaaactaaatatagaactaccatatgatccaacaattccactactaggtatatatatctaaaagaaaggaaatcaatatattgaagagataatctgcactcccgtgtttattgcagtactacttacagtagctaaaatatggaatcaatctaagtgcccatcagtagattaagggataaagaaaatatggtatatatacatgatgcaatgttattcattcataaaaaaggaatgaaatcctgtcactggcagcaacatgagtggaactggagatcattatgttaagtgaaataagagcgacacggaaagacaaattttacatgttctcactcatatgtgggagctaaaaaaaatagataggaaatgttcttaccatccattcagataaatagaattccctgcaaaaggttgtgcccttaagaagtagaaacttttctgcatcatggaataatttatgtgttaattcatgtataacaataaaatattcaatatttattgaataatattcaatagattatcagcttttagtgataaaaatgtgtaaagtgcttggatttattgcctgaataaggtttagaatgggaatttttttacctctgtggtttgatgggtgaattctgaggtctgggcacaggaattgtggtgccaactctttatgtgacttactagaacaacttttcctaagactaaaatgacactgctggctgctattgtagccttttcttcttcagaaatatccctggctttctattgtgccttacatcatctctcagcattaccttagtctttgcattctagtgtgtcattggcaaatgcccttgccaatgccctcaccctatcttaagacttttgccttaaagtcaatgcctggacttatattagtrtaatgacagcagcattgtttatatttgtgtgttatgtcttttctcatrtcctttcacttttaacattttgatgttyttatatttaaggtatgtcttctgtaagtagcacataattgactttgttgtttgtttttttatccagtattctactttttttcttttagttggtgttttcgsaccatttatacttactataataactgatatatttaggtttgttttcaatttatcccatctgttttatgttcctttttctgttttattttgtttttttgtaggattaattaagtattttaaattattttaattttccagccctcccctgcccacatattggcttgttatttatacatccttttcatggtcatgttaaagattatgacaagcattttgggcacattattagtttaatataaattaaattaatgtaaattaactttaaataactttcatacctttgatgttattgttatatattttaattataagtatattgctacatttcaactttttgccttgtattatcaacatttatttagatttactcatatattcactgtgccttttgctcttcattcctttccacatttctgtatttcttgtctatgatatgacatttcttttcaagggtatttgccagtgaaagacatttttctgttgttatttgtttgaaaattcattattttaccttaacttttcaaacatcttttcaagtgaaattctagattgtcagttattttctttcagaaacttaaggatgtcattccatcattcctgttcagtgaccaactgttttaatgtcatttgtttgaaggcaatttgtccccttccccttccccttcccccagctgcttttaagattttctctttgactggttttcagcagttttactgcctgtccatatacatggttttctttgtacttattttgcttggggtttgtagatgttcttaaatctgtggattagtatctttcattagttttgtaaagttcttggcctttatcttatcagatattgcttctgccatattccatctctccctctctggtattccaattacattcatattagacctgtttcatcatgactcgcattctatttctataatctttttagtatttttctgtctttttgctcttcaagcttcaggcaaggtattttcttttcttttttctttttctttctttctttcttttttttttttgagacagagtctcactctgttgcccaggctggagtgcagtgtcacgatcttggctcactgcaacctctgcctctcaggttcaagcaattctcctgcctcaacctcctgagtagctgggtttaaaggcatgcatcaccacacccggctaagttttgtacttttagtagagactgggtttcaccatgttggccaggctggtctcaaactcctgacctcaagtgatctgcccaccttggcctcccaaagtgttgggattacaggcgtgagccatcgcacccagcccaggcaaggtattttctactgattctgtcatgagttacaccagatttatcttctgttgtgtctagattgctgttattgagttcttaatttcacttgttaaatgtttttaaattctagaacttccattttgatttttaaaaaaatagattctgttctttgttacaactttctgtcttgtcttcttgacatattaaccataattattttagcatctgtacctgataataccaataaccaaaccatttgtgagtttgtttcgattctttttttttcaattggtcttgtttgttaagtctggtagttttaaaatgaatccttatctttatatattaaaagttttagaatctctggattatctcatttttctccagagaggttttgccttgtcctctgatggccacaaagagtagtggctgactcaaggccgtgctgcgattttaagcctcctttgatctctggtttgtctctgttcttagagtgtagtatctcagggatccctatacagaccttgtagtatctagaacctttcttctctggtggtcactgaataccaatttttgtctcttgtacatcttgagactaccaaaacttctgtctgcttttcagggacattcttcttagcttcttgtcctcttgttctatacaaatgagtgtcagacttaccttttttttttttcacctcttttctcatcaagacttggcctttctttctttacctgagttctctgaataatatagtataatataatatttctttcttataaaagctctttctctcactcttcttaagatttcacctcagaatatgtgttagtttaaaattccagatgcacttttaaaatgtctttcttaaaaaatccacaatgaaaatgtatattattttcttatttttcttcctttttaggtcctcaagttctggctgcattggcagctaaaaactttaatttttatctctccagtcttccaagattgccaaagactcttggattctctacttcctggcagcagctatatccccaaattctcagcctcttgctttgtgccaagaataacaatggtagattccctcagagttacagtttgtagaattttggattacttccctgtggtttccttctctctaggatcttagcctttcattacttgattgttttggtaccttcaaatttattttattgggctttctagttgttcttggtgggagcattgctatgcccaaagcttctctggcataaccagaagttatggttaaatcttagtgttttagtcattttatttaaaagtgttaatgaacaagtaatgcatgcacacaataaaatttatacaaacaataataaaaagtcacttttcctcctgtattccagtcttatagtctttttctttggaggcaaagttgcagtttattatgtatctatctatctatatcatgtatacatatatacaggaatataatctaaataatatccaataatatccaaaagaaaggaaatcaatatattgaagagataatctgcactcctatgtttattgcagtactacttgcagtagctaaaatatggaatcaatccaagtgcccatcagtggattaagggataaagaaaatatggtatatatacatgatgcgtcttgtatattgcaatattattcattcataaaaaagaatgaaatcctgtcayttgcagcaacatgggtggaactggagatcattatgttaagtgaaataaggccgccacagaaagacgaattttacatgttctcactcatatgtgggagctaaaaaaaatagctttgatracgtagacaagaattgacagaatagaattgatgaagtagacaagaatacatatgtatacatgatatatgtatatccttcttgttatatttcaagttctatttataaaatatttcaaacatgctgaaaagaatagaggatataataaaaattgttgtacccacaactcaggtttaagaaaatgttaacattttaccatatttagattctttttagaggggggggctgaggaataaaatggtgtaatacacttcaatccctattttaaaaatctattttatttaacagttcttttttctatttagtttggttttcaggatttatccatgtttatatgtatagatctcccttgttcattttagttcacatatggcattcctttaattactcctctgccaacccccatttattttgttgttatttggttttgtttacataaatctgaacatattttactctatattctagactttatatttcttacaaaacctctttatgtttaaagtatgtgataccaagaaaatttactttatatcccctctcaatttgatggaaaactaaaaataaaacgtatatttggggacaagtgtatgagagtctttaatgtcatggtgatacattgaggcttgtatagaacatttggtgaattccagatatattgcaaatctttgatatgtctacctttggcatgtcccaagttttataaatagtgcatttaggaaaaattacaaattaccctgactcctgtttctttaccttaatacttccaatataatataacataacataatatataatgtaaatatttctccttaagaatttttttctcttattctycataagacttcacttaacagaatgtctgttaaattagcttaagtaatttagcttcagacaagctttttttcctttctttttattttaaattttaggtacattacaaatggcaacgtatggtagtctcttatttttcttccttttttaggtctgcaatattttgatagcattgtattcaaratttattgattcattttatgtgctttagcactttgctaagtattattgtggatattaatggaatataagacattatcttggcccacatggaggctaaaatttaattgaagagaaataaactgatcattagaccactaactgaagtgctaatgatgtgaagtgagatttggagtagaccataaaggatgatgaatatttgattttagaaagcaaagaggggaacatctttatgataccagctaggtgaagcttgaagagtttcaccattatgcagctgagggtacacatttgcgataatgggaaattaagtgaagtagcagcagagggtcatcaatagtccaggaagattagaattgatgaagtagacagtgagatgcccatatcaattgtaagtgagaggatgcaatcagtattttaggaagctgagtggatcagagcaagaggaaggaggtcaactagaaagcttttatggaaatttgggaaattcaacttagatatagccttccaaaaaatgcctatgcactttggcacagtaattgctatactaaggcttctgggaaaacacttcaaaatgtgtggtatctgaaggtacagagaactggatcaaagcaacattttaaagtaacttgtttttctttcatgtgtttttgccttgtggcaccttttccctccaaatcccagtgaatccagtggtggggaattttcctgcagtctgcaacatgagaacccagtgtggttgggttcccctgagttggaatatctgggagctcttagagtaggcacagattctttttttattttttgtagaaatgaggtcttgctttgttgcccaagctggtctcgaatgcctgacctctagtgatcctcctacctcggtcccccaaagtgctgggactacaagcatgaaccactgtcccaagccaaagcacagatccttaatcagagtatcccatagaactctgagagagttcatagataagcttctgggtttatgaattttctgaaattatattttaaattttggattatgtacattttctagacaagagtttcagattctgaaagaagtctctgaccctcccccctcccaaattaataattactgcttaaaagatttactttgtacaagtctcagtcctatctcttcagagactgcttgagccaagtagaaagaagataagtgattatattatgtcgacccatgtgcagttgccaatatttaatttagtagtttttggcctatgaaacatcaatttcatgtgatccaacctaatatagccttaaataactttgcatgcatttttaaaatgtaaagccattcattttagacatgtaggttttagttaagcagcatatattcaaatttgaatttaaatatatagatttatttcattaagacaattaaattctggttatatttcctcaatttctacattccataaatttaatgactttagttttatgtagtttcgggttatgcagtattttttgggagtatttctcttgtgtatttagtgtttctactctggtaaaacaggatagggaaatggtggaaagagaaatgaaagaggaacgaagaaggtatatgatatagtataaaaatagcaaatacgttcaaattattcattaacttccaatggtggttagtctctgcctggagctctttgataataagaattctcaggccctgtttggctcagggataaaaagaacattgatggatctgtcctcaatcacgtgaagtctgccatgagcacaggacaactgagtggcagagctcatgccatacgtttggtgttctgctaattacttcaatttaatcagaatttctttgttagccagagtattacatttcttcagaatgatggattatatgactttcataagtgtagttyggcatttgaaacttcgagtcaagaaaaccaaatttaactataagctatttcttggaagacttcagagaacmaacagcaattcaggtttttttctttgatttttgttttgtttgctgttttgtaattttcactatcwttgttttttaattaaggggaaaaaagaaacatatacttggaatgaggaaaccctttaaacctattcttttttttatatatagactgctttctgattccaaacagttcaacattttaagaaaagcaagatcttatataaaacacagaaagtttgaygaagtggtaagtataccggccttatagacataaatagctgattatcattttggggatggagaggagaaaaatagagcaaagtaggcaggccagggagctttcttgagccctcaaggaaggattgcatttcctgagtagctgctttagcagtggacagatctctcttatttcaactaatattatgggtaaatttttttttttttttttgagacagagtgtcgctgttgcccaggctggagtgcagtggcacaatctcagctcactgcaacctccgcctcccaggttcaagcaatcctcctgcctcagcctcctgagtagctgggattacaggcatgcgccacaacacccagctagtttttgtatttttagtagagatggggttttgccatgttggccaggctggtcttgaacttctgacatcaggtgatccacccgccttggcttcccaaagtgctgggattacaggcatgagccaccgcacccggcccacatttttttaggttagcattagaaataaactattaccattttttaaaatgagaaaatagatgccaagtttgtgtcacccttcttaatgtataatattttagaatactatatgtttgccacttggaattatctatacattattaaaagtctaatgattcatgttgaaattttgactcttccaaactcctatctcactgtttttcattaatttttctttgttaaatggtcatttaattttaaagtagaaaagaattctgttttcatttctaaaattgcctaaataattgccaatccgtgcatttctaatgctttttttgatgattttaaaatgataagctattcttctcctgtaaaatattaagctacttaatgatgttttataactgatttgagtaatctcatatgagaaaaaatataaatatggccattatcattatttgggacctatattagagagccttcatttcttttatgagttgtctgaatatcatttccacaaacacacatatacaacacaaatagtttacatttaaaatgccctttcttattaagattaaaaagttcattttattccaaatttttctcatactttaaaagaagatcctggaacaattaaaatctgttcttaatccatcatctacagttattcactaattttaatacaacagtttggctgttaggaatttaaaattttcctttctttaaaatgtaggttttcttattatttctgttagcaagttatatatgttttttctccataggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttwtaaaaggtgttagtaaagaagtgaaggtacgtttagaaaatgtgaggattcagatgatggtataaaatcactagtactgaatccagtgtaatgagtttataggatgtgcaagtcattgttctaagctaactcttgtttatctttcatttgcttttattgtattggatttttcctcagttatctctgtttcttcagttgagaaaaagatatattgataataatgatcctataacttaagaaagctataaagatagaggtgtaagtaatttaagtgctcctatgttatcaatggtgtcgaccttctgttttattttataactagcattttataagtattccatatctttctagtacaactggtcagaaaactacttcaaaacaatatgtttaattttatttgatattaaaagtttgggagctagagaacaataaaattatttgctcataatgtttcttcttaaatgatgtatacattttttaattacttaccttcttttaactttttgaagtttctcaaaatgcagatttctagacctctccaagtattcttattttaagaatttgttcctactttactatgctttcagtgaaaaaataaaaattaaaaaaatctctttaatgatacttcatattgctgagacaatataacagtatgtatatggttttactacattaaaacactttactcttttaaaatatatttctaactatcatttaccaggggcactatgccactttcatttcctttgcttcattctctttaatgattattaccatgttcaagttctctaaaaagtaatatatcctggtggtgtatttttaataatagtctgcagatatttccagtggtaacttttccaattttatattttattattctgtaatggaagtaaggccattagtgtttattataattttgtataatgctttaatgtatcttaaataatttcccccaagtaattttaattatttgagtgtatgtgaaattggctggaatgggaattgtatctaggcattcttagaactcataacagtgctagaagtagacataatttatgtttgcaaaaaaggaagctgaagctgaggaggattaagttacttattaaaggccactcagatagcatgtgagggactgagactttaatccagagcagtcgtgggycagagagtgccttttcatgtttatcttaatattcagtttattgagaaaaaaatatgtttttatattgatatgttaacaagatttcatagctgatagttcttcattattcrttaatctgataatacagccaatatttaattgagtgtatggtacaatgctagatgctggcaagggtatccaaycttttggctaccctaagccacattggaaaaagaataattgtcctggggcacacataaaatacactatcaacagctgatgagctttaaagctcattcaaagctgtcctggaccacaggtggcctgtgggctgcagactggacaagcttgctgtataggctatacaaagaaataaaagattcagattctaccatcaagaagcttagaatttaataaagtaggtaagagatgtacacatataaccaaccaccttaccaggcataagtcactatatctacactcgactacaaaagaaaactttaagatatgtaaagtgtttgggataataaaaagactatcatattttaaatatgagagctgactttagggtgacgataacaggaaaaagtaagtcttggtgggagtttaacagtcagaatctagggagaggttgagaattaaagcaaactgaatgatgtaaacagaggcagatttgggaagatgtactgttcttctgggttaatagtagtatgtattgagccccactgttccaggactgccctgggtgctttatgtaagttatttagttaggcttaacactaccctaaatttggtggttatgattctcataatatagatggagggatttaggctcagaaaaattacctgttttccacaaggacacatgggttttaaatgacagaacccatattttctgacacttgaattctttctctttctatgccatgcttccttcaaaataaatagttcactttgtatagaatgtgggaggtttgttcgagggactgataagaaataatacaatatagattaggccgaagtaatcmaaggcttcaaatgctggactacagcatttacactttatttagtgaggagtttggtacgttaataaaaaccagagaaatagaaccaggctatatatatatataatatatatacatatttatatatatatatgtattatatatatatwttttattatgctttaagttctagggtacatgtgcacaatgtgcaggtttgttacatatgtacacatgtgccatgtagtataagaaattggcttatgtgattgtggggcctagttaggcaagtcctaaattcacaggtcaggctgtcaggaaaggcagactgaactcgccagcaggagctgaagctgcactcaacaggtagaatttctcctttagggaacccttagttttgctcttaaaggttttcaacggattgaatgaggactacccagattatctaggataatctcctgtacttaaagtccctgacctttacmccatgcagactatcactagtgaattasattgatgaattctctgttttggcaggtgattgggaatagtgcatatgactgaatgaagtttctattgggtgggcaatagagagagaagcttagatagcttgtcacattggagcttgaatagataagacattgttccaaatgataattaagtcccataccttattatggattaaataggcttttgcgagttatccagagaactcaatcaacatttataaaattattcctaaaaggaaacatgttcagaattctgaacaagttacttgcaaacaaactttaaggccatagtcacttttaagttgagaattgcttaattgcagcaattccaggttatctaggtttttcctctcwaatatgctcctcaaataatagatttttttccttgtcttaatgcagctctttgattaatcatctagtagtataaccattgaaagaaagtaataggttttctttactttataaaatctcttttaaaacctatcaattaccattggtttggaagtgtttcaatgttttgtttgatttttcagaaaccaagccatctcctgccttgtagttttgtagctattggcattttagtagcrttttttctgctgattcaagcctgtccctggacatattatgtatatggtttgttgccactgccaatatggtatgcggttctaagagagtaagtaatgcatcttgctgccttgttttttcacttcattgacagttaaatctgtrtttaaaatgcagtagatttctgtaccataagtcatcaaatatatttataatactgtactttcaaacctccagtccctctcacttcatttataactgcataaatgttgagtaggatataaacattctttctgtygtacttttcccttttgacttcatctttatttttctgaagtggcagtgttcacttctttgtgtatcttttatagaaaaaaaatggaataaaagtaacgattaatattgatcatactatgcctagactaacttgcattttgaacttgtgtcatcatctcagattccaatatatcttcatatttgacaaagatatttgcatgttttatttccatacattttgactcctcctttcctagcgattgtrtagatctagataaattaaactttgtagttaaatctaatacggttatatttacacacagagattagtctrtatttttcacatgtgctgtggttctacctgtaagtgcttcctcacaggytgtacttaaaatagagtgtattgttaacattgtagaaaacattagaagtaaggctctttggtgagtttcaaacacttttaataaaaccactagaagggagtactagttcatgctcactggcagctggagtcatgttgcagatcttattggtttctatttttacaccagtaatctataatttaaacttagtcatggatatcaaagtattttctgagcaaaccagacccctaaagtcaatgaaagaatgagagcctattataataagggtatccccaaggttggcttaacatgtgcatcgtgacactatgcataattttattctaatttttcttaactttagctttgactgcttcttccttcttttaaaacatgatgtattaaaaatatttcrgagttggctgggtgcaagggctcacgcctgtaatcccagcactttgggaggccaaggcaggtggatcacttgaggtcaggagttcgagaccagcctgaccaacatggcaaaatgtttctactaaaaatacaaaaattagctgggcatggtggtatgcacctgtaattccagctactcaggaggctgaggcatgagaattgcttgaacccaggaggtggaggttgcagtgagccaagattgcaccactgcactccagcctgagcgacagagtgagactctgtctcaaaaaaaaaattaacttaaaaatatcaaaaattaatattaatattaaaatgcttaaaatattaactataaggcaaaaagacactgatcaaataacatattgttacctctccatttgaaaggaatagggttgttgcatacgcatatttaactcagatttttaaaaatgtcatttagtctggtttttaaacttttagaacaaaaggttttgtctttgcagaaaattgtatctagtacagaacccctcctgaattattaaatgtcctaattatgaagaaaacatatatatttaaattttaagggaaaacatgattttgaaagtatgttgtgtcctatctttatctttttgatagattgtataggaaaaagacataaaaattcacagtcttctaaatgattttacaaaatcatctgttgatcctctgtgcttattcattgttaagaataaaagaaacattccccttttgactggtgttagcttttctttcctacatggcaccttcctcattttgatgaaattctgcagctgttgctttcagtcagagaaaggtcataaaccaaatgatactgaccttctaaaattacctacttaataatgcactacaaatgttaactttttttcctagtgatgaaatgtaaaaagtactcaagtatgtaatacatttttgatggttatgagttcacttgattaccgttagtgtacaattagtgacatcttaaattgggtttggaaaaggttatttagctcagttagaaaatgtaattaagatttttctctaactagattaggaaaccctacctttatttcattaagatttaaatataggattacttgggtgaattttaaaaaatttttcagtttatatgcatttggattcattgtgttttatattgatgttgtatctgtaattgtatgaatccgtgtttaaactaagatcaaacaagattcatttattgtcattaatgcttataaaaaccaagcaaacttttgtgatcattttcttttttttttttttgagacagcgtttcgctcttgttgtccgggctggagtgcaatggcatgatctcagctgactgcaacctccacctcccaggttcaagctattctcctgtctcagcctcctgagtagctgggattacaggcatgtgccatcacgcctggctaattttgtatttttagtgagatggggtttcaccatgttggccaggctggtctcaaacttgtgacctcaggtgatccgccctcttcagcctcccaaagtgctgggattacaggcctgagccactgcacctggctgatcgttttcaaattaattcagaaattacattttccctaaaatacttctagattaaaaaaaaataggtaaataaagcccttgaaacaaatccgttagagcttattttagtttttgaataatctataaatggaaaattmtstagtgttttagctttgtgcaaagtttgtattgttatastatgtatgacctaactttaaaattcaatcagtctttttatttgaaacagatttcaagttattcaggaccttgttgtatcagtgttgacctatcctctgagccattttgttgggtacctgttagcctttaccctgggaattgaagtattagtaagtaacttaccagattacaacatttgcaartttcttttatatatttgtaactagtattaaatgaccttatttttcattccttctttggaatgcattactaggttctcagttttttctaccgctatatgcttaccgctggacttactgcctttgcagcttggccatttctcactcggctrtggactcgagcaaaggtatgagtactcattttgacataggacagattagtaactactttgttttgacacatgtgtaactcaaggaactgtttatttttaaagaaaagggtagaatgtgttcttacataaaagagcctagtcatattgataggaggactgacattacctktaaggtttcagtaattcacttagactttcacatcaaaatgggccagttatgtggtaattgaaatgctatataagttgtactgatatgtccatctctgaagcatttcctggatttgtttagcttcaaatatcttgataatggaccaggcaaggagtcgtccagagcagcacagcccagtggcttaggggtctgcactctgtgagtcacaggaaacacctccctcgttaccctgagccactcagttttttttttttctggataagtatgtatttattatagattattaaaaatayagtcagtcttgattttcttccttcagctacatagggaattacaatgtgcttctacaaagaatgcwcttatatttccactttgatactttttgatagaagtagcaggaagatatcttctttctactctgagaatttattaaaaaatcttcaatgaatgggattatmgatcttttaatttgtgagggatcttaatctaattacaaaagtagttttacttattttccttctgggctcagttgtttggtgattattgtaggccaccttttttatagatgtcttcatcaatatatggtctaacctaaattgaatgaagcactttatgcaggtttaaatactggttattttatttacttgtcatggacctggtactacttatattttaacttctctgagctctgtttcatcatctgatgtattgggaatgataatacctgcctcttgaggttattgtgagaattaaatgagaaagtgctcatattatacctaatactatacctgctatgcaacaggtccttcacaaatagtaactattactttttaaagtagttagctgttgattctgctagaaagtatttgaaaaataaaataataaacagctgtaaggctttgcattttccttttaccttcacagtcatatagtctgtgaaacactaatgatagttttctataccatatttgtctaaagataacttttttcttgattttagatgacctcactgagttggactttcttctctttgctcctggcagtgttcccactgatgccggttgtaggtcgaaagccagacatctctctagtgtatgaataatattgtattttattctattttcaatacacttttttttcctcaattaacactgtaaaatttgaacctaatcttggtcaagaatataaaatcatgtgaactaacgggaatttaaaataccaatatcaaaccattagtcatgattttggcctaggttctaagagtcattaaacctcctagtaggtgctttcgggctttcataatgaaattgtgccactgataacttaaaatcccgcccatttttttttgtttaagtctagaaggttttctttcttttatgcttggaggaatcagtaaaagttttagtttcatgtgaaaaaacattctgttgccaaaacaaaaatgtctcaaagctactgtgttagccctctttgctttaatcatgtccacactaaaatgtcatgtaaaaattaaattttctgctattctaaattgaatgtaaagatctccatgggaggaaactctattcaccttgccagctttcccatgtttaaccactcaaattgtttgaaaattcttctgcatatcttacctaaattccttactgtgctgctatatttatttctcttcaatagacctaaataaatttataaaataactggttacctttgcttttaactgcactttattgtcaagtaaattatgggctgtttgagtgtgcatatgatcattatttcatttaacatttcctctcttattgtctaatcatgggaattagaaattaaatcatctttgttactttcttcagaatgctataagcattttttaaaacattctaaccaagtctgtaatggataatggtatatatttttaaatcaaggaagattaactaaatactattttgtaaaaatatgtgctgatttatgagattctatacattttctcctatttgtatgagaataccaatatgcaatagaccaggaaatatcccaggaagtcactttattagcagagctcaaaataattgtattgaattctaacaccatactatctaagccatactttattagagtgttactaggtaaaaacattttgcaactgtcataacctataaatagtatatgacaaaatgaattccaatattttcatttatttcttgcttcagatagctctgtaagctcttgtattgtttctataaagcccctttccttccctttgtcagtctctgcctatcagtcctgctcaagcagtattgccatagttgagcagaatttatcatatgctaaaagggaaggaaattgtataaatttgccacttgcgtattctactaaagatgaatgtggkaagcaaataaacttgttaaaatatgagaaatctaatttatattttagaaaattatattgtttccctctaaatttaaattgctcagtgactttaagtttatcctactagctatatttgcaacttatttattttgattcctggttcatggggaaatttctactctccttttcatctgtcacagcatctcccttcttcagaaaatcacaaagatgtgattttgtgaaacatttaaggatacaattaaaggaaaaagcaaacgtgtacaacatggttgtgatgtctgttactccagtgttctaaagtaaaaacatatttgccaataagtttagataccaaattattttaaaaattaagaaagagaaaaaaagcaaagaatcttgatcatatgtgactattttttcctaaattttaatgataatccatgttgaatatatgattacctttctccttaggattctcaaagagtgtatttgaagcatcacaaccaaccatcaagcatttttctggggattcctgctttgcattcttcttaggtgtccagctctgctttttgctctttcttttttctcttcaaccaattccttttctcttagttctatttgggttctggatttcatcctcagcataattctggctgtgctatgttattcagatgttaaggaggtgagaaagagctcaacaatagggcaccatttccttggtatcagtcacctttgactttaggaaacatactatacctggtgtgtttccttactgttatttcattactgtacaaatgcctcacctgcatgccacccatgtgaccactgcctaccccttccctcagccaggagcagctgaggaaaataccaaggtctgtcacagaagggagctgtttttcctgctagaaataatgtgggttatatatgtagatactttttgcatgagtaagtttcataatcacaaaatacatgttgtagatactgataatatacttgtttagctatcttttatattgtaaatttttgtaaatttgcccaattcaggctaaatattatagtatttgatatgcctaaaatttttttaaattaaattatagaagcaaggtagagatacttagaaaattgtggggagaggttacaaataaccccatccagcagtatctttatcctaagattaaaagttttcttaaaatcttaaaacttaaaagttttcttaaaaatctgaaaatgtacccattttgctacttcctcttgattaagccaaatgactgagaggttctgtattagagtaagatgtctcatatttccatctgatatgtgttcgtaaatatctgaagaaaatttaaaattaattgtatttcaaaacaggatgggtgcaggcttgctggttcttctgttatccctgtgtgttgtaacatctctcatgaaaagaaaagatagctttataaaggaagagctattggtacatctrttacaggtcagttacagattttcaatactatgttatactaatgatatactgaaatgtgtcttatggttatatttaattatgttcataaaatgccattacctttatgctacttagtatctgccagctgagaagaaagctttcatttaagatgctacatggaaatgtgttctttaagaggtatgaaatagcaaaaggtccataagaggcagcccagtgatgcctgaagagcagaggttatggaaactgtattgaccaaaaagttgaactgaaaagggcttcatctggactgagattctacattgtcctcatttgggtcagggaaggtcacttccttgaagtgaaagcagcctggggtatgtttatattaagaatagccagtttaagacttcagttaatgtcccaggtgaaaataaacttcagcatggttggtggctttggtgtggtgaaaataactttgaacttgatgtttcaaaattgagtcagttcccagttacgctgcatactagatgggtactttttagtaatttgatttcagtttgtgtggtttttttgttttttgtatgtgtttttttgaaatgaggtcttactcctgtcacccagggtggagtgcagtggcacaatctcagctcaatgcaacccctgccttccaggttcaagtgattctcctgcctcagcttcttgagtagctgggattacaggcgagagccactacgcctggctaatgttgtatatttagtagagtcagggtttcaccacgttggccaggctggtcttgaactcctgacctcaggtgatccacccaccccggcctcccaaagtcctgggattacaggcgtgagccaccacacagccacttcagtttgtttttaatctgtagagataatatctgatagggttgtgacagagatcatatcatgtgatagtctataaaatgacaactttttccatagataacgatggaaaacatctgtttttctttttaactgaataaataaataaataaccacgtctagaccacacacaaaaagcaaaactcatatgagtgttctcaaaaaatttcctcaagaatagagcttggatagtagatggtatttccaagaacactctgaaataaaaatatacaacatttgaaggattacatcacaagttaaattcatttttggagagcaacagggaacttataaaaagagaagaattttttgtcaaaaatcctgtcaagccattggaacatatgtttccttttaaatggtactctgactggctttacacttaagccatagtagctttgacagaatgtatccagaataataagtactttgacagaagtgaatgtttctgaatctctctctagggtagccaagaatatcatgctaacattcttacgtgctttgttagacatacccctgagtattaggtaactctgttacaaaattcatttttgcattaggtttattaacttgcatcagttcctgtactgtccactgtatttcattgattccaagatacacattttttccacattttaatgtctcagaaataagaatgtcttacattcttgctagttagagtctttcactaccttctctttttttaacctatttcatctttgtctttaggtgctgagcacagtgctctccatgtatgttgtgtatagcactcagagtagtytrctcaggaagcaaggactgcctctcatgaatcaaattattagctgggcaacattaggtaagaggccactcaaaccaggtgaggtaatttgacatcaacttagttattttaaaatgatctgtttatgtctgtatcattgttattgaaagaaataattttattgcaggaaaataataataactggctattatttctatctcttgctggaatttaacaaagagaatttttatgttcatgcatgtgttaaraagataatttgatagaatatttatgagctgataataaagctatgtatttattaacatctcataagatttgactaagtgattccaaaagagataagggtgaagaggatcttatgcctcattttcatgccaattcataaattctctgttcttacacagggactgggaaatgtttaaattttatctgtttcccttcctgaaaataacatcgactagtataccttacatattttttaaagctagttagacatttgaaagcatatttttctatgtagtcctcttaattaggaatgttggaatatatgtgtgaagcaaacatgtaatttaaggacttaggttttcccttccagttggaagacaagagcaagttttgagctcaagttttttgttcagaaaagacactttgtaatgcctgtgaataatttgacatatgctttaacttttacatcttttgatgatttttgttgtttgggtcatgggggcccacccctcatgaatggctgtactaacttacattcccaccaacaatgtacaaaggttcccccttcyccacatcattgccagcatctgctattttttatctttttgataatagcaattctaactggggtgagatgatatctcattgtggttttgatttgcatttctttgaagattagtgatagtgaatatttcttcatatacctgttggccatttgaatgtcttcttttgagaaatgtctactcagatcatttgcccattttttagttggattaataggttttttgctgttgaattgtttgtactttttatatattttggttattaattccttgtcagatgggtagtttgcaaatattttctcccattctgtaggttgtctcttcactccgttgatggtttcctttgctatgcagaagctttttagcttgatataatccmctttgtctacttttgcttttgttgcctgtgcttttgaggtcttacccaaaatgtctttgtcagactactgtcctgaagtgttttccaaatgttttcttctagtactttatggtttcaggtcttacatttaagcctttaatccattttgagttgatttcttttttatgtggtaagagataagtgtcttgttttattgttttgaaaatggatattccattttcctagcacygtttattggagagacagtcctttcctcaatgtatgttcttggtgcctttgtctaaatgagttggctataaatatgtggatttatttctgggttctctattctgttccattcatctatgtgtctgtttctatgccagtaccatgctgtttgggttactatagctttgtagtttactttgaaatcatgccttcagcctgacttcatgatgcctccagctttgttctttttttaaaagcttaagattgctttggctattcagagtcttttgtgggcccacatgaattttaggattttttctatttctgtgaaggatgtcataatttttgttttatataygttgtttgaagcaaaatattcataactattacattatcattgtggaatgttacttttaacatcacaaagtgttcttctttgctttattgattgtttttggtctaaagtatactttggtatcaggattgcaactctagatttcgtgctgtttccatttgcctttatttttagcctttttgaatcactgtgttttaagwttagttcctgtattctgcgtagagttaggttttgctttatatgccaattcgacaattttttttcttttaactaaaaaggtgagttgagctcattcacatttactaacatgactcgtaggcttgttctcaagaagcatataaaacactgcataatgtgtaggtgtgctctactacaacaaattgaagattctgtcaagaagattctgtcaaatcttatgttgtagcagagcacacttgtacattatgcagtgttttatatgcttctttctctatttggagtatcctatatgattttatttattgtccttattgatttgattattgttttggaatggtgaggaggagattcagaatcagtttactgctattgttcaccaaacatgaaagtttctctgggcatgtattttaaacaagatctttcctccttgggattggtagagctaggttctagaggatacctacaaaatgatgtaagacatgaaattgttaactcataggtaagtcatcagtatctccaaaggtctcttttaggcacagatacaccatggtctagctttaatgagcatttttgcttaatatgctatgatctccaaatggatggtatattttgaaattggttctacttatgtcatttagaatagagactcttatttcccctttattaccttatcaatcatttagacaaaagtaaaacaaggacagaaaatgtgtacagttttacagaagaggtctcatttgaactgacttttattatttgctttttatttttttatttcttaacaaccaccgtatgtccaacagattaactgacttttaaaatcagacatattgaaatgttattccttccagttaaaatatgtatcagtttattatgattggagctacacatctggaaaaaaagtcagaagctactcatctaagggtattaaaaaatgtaacttcatagtcttaaatcttgcagtgacttgactttaggtgaaattgacattacatgtaacttaatttagaagatgttgactaataataataaccacagttaacagttactaagcactatgtgctaggcactatgctcagggaacattgtataggtgaaattgtatttaatcctcacaactttttaatgttatctctatttgacaggtgggtaaatttctgcttggatcagttaatgaacttgccctatagtttaaacagttagtaagtgattcagccgggatttcatcccaacttgtctatcttcaacctctagagcactagggggattagaaagttatgcacatttccttcccagaatagagatggaggagtttatgttttgccaccccacccacttcatctgcccttyctccacttgggtagttgcttttattatcccgggggagagtcgatacatctctcatgcatggtgaagtcattcctgtttctcttttccaaggggcatactgcaactgtcagtgcatactttacggtgggaaaacttggagaaggaatgggttaggaaaaaatcagtttctgaggagtaagttgtctttgaactaagatataaatgcctaattaagcaaagagtgctaaatcttgagtaatacttttatttcattaraaaataattcatttttgggtatatacccagtaatgggatggctgggtcaaatggtatttctagttctagatccctgaggaatcgccacactgacttccacaatrgttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttygcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaacatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaatatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggagggggaagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaagaaaataattcatttttgagttaatattattatagttatctgggctgaatataaattgagaaaatatgggcgtagttaaaaaaatgaaatgtaatgttaattaaaaatgtgaggcttgactgtgattaggggaaatgtagcctcatgttcaaggtcacaaaacaataaatgccataaatgatactagattattcagagcttctacagtaacttttttttttaagatggagtttcactcttgtcacccaggctggagtgcagtggtgcaatctcggctcactgcaacctctgcctcccgggttcaagcgattctcctacctcagcctcctgagtagctgggattacaggcgcctgccaccacacccagctaatttttgtatttttagtagagacggggttttatcatgttggcaaggctggtctcgaactcctgacctcaggtgatctgcccacctcggcctcccaaagtgctgagattacaggtgtgagccaccacgcccggccctacgctaacattttttttgtgtctcttatactgacagatgacctgttctgtttcattgcagcctcttccttggttgtgccactactgagttctccagttctctttcagcgattgttcagcatacttctttcattgatgtcaacctacctacttctaagcacagggtataaactttttaacaatttaattttatagcagcaagttttaaatgatatattgatattttctctattagtatttaacttctggaaataaaaaatgttttctaaatcttgagggatacattataaatattttcttctctatgagaactgtatctgacttgatctgtaatcttctgttttctgttttttaaatccatttcatgatattgcttgctgtctttgtctttctcttttctgaagttgctaaaataccatttaactataatgttaaaaaattctgattgtggaagaattttgtctcattgatttttatttttattgcattccttatattgattttaaattatgctttgatttgtccattcttctttgaatatagtattttttaatcttacatatctcacagttcagatattcatttgattcagagaaccttcagaatattttcccaaaacttttaaagatttttatttaagattgaaattttcttrccaaaacaaaacaaaaaatcagcagcttgacttggggtaaatcccaaagcattttctagaactcagtgaagacagggatatactctgtccattaactttgaagaattcttttcttgcttttgaattttgtccttacttaaatctttatgagggtaagaaatgtgtacattataacaaacaatgactagaacaaacagtgaataaacaccactcataaacagtttgaattttggcccaaatacagaatcttgattgaagttagactaaacctagggattcaccattatgctatgagattattcacagttcaaatgattttgtaaagccatttggggtctaaggctcaggttctcccttttggaaacttagttgtcatagttcaaaattagagagatgttctcaaagtcttcccacagtagactctaacaccctaagtgacctagaccccaggagttcttgtagtctcatataagagatgatccagtggggccctaaacctttttttcaccaaagctgtctatcttcttttgtttcccttccccctgcctaaccagatgtgggccacagctctgaagatgtgatatgaatgtcatggaaatttttaccagttacctaataagattataagataggcttcctttgagatttagacctttgaaatataactttaaaataaaactggaaatttatgagcatctgttattcaagagtgatgaacatcatgaaagcttaaaatctttcacagttttcaccctttattagtgaaatttcaggataaataattttgttaaattagaatctatgagagtaaaaatgaattcaactatgcacaagtttttaatctatataaggaagcagaagttaaaataatttctattctaacctaccatttcagggagacttgtgagttttattaagagatcacacccagargttgacttaaggaaataaatgtttgaaagcgtccagaaatatgtactaaattctgtacagtctcttaataggcctttctcttttttgaactttcaaattctaaagcaataaacagatttaaagggatgtgtagttgattaaaaatgtaaacaaatataaaaatagatctgatttgctggattagaaaaggagagaaagaagcaaggataattgaagtttaattttgaatgaaaaactatttcataatgtagcattagttaatcatgtaacttacataggggataaatattttaaatcatcaatttaatagtcataggagatgcccaaacaaattatcataataagcataatcataatcataacttattttaagaaaatctaaaaagtgaaaatttatacctaaaatcagaataataaggcactatataaccttgttaatgaattcattaagagatacattattcaacatcagaaagtatatctagctttgccaaaaaaaattaaaaagagtatcttgaaatagcacagttcagtcatttcaatcagtacatcttctcagtgtcaaatcagttttgcaaaacacagtccacctgttatgattcagcctcaccattttggatgacctggagggttctctacgtaaattagtgaatattcagaattacagagtatttaaaagaaatgtagttatattataatatagaaatatagcagcagtaatcctaaattcttacaatgcatccttgatttattgaataaagaagattcatttttaatcagcacttaattatttttatgcaaatggagctattgtaatacttgaaaatagtttgttctcttggttaaagttggttaaacatttccctttgaaattttctttgcattattcctttgcttagcaaactgtaatacaaagctaaatgccttgtctgccctattcaattttcacagagaccaaaccagcagatcctaatttagtaagttttcattatgttctccctgagccggtgatgacatttcattgatatttcagtttattaatgcagatatacagactttatatgaactattgattgttttaagagataaagtcccataggaagattatctttatctggtttattcatctccattttacaaaagaaagtgatcataatgtatagtttttgaaaggaaataaattctactatttgtagaactatgacatttatgtttttaaatattaggaaacagtaacttcatatataacttcaaatctttaaaaaaatgacggttgccttttgttcagagtatgcaccttaattcaattaatcaacagttgttttttctttcatatctccagtgtccagagcactatgcaatcacacagagagaaccattagtgtactgctagtgtacaatagagttataagctgctataaaataagaactatattttacagtgttaggcaattacaaaatcaaacaattaagttactgtgagttaatgaagttgtgaattgtatgaaatgaagactgactagagaaagagcttgaataggaaagctgagttagtgccatcaatgatgttgaactgaactttaaagaaaggccagggatacaagcattgtaaatatttgtttttcaatttttaaaaaatcattggaaaaatagtgtcatcacattatcgaaagtaggaataagggataaaatcatgtattaactctactcttgttaatgttctggtatatttctttctggtgttacccccgtatttgtctttttaacatagaattaatcacagtacatgttctattttggatctttttttctaattaacattatttcagaagcattttctaggtggctcttaggctttctagccaccattttaatagatatttaatatttcatgatatggattttgtttcaactttttattatcacagataatattttgagttatgtttttatgcataagctttttcatagtctagattatttcctttgttcacttctcatatagtgtatttgggccattgggtgtgaactttctttttttaacttgtaattgtcttaagaacagtgccaatgtataatatctacaacaaactatatatgaggggtactatttcatcatatctgtaacaaatatgtaacagtatttggtatttccatttttaaataagaatatcaaatgttatattaataggtcaaaagtggcactgctttgtacagttttctgtacttgttttactcatgatattttctcatgtgtgtaggtatctgttcatatccctgggccttctaagtcttatatatcaagtgatttgtgtatgcttyctgaaacctgaatctttccttctgcccagtcttcagtgttataattttataatttgtaatagcgtttaaagtgtttggttttttttgctttcttatctttaggaaatagtrgcgtatgctgtagagttcagtagttgaaagactcaaaaaggaaataaggctttgttttgttttgtaacttctgattagataaataactcactcagcaaatatttgtgagctgggccagcagtggtaatgagacagacagacttggttttcaaagattttataaagtaataatagacgcttacaggtagacatgtgattaagatggtgtaagtactataatagagcatttagggattatgaaggtggaacatttaccccagacaaagcggaaactgtttagaaaaggcttctatcactgtgttgtctcatgagcatttcttctttgtttttgtgtccattttacactccagcctgtaggtgtaccacacatttaatcattccccggtggacatgtaggttgttttctgtttccygcttctgtaaacaatattacaacagatatctttataatggaaattgtagcacatgtctgcttattttctcagggtaaatttttagaaatggccttattgcattatagtatatgaatatttttgagattcttaatacatagtatcagatggtcttccagaaagtgtatattcctatagagagcatatgagagttcctttttcatcacattcttgtcaacactgttttgtttttgagacagaatctcacactgtaacctgggtgggagtgcagtggcgtgatctcagcttactgcaacctctgcctcccgggttcacgtgattctcctgcctcagcctcccgagttagctgggcaggcgcacaccaccacacccggctaattttttgtatttttagtagagacagggtttcactatgctggccagactggtctcgactcctgacctcgggatctgcctgctccggcctgccaaagtgctgggattacaggcatgaaccaccacgcctggccaacactgttgttttaatattggcaaatatgatatatcaccattgttttcatttccatatgttatcartaaggtcaaacataattttcgtgtttgtgttcttgttgcgcccatttttttgaaaatttagagtgttccttttcctcttctatgtatgttaataattttacctcaagaattatctttttacctttgtcttcatgccttctttctcttttatgtatatctgtcatttgctttatgaatggcttttatatatttctattattttaaacacataattatctcaagatttcacatcactcaaaaaagatgatgttggagttaaaatttaaatattactttcctactttcttcttaagttttgtaatattgtgacttagaagtattatcaaattgttttaattttgagaaagacctcagtgtaaatttgcatttttacttattttactgtttttttcttttcatttctacctttccccacctgttaggtatgaagctctctttccactagtgttgtcttgtttgatgtttgtctggataaacatagaacaagaaactctacaacaatctggtgtttgctgtaaacaaaaggtagctggtcaaagtcatttttgtttttatttgagactattagtctctatcctataaggaagttgcaatattatttcaaaaattctttctacttaaaattttagtgttaaaagttttagttgtttggcattaataattaagttaaacttaataatagataaggaagattttttacttatcacagaaaagcacaattttgttgttgtataggttgggcttttcttagtgattacttgaggatcattgatttaaaaaastcaatataagtgaaggaatacagaaaagaatgctttttatcttattttcttcatatttcacatccaatttttccttccgtcaatttatcttggaagaattttaatgttgtcacaagtcaatttatgaattttattataaggtgacatttacgtttctattgttgtttttcactttctggtcatcctaatccaaattgcttattctgctgccttaatgattgtggcctcagtccaaatcttagattgtgtatgcaacacataatactttgagttggctaaaatccaaccaatttttaaggatacctttatcatggtgggctacagagttaaattgatgtttcttgtctatatttagagctgatggtaattctgagaaattggtgatagaatatttgcagttttactaaggtcggataaaatgaatattacagaaaatactttcatagttgatccatcgttatatggctccagttgagtttgtagattgttattgataattcagaatgattaatttcaataaagaagaaactttattgaggcatatttaataattactggttttaaacttttagtccttgaatattaaaataatacatgaaaagcagttttgagcagattcatgtaaatactcagagattagccttaatgttaaatattttgtcaggctgaggattattgtgttactttttaaattctatgtttttaactaaaagcaaatgtatttcattctagaaaagagtattaaaacatcccaagaacttactagaaaattacatgggaagtaggagtggggaaagtctacctttaaattcacccattagtgttctatttgtggagggtgattaagcaagagtgcactcaccttgttggattgagtggctttctgttctaccaaagacaggactatgttgcttttttatagaaagaaaatttctctgcaaatagaattaatagagggacaaataaacaaacatttaattttaccatgtcttttaatatgataccatatctaggtttaagatgatcaggacactctgagaaattagtctttgaagagggaagaattatatagggattttaaaatgaagcatttatataagataagaaaaaactcaattctcacttttattacacatatagcaacastacaactgtgttctatatattattagcaacatattttaccttttggcacattttattaaggtgtaattaaaccctagggaaagatttattgtttattgtttattgtttatttttttgtcagcacagggcatgtttctagccattgtaacttagccattgtaagtttgccttcaaatatagaaataagccaactgttattgtgcattaatatttttcttattatctcacagctcaccagtatccagttctcttataatactgatataactcagtttcgacagctatatctggatgacatccgtagggcctttttccttgtatcctttgtggagactttggtttaaagagctgcaactcccacttaatggagtaagaagacatggaaggtgtttctgcccatcacttaatagtggtgttaagtactttaacctccctgaactatagttttctcatgtaattcacattaaaaatttttttgaactatagaaaagtataaataattwtatgtatgtatatatatatattcctgctattcagatattagccattagtactttgtcacatatgttttttaaaaatgtgtttttaagaagttaaaacattagagctaaagccaaagtctttcaactcccgacttcaatcgaatttctcacatcctggaagaaaccacaattatgagttcatatctttttatgtgcattttattctgaactcacattacataacatctgtctcacagaggtttttggatcacatcagaggcaatgttgtgaaagttgttagtagtagaagtttgaaagacagtatggcagaggaaagtcttagtttggaaaggctgactgactagctgcaagaaatcatagggatgtatttcctttattttattttattcagctttattgaagtataattgacaaaaattgtatatatttaaggtgtatattttgatgttttgatatatgtatacattgtaaaatgatcaccacaatcaagctaattatcatatcgattgcctcacgtacttactgctttttctttctttctgtttttgcagtgagaacacttaagatcagctctcttagcgcatttcaagtatacaatacaatattactgactatagtcaccatgctgtacatttaatctccagaccttattcatcttgcacaactgaaacttcatacactttcaccaacatttcccctttccccactcctctcagccctcagcaaccatcattctactctcttttttaagtgtgactattttacttttgctagctgtaggagttcctcgtatgttttggatattaacccttatcagatacatggcttgtaagtattggaggcattttctttgagctgaccatggtgcagagtctagacctcaggtacaggaaataaatattccatcctctctgtctcttgcttttactctgttttgctttctttctctctttacaggttccttccaatcagctaatactattaaagcactttacccactgaaccttgcatttccctaaattataatttcatcttgtcctttctgtttaattttttgaaagaaawatttatagttgctgccattattttctctccatgtatatgccatatccgcaaacctctaacaatgcctggcacgtagcagtgctctatcagtatttgtcagatgtctctgccgaagttgtactgtcagtggtctgcaggggcttcctgatcactcaaatctattcagtttacctgaccacactttaacattcaagtctatgttttctctttcttttcccttcacatccagtacacagtacaagttttcttctaagatttttatatcacttctattcttcttctctataattacttcctttgcctgatcttcagccatacttttttctccatgctccaccattaaccttcttttattgtgcctggtttatgccatattttcctgtaactttggtagacacttctatgcaaacaactctaagatgtgtttttccaaacttgacccctttcrtgacctcgaggaccacatgtctaacattctgctgggcatcaccaaatatgtgtcccaaactgactaacaactgccactcctcttcaaagtcactctctctggcaggccttatctcatttaatggcatcaccatactcccagtccccaagacatccaacttgttgtcatatttaactgctccttgtccacttctaaagtccctgtggctcccttcactctagatcttcattcccactgcatcagttcacatttccttatctctgacatggactactgaaatggctcccaacttaaattttctgcctccaattatttgtctcccttatctgaatatcacacagtcactgatgtttcttgattataacactagcctaaaagatttgctactcttcactgtatccacaataaagttcaggctttttaaaaaaaaaaaaaaamaaaaaacggagtcttactctgtcactaggctggagtgcaatggcacaatcttggctcactgcaacctccacttgccgggttcaagtgattctcctgcctcagcctcctgagtagctgggactataggcgtgcaccaccaggaccggctaatttttgtatttttagtagagacggggtttcaccatgttggccaggatggtcttgatctcttgaccccgtggtctgcccgcctcagcctccctaagtgctgggattacaggcatgagccactacacccggcccagttcaggctttttattaatatgccaccagtctatatttcttgcttcatctttcaccatatccttcgataaagtctaagttcctatctgtcaagcctttttactctttcttggcgttgtcatttttttctcactgttctttaccttaaaatgtctctcctctatttctgtcatcatatcttagtcaccatttgagtattttgagactattttatttatgtttatattcttagtgcctatctctgtctctgacatctactagacaataaacggttgcttagatgattcgttgaatcactgaatgcatgaatacattaaaggctcagctcaccaactcaaatgcctctttttcactgaaaattgtcatgattcgtacttcctcttcggcgttgcctcaccatttctgtgggtgtctatggtaatgaaagagctaaygcttatcaagccctttcagtgggctrggcaccattttaagtgctttgctagcagtaagttcttggacactaagattaatatcaatgttttattgctttactaatacaaatgtaagtttcagaaatgtcaaaaagatgttcagcattttctcatgtgtcattctctattgaattattttaaaacatggtatcttgtttcttcctgagcctttcaagtggtctagcatgtgcttagcaggtggtgggtttacggcaagcatatatagactataactgtgtctctcagctgaaaatatctatgatacacactagatccatgtttttcttttgaaaaaatcactagcagcccactacagatatggtccaccttgctcatattagggaagaggaaaayaacttactaggaactgagtgaggatgacctctcaggcctcattattctcrgtacacagcctcttcaatctggctgttttaaaatgcattcacaakgagttataatggaatgttcattgaaaacaattcatggtacaagtaaaagagcaaattactctcaaggtaaaattagcatatcttttctaaatgaaaaggaaatttgtatgaaatctgagttgttttgccatttccttgactccctttaggttttcttcttagtgacagcattttttggaactggaaatatagcttctattaacaggtaattttaaatgaaagtggcatatatatataactaaaaaataatgcaacctgggacttctataccttttgttctgtaccttattawttttttttctttttgagaccaagtctcactctgttgcctagactggagggcagtggtgtgatctcggctcattgcaacctctgcctcccaggttcaagcgattctcatgcctcagcctcccgagtagctgggattacaggtgcccgccaccatgcctggctaatttttgtatttttagtagagayggggtttcactatgttggtcaggctggtctcaaactgctgaccgcaggtgatccacccgcctcagcctgccaaagtgctgggattacaggcgtgagccacggcacccagcctgcaccttgctttttatactgaatgatatattttggagattggtatgtattggcacattcggatctactgcgttcattttagtggcttcataatatgatgtttgcttgtgttttagtaagtagatttcagagaattagtttaaacatctttttagaagaatattcttttaaagttacagagtgaattctaaattctttttccttgttataattccctagctttgatcttgcctctgtctattgctttctgactgtgttcagtccttttatgatgggagccctgatgatgtggaaggttagttttcttattttgttatttgtcttaagctattgattgattaagrttataaagtcatttagacagagttaagtagcaatggaaagaagatatcctttcagagttggcactgctaaactggaggtgagaccctctatcccttactccaaaccacagttaatctttttgctttactcwtaagtgcatttgacttcaaaagagtagggattcaactgttaatctgagaggatcttatcagatgtgattaaagcctgtgggaagctatggatcaaactgcagtgctgctaaagagtataaggttccctgaacccatgttctctacccatgagattgccaacataatcttttctcataagccatgtacctggaattgatcaattcattcaacaaatgtgtcattttctgctatatttagtaatgtgccagataytagctgggtgctgacagtacaaagataatgaccattttcagctttccaggggttcagattcttcattagaatgtaattcatgttcttcttctctaaggtcattatgcttgttttattccctttaccataatgcctgacacrttttacttagtatatatttgtttaaataaagtaaactgattcttgcctaaaatccgattacctaatgttcagatttatgaataaaaatggttaaaggtgtcatcttaataggattaatgtctactttttgttattacactaatacaaatggaagtttaagaagtgttaaaaagatgttcagtttctcacatcctgttccctactgagttattttaaaacatgttgctatttccttaattttcaytcacattttttaaatggttttttttcccagtttattaaagaccattggcctttaattaaaaacaagcaagcaagcaagcaagcaagcaagaaagaaagacaaagctcaaattagaatgctaggttcttaatctccagcacaatgcagtaagctttaatgacataatacacttgatgacttttgttgactgatgtgtctagaagtgagggccctgctgaattctattttattcatatgtccttcacttgaaaaagaactgtatgctgccttgaacatcatttattttccatatctccccctgttttgaaacatcaagttatatatatttttcaaaattgataattggaaagcaatacctcaagatattaacagtattagctctggattatggattttcaaccagcataaattttactatagctttatttcaaatgttttataaattttttcatatttgttataatgagtgtgaattttataatcataaataaatgtatttttttaaaaaaggcaaagattaagaagctgaatcatgtttataatgttatagttttaaataaccagatgggtttaaggatctgtgaatcaaattatcaggttatataatttatttgatttgggcattctgtgcttttcacaccctcttggaatcttttgaacattgtggttaattattagaatacattaaatggaacaaaatttgtaataggcttttatttggaatatgtattgatgtttgctgtcttttacatcgtatagcttattaatgtaggtttttaagtcagtttcatcaccgttctatgtgccattgktatcatgcttttatttcagtgtttgctcttcactagtatatataaaagttacttgagaaattgaaaatatttctgtaagcagaaatagtatttttttcaaaaagtgtttcagatgcttcagttattccttgcatcatttattgttcttttacagattttaatcccctttgttcttgttatgtgtgcttttgaagcagttcagttgactactcagttatcgtcaaaaaggtaagatgaattagtttaagaaacatttgatttgcctatttttaggagatgagagtaaactttcgaagacatttcatatgattgctattaagacactgtaacatagattgtttattacaaaaatgagaaaattytcacccgtttagtcagtgttgcttgtcattagaggaaattagttgattagggcctctagcagacaaacttgctttctcagcaataaaatgttattagagtattattcaagctagtgaagaacctccctagaaaacagtaaaacataaatgttaaattattgtagttaattacttgttataactgtgcctacaaaaagcaaaagatactctaacttttattttggtttatttcttaaatatgttatataaatatgttaacattatttcattttccatgacttaaaattaacttttctacatgtcaaaaatatactcagtttctctgtcatgatttctgtacatttgacaaatggagtaggaagtattctttctgagttttgaggaatttctggagcagtccgtcttaagcaatcaagactgtggaagaaaagctgtcaactcaactatttgctttttttaaccaataaaattgcctcatcagcacagggactctgtaaaatacttgatataaatatgaagcttagcagttttgttattcttgaatcaagctagcatattcaatgctgaaagaaataactaatattagcataaatttgcatgttgttcttgatgagtataagctagaactgggtttagcatagtattatggatatgccataatgaaaaaagtttttcttccactgcttaagaatactagaaatctcatttctagttttagtatatttttgcaggatatttacatgaatttaatattgaaagtatttatgccttgtcaatatcacataagagatatttacttagatgcaataaaaactggtgaatgacatgtactttcctgcatctttgttggtggataagatttttagaagggattttaattaaggtttaaataagaagagctggggacatgtggaatgagaaatagaaggctcatcaaaatgtatgtgtgtatgtattcttatatttgtgcgtgtctatagtaatgctatctggaaactagtgcaatgaaaaacaaaacacaacaggagagaactgaggcaaaggtggctcagaaaggtctcttttgacctttaaactcagaagtcactgacatttcttcctggatatcacactgactcatcaaatttaatgtcacacattgaagccagtgatgccttttcttcctattgcaaactagcttctcatcctgttttctttatttaatacatcacacaagctgaagtccagccacccttactgccatactgcttaccaaataatcactgatatcatctctcctttctgttcaccttttaacagtcttattatttatattgctaatcattttcttacaactgttggaagcctacagttaagatgggggtggatatatatactaatgacttatttgtttattaggtctataatgccaaggacgagttcagtataacaaaccagtgaaatgattctgcttctcttccgactcactccttaaaatgtgtattgaacaaaagtgaagtagaaaagttgtattaacattgttttttttcataacttaaaatttacttttctaattattaataatttatctagtgtctcagtgttaataattgggttcatcagcaaaaccttgtaaattttgggtagagaccacaaaaaggtagtagctgtgcatgaagattacctgatagtttatctgttaagaatgcttatggatgtaagcaatgaaaatctaactaacagtagctcagagaaatagagatttatgtcctcacgtcacatggagtctggaggttggcagcccataactctgtgatgccatcagcaaccctgcttttctgcattcctaagaatggtagattcttagattgttgcttttaccctcgtgtttttctcatcatgcctccatctgccatcgtatctcatctgccatccagacaggaacaagggaaaaggactaatgaggaaaaaggcaaggagatatgtcagccgattctccttttctgtcagggtagcagtgtctttcccaaaggccccatgtagcagatttctgactatgtctctatggccagaactctgtctggcacacattcattttaaactggaaggttgttagggaaaaggaaggtgtgggggtgtgaaacaacctgccaaaagtgtcacaattgtggccagttcatttcacagtttgagatgacatggaccatgaagacctttgtcaccttcagaatgcagcaaagcatgagagaagattagaaggccgctgagaaagagaaacaagttttagtattacagaagtattcaacaaccaaccatataagatctgaaagggatgatttttcagttctgtgtttgattaaatactcaactgtacaagagccatggctacacggcagggattggggraaaaaaaacacaaaaacttggaaatagcagttgtcaacaatgtgatctagcagccaaaaagctagttttctcatgccctctattaattgaagtgaaaatattttgactctaattttgaatataccattttgttctgatggatatttttatctccagaatgttttgctcacatatttaggaatccaaatttgaatcagaattattataatattgaataacttttattgggaaagtgtttttatgtgggtactctattaaatcagcttaatttttaaattaattttatatgaagtagaagtaaattacttctaagtatttctattttgatttttaatttattaaaattatttttattaattttcagaaactttttgtgttatttgtttttatcttaaagtctatggatttcagctcctgccagagtttttttttttttcttctacagttatcatatctaccaggtctcattcacctagatcagatattacagatctggttattgtcaagatttgcttcttccatcattattttgttagttacagattttattctgtggttttagccttctacaatgttatttggtgttgtttctaccaggtctaatttttcctgggtcagattttttgtattctatgaaatcaaaaggaaaaggctcttaagtcagtcttaaatctaaagcatatttcacaatgtgtggcattagccattttcagttttattttatgctaatttctcctactattcattcagtacatagggtttgagtttgtatcatataccgggcactgtactagccactggtgatacattttgtgatcagagcttactgtctacctggggagacaaagaaaataaaatgcttgtaataacaaaatttcaagtagtgttaaatgtcaggggaaaaaatgaagtgattcagggagacttctctaaggagaagcaatttatgcaaaaaccttaatatggtctttactcacatagttttatggttcactcaggtggagggagtgaaacatacaaagggcatgagttgaaaacatgcttggtgtatttggagaacagcaagaaaggtagccttaagcagagtgtgctagcagaagaattgtaggaaataaagttgaacaggttggcaggggcagaaaagaaggggccacagataggacttcaccattattcagttgtggcaagaagcctttggtaggttttgaaggctgttctgtctgttgcatggataataactttaggaagacaagaataagagcagggagatcaattaagggtcttgcaagtgaacaatcacagtggctcagtggggatgataagtaatatttattatcaattggataaaagctcaatagcaggtatttatctcttgaataaaaaggtatttacgaggaaactcataggatctaggtacacagtagcttcaaaacatcttggagatcaaataataccatataactaacctgacttcaataaaattattgtatttagagcaagggaatgataaccctatcsttcttaaaattagatcaccatgaatattgaatagtgtattacatttatgccttcgcatttgagcaacatatgaataaacgagggaaccagggacacattcaaaggaacgtggtgaagatgctgaaggcctctgagagtcagtagagccatagggaggcagtgtgcgtaatggttaggagcacaggctgtggggccagacttgctgttagaagtctatgacttactgttactagctgtgtgaccttgagcaggcttacttctgggttcttcagtttccacagaatggttcaagaatatgaagatttgctctggaaaatcattttccttccttttaattaagacttagttcaggsatcgtattctctgttaaaccttttttacccaactgctccactctccagaatccttccaccctcaaatttctggctaagttaggtaactcagactgtggctgataaaattgtttcttacttttctgtttcacacccagttaggggctgatttgtgtcccctaaaattcttatgttgaagtcctgacccccaagtacctcagaatatgactaaatttggagacagggcctttcaataggtaactaaaatgaggtgatatgggtgggccctagtccaatatgactgatgtccttataagaggaaaagattaagacacagtcaaacacagaagagataacatgtgaacctaagggagaatatggccatttacaagctaaggaaagagacctcaaataagaccgatgctgctcacmcacgatcttggacttccagcctccagaactatgaggaaatttatattgtttaagccactcaatctgtgggactttgttatggcaaccctagctaatacacaccttgtgaactccataaggggagagattatatctttaatttcatttaaagcttttgtttaaggagtgagaatgaaaccgatatttactaggcagataccatatgtcaggcactgtattaggtactttccacatattacctgacttaatttttccaatgatactaggaaatatagatattattacaaccattttatagataaggaaactgaggctaagacaataaataacttaatcagatgtgtcttaacttcagaaggatcccagaatatcatctgtgtcacacagtaatataattatctttagaaaaataaaaatatttctaaaaaatcaaaactttttaaaaaaggtatgtaaaggttttttaaaggttttgtttgtttgtttgtttgtttgttttgaggcagagtctcactctgtcacccaggctggagtgcagtggtgtgatctcattgcaacctccacctcccacattcaatcgattctcgtgcctcagcctcccgagtagctgggcttacaggcatgtgccaccacacctgcctaatttttctatttttagtagagccgggttttcgccatgttggccaggctggtcttgaactcctggcctcaagcaattcacccacctcggcctcctaaagtgctgggattacaggtgtgagccaccgcactcattctaaagctcttttgaattgtatttattatttttctattccagaagaactgggtccatagggtagaatatttgttgtgctttgattcacagaagaaagaactctgcagtaattggagctgctgaaaatggagtggattctgttgctgcaaccactaaaactagtgctagacaatgcctttattgggattgatactttgggaattcatgctttaggtagaaggttgtactggatgaccattgcattctctacaaactcttaatcagattaacacactttattatgtgtctgaatggaattatacttcagtaagatatgatcagtctgacttgtggtatatatctgcatatgtgaattattgagttacatgtctttatttcaaacctatggttagaaaaacaattatttattaaaaagaagtcacaaacctctaccaaaacctcacactttattcaaaaattaactcaaaatggaccacagatttaaacttctaggaaaaaaatagagcaaatccttgggatttgggttaggcgaagagttaggcttgacatcaaaattgtaacccattaaaggaaaaattgataaactggacttcttcagaattaaaagtttttgctctgtgaaagactctagtaagaggaagagaacataggttacatactgggagaaaatatttacaaaccaggttatctgacaaaagactagtatctagaatataaaaagaatgcacaaaactcaacagtaaaaaaataatttaattagaaagtgagcaaaacacctgaagaagatatacagatggcaaataagacaatgaaaagttgttcagcattattagccattaaaggaatgcatgtaaaaccacaatgggttgggcgtggtggctcatgcctgtaatcccagcactttgggaggccgaggcgggcggatacgaggtcaggagtacaagactagcctgaccaacatggtgtaaccccgtctctactaaaaatacaaaaattatccgggcgttgtggcgggtgcctgtagtcccagctacttgggagactgaggcaggagaatcgcttgaacccaggaggcggaggttgcagtgagccaagattgtaccactgcactccagcctgggcgacggagcragactccatctcaaaaaagaaaaaaaaaatcaacaatgaaatatcattacacacttaccagaacagtttatcagaatagttaaaaacaaatagtggcatcaccaaatgctgttgaggatgtaaggaaattgctctcatgcattgctagtggaaatgtaacatggtacaaccactctgaaaagagttttacagtttcttatgaaactaaacatgctactgttgtatgacctagcaattgcactcttgatgtattttcctagagaaatgaawggtttacacaaaaaattagrcacaaatgtttataaaagctttatttgtaagagccacaaactggaacaatagccacaagtagaaacaacccttgatgtcctttggtgcttgaatggttaagtaaaccattgtatatccatatgatggagtactattcagccataaaagtaaatgacccattgatacagcaccttggatgattcttgagaaaattatkctaagtgagaaaagccaatcccagaaggttacaaaaggtaacaaagtgttatataaattgttcaacttgttatgtatgtgattctactcataaaacactcttaaaatgacaaaattatagaaatgggggacagattagtggctctcaggggtgagggattaggcagagggatggtgaggggaggacagatgtggctataaaatggcatcatgagagatctttgtgctgatgggaacactctttaccttgacagtatcagtgtcattgtcctgcttgggatattatactrtggttttacaagatcttcccactgggggaaactgggtaaagggtacagaggatccctctgtattatttcttgaaattgcatattagttaacaattacctcaaaagtttagttttgaaaatcataatgtatgtccctttcattttactgaaataaatattcagagcacttaataacacattttacagtccagctcatctctatggtatggtcacccatgataatatgaaaagaacctttgaaagttgtattttcagaagcaaaaataccaacaatactaggttatttgcctagtctcacttggattttaatgagcttgaaaaatgcacctgttgtattagatgtaatttttccttctttttttttccagcctttttctcattgttctcgtcatatcagacattatggctttggtaaggcattactrggtagtccatataaattagattaagagtcctgggttaatttaataaagagaaatatgaatgcattttggtacgtgaaatctttagatgttgagttgtaagtgctggcataatttacacaataaattatgttcttttatattagttatgcaggatgtgtgctcttcttcaggtgtcaaaagtcttactacttgaatttgtcatacctcgtcttccatgttgctttgtatctgaaatgaaccttccaaagaaaattagcagaaaaagctaactttaaatttagataatacatcatttttctactgaaatgttgatttttaacccttctctcagattaaaaatgaaaggaaaagagggagggaaggaaggaaggaaacaggaaatacagcttttctgttgggaagatgttaatcaagacgtagctgcaataaatgagttctgatgtatgtaggtaggcctctctcattaacaaaaagaggaacctattttatgtctacaactttggggagttcccaagaccaccctcagctttagtaattcactagaattcactgaaatcactgaatgctgttatattcagttacagtttattccagtgcatagggcagagtccaggacaccaaatgccaagcttctgtttctccctgtggaatcaggacagcattaccctcccactattgatgtgtgacagtacacatggagtattgccaaccaggcttacctaagctttgttgtccagactttttagtggggcttgatcacatactgcctacctggctgacctttaatcccttctggggatacagctggtaatatggcccaaagccctcatcatatatcacattattagactgtccagtggccaagccctcaggcagaaccttctatgaggcatgacattccatgacattccaagggcccagaaattgcctcccagtagctgagaatgaacaccagcggtctttttgggtaaggttaatttgtcaccatataacatcccatgccagaagtaactaggaatactaataagggtagcttcccaaatcagattcctagtcactcggtttagatgagagtacttttgtgtggtggtgaaccattattcattgtatttctgaaactgaccacacataatgtgagagcaaatcagctttcagttttgtgcaaagtgacaaacagacatattaatagaagaggattgaaattctgattaattttgtataaaaaagattgcataaattgacttgaacagccatttgtgatataacttctgctcatttgattgacatcttctcttacctctccatccttgttttctctacaccatcctccctttgacactaccaagctctctctggactcttgatgtatatataggctattccctctgccagaaacttctttctatccaaacctcctttcatctgactcctactttttacttagatttcaccttgcaatgggaagccttcccttccattctaatcagggtatgaaccccttcctctgtttctataattgcctatattttccaatgataacactccctccatcccccccttacacacacacacacacacacacacacacacacacacacccctgataatttgatggaattatttactacagcctatgccttgtgaggaggagtttatctccagcacctaagacagtgatcggcacacagtaggtagtcagtacagtaaatatttgttggtagatggatgacgtggcttctttccactgacatctttagtattatctagttttttttattgatgttggcttgttcttctttatttctaattattcagaaatgtcacttttgtgttcatttgattgataattctatttctggattttagactactgctaattctaatccaagcaaaagtttcagtaaatgacatattcttgttgattacagtcagatagtgattcttagagtcagaaatctgaaacatacagtcctaaaatagctttgtttttagactgaatctaaatagctttgtttttcattaagcctttttttttttttacagcattttttcttcttggtcaaggattatggcagctggcttgatattgggacaaggtatagtatatatggtcatgcattgcttaacaacagggataagttctgagaaatatattgttaggcaatttcttcactgtgcaaacatcacagagtatattcacacaaacctagatggtgtagcctacaacacacctaggatatggtacagcctattgctcctagactataaacctgtacagcatgttatcatactgaatactgtaggcaattgtaacccaatggtaagtatttatgtatctacacatagaaaaggtatagtaaaaaattcagtgtaaaagattttttaactggtatacctatctaggacacttaccatgaatggagcttgcaggactggaagttgttctgggtgagtcagtgagttattacagtaaccttttttactttataaggttcttaactttttgactttataataacacttagcttaaacacacaaacacattatatagctatacaaaaaccttttctttctttatatccctattctctaagctcttttctattttaaaattaatattttaatttaatattttaaaatcacttttttttactttttaaacttttttgataaaaactaagatacacacacacacacattcacctaggcctacagagggtcaggatttttatttccacatcttgtcccactggaaggtgttcacaggcaataacatgcatggagctgtcatctatgacaacagtgctttctagaatacctcctgaaggacctgcctgaggatattttacagttaaatttatatatatatatatatatatatatatatatatatatatggaaaaggagtacagtctaaaaaacgatgaaaaatatggtatagtaaatgtagatactggtaacagttgtttattgtcattatcagatattatgtactgtacataattgtgtgtgccagacttttataggactggcagtgcagtaggtttgttcacaccagcatcaccacaaacaagcgagagtaatgctttgtgctgcaaagacactgcgctatcactaggtctgttatcatcttatgggaccaccatgtatatgcagtccattgttgactaaaacatcattatgtggtgcatgactacactcacgcagaagttcttaatagtgcagtaaaaaaaaattaaaacttagtatcttagtatagaaggtgcccatatgattttgaggtaagcgcagcaattagcaattattttaagcccctggaaatgagacatctttccaattcttggcattagcacattagcaaatgtttacatggaatgctgtggggaggatgatagatgttaagtctagagagaactaaagggcagcagaagatgcaagataaactgcttgaatccgcggtttcaaagttgatcattccagagtcctagtgtgttttcttaatctctcatctctgtttagaaaaatgaggttgttccggttgcagtatgaattttatatggtggtttaaatttcatgtgatcattatctgcctcttagaatctttaatatggtaaccttttaacatgtgataactatttaaagtgtaatttgaggtcaggaacagtggcccacgcctgtaatcctagcactttgggaggccgaggtgggaggactgcttgagcccaggagtttgagaccagcctgggaaacatagtgagaccctgtttctacaaaaagcaaaaaaaaaattacccgagtgcagtggcccatgcctgtagtctcagctactcaggaggctaaggcagaaaaagtgcttgagcctgggaggtcaaaagagtttagtgagccatgactgggccactgcactccagcctgggccacagagtgakatcccatatcaaaaaaaaattaattaattagttaattaaaaataaagtataatctgaacaaaaagtcaggttcctttttatkgtgatttaaatttcaatgattgccataacctgttaaatttcttttctttgagaagaagaaagcaaaattgacccttttgccttttcttctccaaatgcattctgagacagaatacatttttgtatactgattttatttcatttagtcaatattcattcatcactttgtgttgccaggaattgtatgggtttgcaggagacaccatgtgttaaacatcctcttccctctgttgatacctcttaggcaactcctggcatgtactgcctggttatttatgtacatatctgcctctcccaatagactgtggatgctctcagatccaggattggatttgaatctcttacatgccatacgtgcttggtacgtaaaaggtactccatagaaaattgatttggttttcatttgtctcttatacttgaaagtttagggaaagtttagatatccccttctgcttcccagccctctcattctaaagtgtccaggcggatagtggccagagcatgggctttaaaccagagcgcctgggtttgaatctcatttctgccacttttgagctgtgaaacctttgctaagtgacttaatctctctaagccccccgtttctcttgtagtcrttttgaatgaattaatttatataaagcatttaagtatttagcatagtgcctggcatctaataagcttcagtgaatgtcagcaattgttactgttgtcattctgtaattctgtttttttgtcctttatagtgcttcttgcatttggcatacctttctttaccatttgattattttcattttagacattggtcagaattttgtttcaaaaatattctggtaaaatacagtattttgtttatgagactttttcttttatttttaattgtggtaaactacacataatgaaatttgtcatcataacaatttttaagtgtacagttcaatggtattaagtatacattcacatggttgtgcaactattaccacacaccatctgtctccagaactctttccatcttgagaaacaaactctgaatgcattaatcagtcacaccccattctcccgctcatcagcccctggcaaccaccattctacctttgtttctatgaayttgatgactctgggtatctcatataaatgaaatcatacagtatttgtctttcttgcaactgacttatttcacttggtgtaatatcgtcaaggttcatgtatattgtagcatgtgtcagaattttgttccttttaaaggctgaatgatagttcattgtacgtatatatgcatatgccatattgttcacctgttcatctgtcaatggatactagagttgtttccacctttgtttattgtaaataatgctgctgtgaacttgggagtgagactgttttgatgagagaaattaaattggtttgactctaaacaggtgccaaggaatgaagaagatgcagttttcataggaagatgtgcatcattagtttatgaacaggcattcatttgtattgcactaagaattttagattttctttaattagcttgaggtttatctttacctggcgtgttttttcttcaaagtaaaaattgtttactcttattaccagtaataacatgtataaaacataaagcactttttcatatccatgatctcaattcaatccagcaaatatttattgagcaccagctgtatgctaggagagttgctggggatgagaaactcacagttctgggctttcaggaagcataaggctggaggaggaagcagatccgtgagcaggccatatggtgcagtgtgagaaattttagagtagtctctcttgtactgtggggacacttagggtgtctctctgagtcttgtagcttaaggaaggcttttcagaacaggagctgtctgaacactgsaagtgtggggcttacaagagtacrttgggtcacaagaactagggagaatgtgtagagtgagagaaggtgaagagcagagaacaagaagtgtggaaacaaggctgaaagaagtggccagaaggcaggagaaaatctagagagagcagtattgtgaaaatcaagcgagcatttcaggcaggagagaggtcatgcagtctcagatatgacagagtgtaagtgaaaacataaaggtgtgccttggtttaagtggcagaggacgttgttgagcttggctggagaagtttcaggggtaggatctggtgctagattgctgtgctgaatcagatccaccaatttccaggtgaggactgcagaccaaagataaacatttttcttttttctaccaagaccccaataaaaataaacaaacttascaaaatgaaaagagtgggagaaggactatcagcaaatttgagttcaacaaatttctagaagatagataaccagagggaggaaacagcagctgagaaactacagacaggtatggcaaagggaaaggaggtccagggacctcagactcagtgagacagtaatgtggaaggaggagtgaggaagggaagcaggagattaattggatatctgcctaccaaatgatgrtatcaacaggctctccatagcccgtctccttccttcatccccatggagaaagtgctacaggcattttattccaagtagaaaaccagaagacacctctaaagagacaaaaaaacaaacaaacaaacaamgacctgggaggaatttcattgctatgatatatgtgcctccactttagtaaggctgttctccattctagcatgtgtagcctcctcctaacaaaggacagagacaggcatccctccygctcatcctaaaacacgacacagcaattcttattacatgcatagaacttactggtggccttcctattcgtgagtgagacctagagggaaaagaaactttcttaaaaagtgaaatacacactacctctgacccagcaattccatgcctaggtacccaagagaaggcaaaacatacgtatgctgaaagacttgtacaggaattttcatagcagctgtattcataagaaccaaaatcttgaaacaacccaaatgttcatcagcacatgaatgggtaaacaaattgtgctattgccatacaatgggatattacttacctataaaaagaaatgagtaagtgatgaactcaactacatggatgactatcagatactttatagagttaaagaaaccagatatgtaagagtatatagtgtactccatttatataaaattctagagcaggcaaaactrtagtcacagaaagttgaccactgrttgtttggggctggcagttggggtatgattgaccacaaaagggcctgtaggaacttttagggtgacagaaatgttctatatattgaagttgtttttagttacatggatgtagcatttgtcaataatcggctaactggacatttaaaatggttccattttctcacatgtaaattatacctcaaagttgattcataaggaaaaatagaaaaactaaaagttgaaatgagtggagcctagtatgcatagattaaattctggttagtaggagggactttgtttcaaatgggtgcatgcataaacaacaacataaaggtaataagtcatattaggggggtaaccaccagaagatctaaaaagaaaagtagttagagtggttgctgtaaaaagtgaataagaaggaatgaaagattgttgcttttcattataaatctttctccattattttgcttttctagtacttgcatgtatgactgataaaagctaaagagaaaaatgcataagtagaattggaggtcaggaagtagagttctaagtacagaccactctttcaagtttaattagaaaggggaggagaaacaaagtagtatttgcatgggaatactctcacacctccctttgagggagattatattttcatttattttactaatgagcatgaggaatattataattagaaggagtgaatgtccctagttaaatcagtttaattactctctgtcaaagaaggattttgaaggcattatgtggggcccaaatggagttaactcattcccagagcagagtagaggcagagagcytcccacaaggtcacagcaaggctgtgcattgctacacagagtccacatacccaacagttgtttatctgagatcggagtcctgaaagacgtgataaaggctgttcagagaccacagagtcctctctattagataaaaggcaaagtaagatagaagctcaaacttgagtaggaggcccaggatgtcagtcaaaggattgcccctggtcacacatctaccaaaaataaccaacacttctactgtgctactctatttacattatcttctacattatttcatgtgattttcctcgtaacactgtaaagtagatactatcgttcacagtagataattttaccatctccattttacagatgaggacactgtggccctaaggagattgggacttgctcatgtcacagagtcgatcagtggttgagctgatcttaaaggatgcacttgtgaatggggaagctgccatggggtgtgtaggctgctcagtcactgcctgttttgtgcatgctgccaaactgcacagttgaaaaagtgatttgttatttatgtcagaagacagaaacaagtagtaaatgtcacattggtaattaaaaggaaagccttgtgacatgaagactattgttagcaagttaaaagctatggttaaagaaagcctgtgggagtattaggctgccaaaactaaagctttgagtaagacccaaaagggcttttgctagggctacagagaatggggcaaaatcagggaagtagtgatgaaacgagatacccagaagcaggcccctgaacagaaattttccttggctgcagcatcccctttgcttaccttgatgcctgggactgaaatagaggagatttcagccttggaatcctgaattcattatctttttcctacttactaacatacttagtctttcatgctttcattcaacaaccacttactgagcaacaacataagcctgtcttttttttatttttatttttttttggagacggagtctcgctctgtcacccaggctggagtgcagtggcgcgatctcggctcacaagctctgtctcccgggttcacaccattctcctgcctcagcctcccgagtagctgggactacaggcgcccrccacckcgcccggctaatttttttgtatttttagtagagacggggtttcaccatcttagccaggatggtctcgatattctgacctcgtgatccgcccrcctcggcctcccaaagtgctgggattacaggcgtgagccaccacgcccsgccaagcctgtctttttaattatattcatcctgccccttattcagtttttctcaactgaataatccattctcttgttagttcatcatgggttccattctgttgagcactcttttccctgttttgtttctgtcaccttcagtctttcatctaaaacttgattggcagagtattcccagaacaacttctctttcctttctctacctctgtaataatgcactgttttataaaaaagtttttaaaaaaaggaaaggaggggagataggaaagagaaagagaaaggaaggaaggaaggcatgcaaaggaaagaaggaataaaggaggacaaagggagggagagagagagagaaagaaaaagaaaacgccttttagccttttattgtcccccttcctgcatcagtatcagcctttggtctattccggaagtcccgtgtttgtccttgtccaggaggctttcctttatcccttctgcaatctttaatgttgcttgtttaaagactcaccatttttctcttgaaaattctgggaagttttttttttttagaagtgtcaagttcagctgttttaagtaatttaatacaaccatgtttctcttctctcctctccctctgggatcaccagaaactaattgggggattgtattgttttgccacagaaaaacttctacccaaacctgggaaaagcaggttaagttaaacagtgattgggaaaagttaaggattattgagaaaggtattaaaytgatgataatgatattactagagtagaatatcatttattgtatgcagtgtattaggaattgtacttatrttatctcattgagtctcatgaaatgatgtgaagaaaatattaacaatttctgttttacagagtagaaactggttctgaaagactgattgcacaataatgtggcatagctaggtttattttttgcattgtgtatgtgtttaataaattgatcrtttttcagaaaaaaatacatattgaacactcaccatacataaagcattcccagacattgtcaagtacccagagatgaatggactgccagccttaagacttggtgatgctccatctctggagacagatagctacttcatcaggaacttaagcataaggatgtataactggtatgggacattccagtcctggaagtgtrtgactcttaacacatggccactgctttcagggaggttatggcctaatataggtttaaagacataatgataatgattatagtataaggcaacatgtggttaagggttataaaaatacaggagggaggctgcttcacttaagccttcagtgacaggaaacattatgccaagtctggcatttgaactgggccttgaacaaaaggtgtaatttctttttttgtttgttttattatgctttaagttctagggtacatgtgcacaacgtgcagatttgttacatatgtatacatgtgccatgttggtgtgctgcacccattagctcatcatttacattaggtatatctcctaatgctatcccttccccctccccccaccccatgrcaggcctcagtgtgtgatgtttcctaccctgtgtccaagtgttctcattgttcaattcccacctatgagtgagaacatgcggtgtttggttttctgtcctcacaatagtttgctcagaatgatggtttccagcttcatccatgtccctgcaaagtacacgaactcatccttttgtatggctgcatagtattcyatggtgtatatgtgccacattttcatatgtctgtctaaagtagtcttcccagacctgtaagtcccctaattgaaattataccttttggcaccttttgtaatttcaattaggggacttacaggtttgggaagactattttagacagacagatggacatgagtaaagccatagaggtaaaaagcccaatgcatatgtgcatgatatgtgataaataatttggatttcagaaaccatagattttggctaaaatctataaaaccatagattttggataaaatctataaaaccatagattttggmtaaaatctataaaaccatagattttggctaaaatctataaaaccatagattttggctaaaatctataaaaccatagattttggctaaaatctataaaaccatagattttggmtaaaatctataaaaccatagattttggmtaaaatctataaaaccatagattttggmtaaaatctataaaaccatagattttggataaaatctataaaaccatagattttggataaagaaatttctagaaaatagcctttgggaggcttaagttttttattttgatatggtccattttattttacatttattacctgtgtttgcttgacacatttttgttatttttgttttcccttcctctcatgagtgttgatgctcagtacattttaaaagagctagtgcaagcttgcatttaacgtctatcatgatgttcctcttgatatttgtgtggtacctccagccttatccttaacattcctttacacagccctcatggaataaacagcacaaaacagcaacgacaacagcaaaaaaaaaaaaaaaaaaaagcagaatacaaaagcataaaacaaataatgagcatcattcaaaccaagggaaacagaatgacatatcagcacttataggcagagaatgcatttataaccaccaccacccggtactagccatgagaaaagggtgttaactttatgtttcaatgatttatgtatacatattaaaatattatattattaatgcaattcagggtaaaatatgctataggaatatttcgtgataatattttttataatgggagctgccctgaatatacagtgatcctatgccctgatttcccggagacttcctgatttatgcctggtggcctgctataatcattacacccccatctatacaacattaaaaatccaaagtggataagaagaagacaaaggcacagccagttaataagttatgttaaaccttagtttatctcattctcagtatttcatcattggggatctaacccccataggttaaacrggatgcttgctctgagaaacttctcaaaggcaggtataagaaaccttagatctgtcttcatcaggctgatggcactgaacaaatctacataaatttcccacatattctcttagtcattcctgatgaaatatctccttgctctgtcttctttgtctcttattatgtcatctaaaaggtgcccactttaagagaggaagttgattgcaggtggggggagcagggtcaggatggagaggccaaaatgaaatctgagttggtgaagttaggctttctaaatggaattgcccctgattgatgctgcaatgtgatgtttttcttattgctaagttagaattctaaggtctttcctttgtatcctctatagcggtgatgtcatatagtgcctctgtgaaccatgtggtgctggtctaatgggcaggagtggttcatgcatcttcataaacatctagtttattgcgaggaaaaggcttggataatggtggggaagtagggggaaatgtacgtcaagattcaaaactaaagcmccatacgatagggttcacatgtcaaaacttcattattgtactttttctgctttctgtttgtgagaatgttgcatttaagttttgagtttccaattattyttgtgtgaaggtacatttgaaaagctgtggtgtttcttgtcatgtcgctgatattataaactgaccggcagagctcccttcacaggtgccggggttattggaattgtgctcctgcactggttccccttcatgacgaattttattcctaaactcctttgtgttaatagtataattagcgatttcagccattccatgctttttattcacgggaatggaatgttgcccttttgtcctcactattttattgcatttttttttttttttttttttttttttgagacggagtctcgctctgtcgcccaggccggaatgcggactgcagtggcacaatctcggctcactgcaagctcctttattgctttttttttttgcatttattcctgaaatggcgggamtctgtcccagaatttgagagaggagtgggagctgactgccccrtgaatgtagtctggcatgtatctgtaatgtttatagtgttgtggtgattgccatggattttcagaacacttttgagagatttgtcacctgttattaatagttgcaggttaataagtatagtttcttaaataataaagattgtattattagggcattagatagtatatctgtttataggcatagtactctgtgtttcaaatgcatcttcagagcagattttaccaaactgaaattgagactcaggaagcatacactacagtcagtgtattcagctgaaactactggtgtgagttcagtgtttctcttgagaacctgtggcatcgggtatgctttttaacagccatgtgaaaaatatcctgcccaggccataaaactgttcagctgacagagctaatttagtattttcttcttttgatctttacactttatcttcatttatagcaggtcataaactttatagagtattgccttttatacggcatactgaaagtacatttttaaaactagagaaaaaaattcctttgaggtaattttcataactataaaaacrtatattcagatttgcgtcctcaatgcatttgtagtgaggtgaatagagtcaggatcatcagtttgattgagctgagtttgatttgatggcagtcttcatttggactttaattgtttctcacatgcacgattgttataccttattgaaatacaaatgacaactaacgtgtttatcatttctcttttgatataatgagaactcaaaaaaaagagagaactcatgattctattcaatagtgtttgtatatcctaaatgtaattaataagtgtcataaaacatctgtactgttacagtgaataccaaactttattaaaaccaatgattctcagactttttctgccccagtacattgaacaggtatgacctgcttctatcgcccatcacccttatagaggagaaatatgatcaacattttgtcaccattgtgcaggttgaaaaggcctgcctggcaattccatgtgcctccacacatacgctcttcccctcgaccatcacacatgcacaccttgagaactgctgatttaaatgatggcacaatagtcatgggaggggagtgcgaacagctgaactcatttcaagttgaaatttgatgttcctttaactctgctatggcgagatgacaccaagacttgattgatgcaagatawcacaagctggatgccttatggctcaattgcatgaagatgatgagcttcacaactgtttcctgccaattatgttagcttacatgagccaagagtcagtaatttcaggccactgtaaggaaatgagtgatctgtggaatgccttttatagacagactttagattaaatttgaggatgggtcacctactggttttacaaaccgtttttgtttagacatcaaatcagatttaatattttaacctgtaagtgatggcaaaattcagcaagaaaaatctgctagcatgtaatcttttctttctttgtttttattcttaacagctttattgagtataattcataccataaaatttatctattttcattttttaatgatttaataaatgttttaagtcattttgatgatttttggcaaatgtatggagttgtgcaaccatcacaatctattttttgaacatttccatcacacagaaaataccctctacctgttcacaatctgttcccattaccatcccaagcccaggcaacaacaaatctgctttctgtctctacagatttgcctattgtggacatttcatataaacagaaaaatacaatatgtagtttttttcatctaacttcttccagttagtgtaacttttttttggcattcatctatattgcagcatgtaaaagtactttattcattgctgaataatgttccattgtttggatataccacattctgtttatcctttctataatgcttataaaagattaatcttttatggtccttgttgcttttaatctacctagctccccacctccttgcctggtttcccccctggaaccaaggtcagattgagcttttctggatttgacctccaggctctatgctgaagagtttgtactccttcactcatctcatctctgactacaaactttggtccctgaagaagttgggatgattatatccagtgtttttktttttttttttttttttttttgagacagggtctcagggtacagtgaggtgatcaccactgcagcttccaccttgtaggctgaagtgatcttcccaactcagtttcctgagtagtgaggaccacagctgtgtgccgtgacacccgggtaattattttaatttttattttttagagacagggtctcactctgctgcccaggctggtctcaaattcctaagctcaagagatcctcctgccttggcctcccaaagtcatggggttagaagcatgagccactacacctggcctggattgaggattttaatctcaggagctggtaccaattttggagtgtcttctgaggcctcagaaacagaatagagttgaagatttctctggtaattatgagtcagccttagagttctgtggctaaacctagcataatttgtaaacatcacataaatagcaatatattacaaatatactaaagaaaatactgaaagcattaagaaaagataagtcattcataattcagtgtctcagtttgcagtattcagggagaaccactattcaacatgttgatgtatgtccttttagctttaatttatgtgcagacatatacagtttctttaaaagatggttttctataataaccatttccccatgtgagtaaatacttttgaaaatatgaaagttagtctcatgagcagtgcaaggtcagagataaccagattcattcacgtttgcgtctttccatagtgtcagacttctgttgatgctatttcaatagcaaaaggccatgaactgcatggagttttctaggaggcagtcctccttagaactttccggtcacttggtagtcacagctgcacagccacaagccactccacaagtcagtcaatattgtcaactatatgtaatattatacctaattaatatataaatgttacagattaaacattccacaacaaacaaagtaacatttaacatcaagagaagagagataggaaaaagggttaaggaaatagtccagggagagtgaggaagacagaaagaacctcctggtctgggccagggcccatctgttttacaagaaagagtctttacaagaaagagtctttgaaggccacccaccttcagtggcaggtgctgggtgcttatcaggagtgatagcaagacagtgtcagttaagacagccattttgagctgtgaagtcctgctctttttatggctgcagagtcctccagtgaggactgatagtggaagagtgtgcctgtttatgtccttatctggttggatgcagtctttatttattaatttattaagcaaagtatcttttccctgttggcaaagtgtcctgtgaaatgtaagatggagtctttttctgagatggagttacttgtgtcaagggtgctctgtacagttagtgtagctagaatggtatgagggaaaacatggtcaggagagaattcatagagtagatatttgctatcacttatggcctttgaaagtcattgtaaagaaytgggagtttattccaagtgtaagttgaagcattagtttgttgagcagaaagttattttatttgcttcacatttttgacataacactggccacaatgtaaagaacctattggagggatcgagagagggagaaggaagattgaggaagaggctttcgtggtatcgtaagctagagatgatggcagtttaggctagggtagcaattcaaaatagcaacaagtggctggacttagaaaatattttcagagaggttgataggatttgttgatagactaatatactgggagaaaaaaagaatcaagggcaactcctagttttgttttttaatcttgagtaactgagtgactaggaaagccattgcagaaatctggagaaagctctaggaggagtgagtttggtgaaggaaggtgtgggagattaagatctgggttttgcatatataaaatttaaattaggatggtgctggagggagctatgggatcttgggagagttagaatgagacaaattacacatttgtgtggtaaaggatatgctcacctagagaaggaaaaatgggtgatatctaagagggaaagggataattggaaaaataaagtcctttagtacagtggtccccagtcattttggcaccagggaccagtttcgtggaagacagtttttccacggatggggygaagggtgcaggggccagcaggggatggtttcaggatgaaaccattctacctcagatcatcaggcattcgttatattttcataatgggtgcacaacctagatcccttgcatgcgcagttcacaatagagttcgtgctcctgtgagaatctaatgccgccactcatttgacaggaggtggagctcaggcagtaatgccagcgatgcagagcagctgcaaatacagatgaagcttcgctcacttccccgccgctcacctcctgctgtgtggcccagttcctaacaggccatgaactggtacgggtccaaggcttgagggttggagaccccagctttagtgggagagttgggatgaaatccaaactagaagtggaggggtttgttttagacaagaaaggtacctgaggcagtgtgggcacagatatgagtgggttagaaagttcggggtgagaagaggcacttctcttgcgatcactttatcagtattttctcggttaaaaaaaagcagagtcatctgctgagatgggaggaaggtgacaggactttgaggagaggagaaaggacacaaattggtttgactcagagaagaataactcagaagtgtgcaatcaggattgagacactgatgagaaccaaatctcatttgtgcttataagtttaaagtgagtccagccagaacagttgtgagttactgatgatgattccttgatcttgggtgacaggatgatctgttctcttccgttgtcctgttgattctaatgcccgtattacatttaactttatattttaatattttgcagggtgagttttactttagttttgtagaaacttttcgtttcctttggcattttggttttgctttttagctttcggtattgattatgcttattctattttgggagagtctgatcttattaggttggtgcaaaagtaattgcggtttttgcctttttttttttttttagtggcaaaaaccacaattactttttcaccaacttaaataagttcagattaaatttgccggggtaacataaaacaaaagaagattttatcatttcttctaattataaattatctttaataattcatttaacaaatattgattaagtgcctataagaccttgcatgagacgttagagatgcaatgggaaaagagataaaaattatagtccctgyttccacagagctcacaggccagggtagaggccagcaacctatgccctttagccaaatgcagcccacctcttgattttgtacagcctgtgaactaaaaaaaatttttaattaaacatttcattttaacattattatagattcacatgaggttgtaagaaataatacagagagatctcctataccctctaccttatttccccccagtggtaactttatgcagaactatagtataacatatagtaaaaccaggatgttgacattgaaactgtcaaaagacagaacatttctaccagcacaaggatccttcatgttgccctttatagcccaggcacttccctcccacccagaaaccctccttaacccctggcaacatttaatgttttccatttctgtagttgttacttcataaatatgatacaaagtaaatcatatagtatgtaactttttggagttagcatttttttcactgtcagagtaattctctggtgattcattgttgcgtatttcagtagttcgttacttcttattgctgagtaaatccatggtatggatgtgccacagtttgtttaatcattcacctgttgaaagacatcaaggttatttcaaggttttggctattatgaataaagatcctataaacattcttgtgaacagttttttccctctggcatgcatgctcagaatcatatttgctgagtcttatattatttgcatgctgagttttaaaagaaactgccaccagagtggttgtaccagagactgtcaatccagtttctctgcatccttgccagcatttggtgctgtcaatattttttattttagctattcaagtgggtgtgtagtgatatctcattttggcttcaacttgcataatagttaatgatgttgaacactttttcatctatttatttactgactttatatcctctttgatgaaacgtctgttcatgtcttttgatcattttctaattgaattgtttgtggagctttttttactgttgagttttgagaatttattctatattttattctaggaaatagtcctttgtagctgagtgcagtggctcatgcctgtaatcccaacactgtgggagggccaaagcgggcagattgcttaagcccaagagttcaagaccagcctgggtaacatggcaagaccccatctctacagaaaatacaaaaattagctggctgtggtggtgcatgcctgtggtctcagctactcaggaggctgaggtggaggatcacctgagcccagggaggtcaaagctgcagtgarctatgatcataccactgcactccagcctgggtgacagagcaagaccctgcctaaaaaaaaaaaaaaaaaaaaataggraaaaaaaaagtattttgttgaatgtgtggcttgcaagtgttttatcccagtctgtagcttgtctttttaccctcttaacagggcccttcacagagcaaaagttttttgtttttttttttaagcccaatttatcagatttacttttttagattgtgctttttgtattaagactaggaactctttggctagctccagatcccaaagattttttttctaaaatgtttatgtttttacattttacttttaagtccatgatccattttagttaatttttgtatatagtgtgagactcacactgatagggtgtggtgatatcaggtatatggtttacactctttcagggggatggggtgcagatttgcatgggtctgcttccccgtctgcgcttgctttagctgtgtcccataaactgtgatgtgttggttttttattttcattacattcaatctgttttttttatttctcttgaaacttcatctttgacccatggattatttacagttgtgttgtttagtttccaagtgtttggtaatgtatctgttatccattgttgatttctagttggattccactgtggtcagagaaggcactctgtgtgatttcagttcttttaaacttgctgaggtttgttttatggcccagaatatgatctatcttggtatatatgagcacttgaaaagagcatgtattctgctgttgttgggtagagtgttttatcattgtgaattaaatcytgttgtttgatagtgttgagttctgtattcttgctgattttcagtgttgttgttctatcaatttttgagaaaagggtatctttgctctgaagtctgtttgctctgaagtctattttatctgatattaatatagccactccagcttttttaaaataaatgtttgcatgatgtttcctccataattgaagtgagtgtcttttagacagcatgtggtttggtcacggtcatgttttttattctcttctaccaatctctgtttttcagttggtgtatttagactattcacatttaatgcagttattgatatgttagggcttaagtctgccattttatttttttgttttctgtttgttctcagtgttttgtgtttcctgacatccagtgtattacttgaacattttatagaattatttttttacttttctgtggtgttattaatgtatctctttgtatggytttttaaatggttgctgtaggtattatatatacatagctaatcccagtctactggtgatgtcattttaccagtttaagtaatatatggaaaccttacctccttctacatcccattgccttcccttgcttacaataaaattgtcttaaatatttcctctacacacatttgaaaccatgtcatacagtattagaattttyacatcagctagcaaatataatttagaaaacttaagaggacaaggaaaacttattgtctttacccagatttttacttactgagttctttttccttcataattttagcagattctttctttattgttttatttctgtttagaaaacttccttcagagaaataaaatacagacaagcaaatgctgagagattttgtcaccaccaggcctgccctaaaagagctcctgaaggaagcactaaatgtggaaaggaacaaccagtaccagccactgcaaaatcatgccaaattgtaaagaccatcaaggctaggaagaaactgcatcaactaacgagcaaaataaccagctaacatcataatgacaggatcaaattcacacataacaatattaactttaaaggtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaagtatcctaaatatatatgcacccaatacaggagcaccaagattcataaagcaagtcctgagtgacctacaaagagacttagactcccacacattaataatgggagactttaacaccccactgtcaacattagacagatcaacgagacagaaagtcatcaaggatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcaacaaatgtaaaagaacagaaattataacaaactgtctctcagaccacagtgcaataaaactagaactcaggattaagaaactcactcaaaaccactcaactacatggaaactgaacaacctgctcctgaatgactactgggtacataatgaaaggaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccttaacatcacaattgaacgaactagaaaagaaagagcaaacgtattcaaaagctagcagaaggcaagaaataactaaaatcagagcagaactgaaggaaatagagacacaaaaaacccttcaaaaaattaaggaatccaggagctggttttttgaaaggatcaacaaaattgatagaccactagcaagactaataaagaagaaaagagagaagaatcaaatagacgcaataaaaaatgataaaggggaaatcaccaccaatcccacagaaatacaaactaccatcagagaatactacaaacacctctatgcaaataaactagaaaatctagaagaaatggataaattcctcgacacatacaccctcccaagactaaaccaggaagaagttgaatctctgaatagtccaataacaggctctgaaattgtggcaataatcaatagcttaccaaccaaaaagagtccaggaccagatggattcacagccaaattctaccagaggtttaaggaagaactggtaccattccttctgaaactactctaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacataaccaaagacaaaaaccacatgwttatctcaatagatgcagaaaaggcctttgacaaaattcaacaaccgttcatgctaaaaactctyaataaattaggtattgatgggacgtatctcaaaataataagagctatctatgacaaacccacagccaatatcatactgaatgggcaaaaactggaaacattccctttgaaaactgacacaagacagggatgccctctctcaccactcctattcaacatagtgttggaagttctggccagggcaattaggcaggagaaggaagtaaagggtattcaattaggaaaagaggaagtcaaattgtccctgtttgcagatgacatgattgtatatctagaaaaccccactgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacagttgcttcaaagagaataaaatacctaggaatccaacttacatgggacatgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccattaagctaccaatgcctttcttcacagaattggaaaaaactactttaaagttcatatggaaccaaaaaggagcccgcatcgccaagtcaatcctaagccaaaagaacaaagctggaggcatcacgctacctgacttcaaactatactacaaggctacagtaaccaaaacagcatgatactggtaccaaaacagagatatagatcaatggaacagaacagagccctcagaaataacaccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcatggacaaggacttcatgtctaaaacaccaaaagcaatggcaacaaaagccaaaattgacaaatgggatctaattaaactaaagagcttcttcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaccccatcaaaaagtgggcgaaggacatggacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaagtaccatttgacccagccatcccattactgagtatatacccaagggactataaatcatgctgctataaagacacatgcacacgtatgtttattgcggcactattcacaatagcaaagacttggaaccaacccaaatgtccaacaatgatagactggattaagaaaatgtggcacatatataccatggaatactatgcagccataaaaaaggatgagttcatgtcctttgtagggacatggatgaaattggaaatcatcattctcagtaaactatcgcaaggacaaaaaaccaaacaccgcatattctcactcataggtgggaattgaacaatgagaacacatggacacaggaaggggaacatcacactctggggactgttgtggggtagggggaggggggagggatagcattaggagatatgcctaatgctaaatgacgagttaatgggtgcagcacaccagcatggcacatgtatacatatgtaactaacctgcacattgtgcacatgtaccctaaaacttaaagtataataataataaaaaaaaaaaaagaaaagaaaacttccttcagacattcttttaggttaggtctgcaggcaataaattcatttggttttttttttcatctgtgaattctgatttccccttatttccgtgggatatttttattggattctgggttgacagttatttttctttcaacacttgaaaaatggtgcaccattttctgctggtttccatattttctgatgagaaatctgctgttattcaaattgtttttcccctataggtaaggtgtcatttctcactgctttcaaattcttttctttgtttttagwttttagtaatttgatgtgtctttgtgtggattgctttgggtttaccttatttgaggtttgcttagcttctgtaagatttatgtcttttgccaaatttggaaacttttcagccactattcctgtgagtactcttttagcctctttttcttttccttctagaagtccagtgacacaaatgttagatcttttgtcacagtccacaggtccctgagactctgttcatttttttttaacatctatttttgtttttcaggctgggtaaattctgttgttttatcctcaggttcatggatcctttcctgtgccccctcagttctgctattgagcacttccatggaaatttttattttggttattgcattttttagttctwgacttctttatttgcttcttatttacatcttctttgctgagaattcctatttcttagctcagattttctgtttttttgtgtgtttgtttctagtakgtacataattgctcattaaagtatttttataatgaccactttaaaatttttgccagataattctaacagctctgttatttaggttttgatatcagttaattgtcttttttcattctgcttgagatcttcctggttcttgatgtggtgagtgattttcttttgaaacctagacattttgggtatttggttatgagattctcagtcttatttaaacctgttttaactggcttctgacattcctatggcaggggaagaggggacactacctcatttctgcctgatgaggttagaaatccaggttccccttgcagcctccattggcacccgagagggagctccttactgctgcctgccagggaccagcgttacggcaccctgcraggcctccactactgccttcatgactgggaaagayagaggtcccctttgcctcccatgcaacctccactaataacatggtcaggaaaggaatggcctttctacctctgagtggaggtggaattcctggctctccactaggcctcctctgacatgaccccattgaagagggggagggacctcattactgcttcatggaggtggaagtctaggctccccacgtgatgtccactgacatcctccaggtatggacagaagtaccagcttccctcctcagccttccctgacaccatgacagtggaggggagggcatagccggggagttagagtgccccattatagcctggtgaggatggaagtctgggctccccactcagcctatgctggaataggtaggggtggagccacattttttctgtggtgtttggctgaagtagatcagttaatatctaaacattttctgtctttctggctgcccctttccttgtctgtcccttagctgcgagcataggctcttgtggtggtggtattattgttttttggggatttctttttggtctgtgcccagtggcatttccaggttgctgctgtcttcctgcaaaagaaaattcaggaaattctttgggtcccaagatcactgaccagtttgccctctttccaccacctggagtcgtcttacgtttgtttatagtgtccaacatttttagttgtatagtcagccctctgtatccttgggttccacatcatggattcagccagctataggttgaaaatatttttttaattgcatctgtactgaacatgtacagactttctattctttctattattccctaaacaatatagtgtaacaattatttacatggcatttacattttattaggtattgtaaataatctagagatgatctaaagaagcagtccccaacctttttggcataagggagtagtttcatggaagacaatttttccacacgccgctgtgtatgtgggggtgagggatggtttcgggatgaaactgttccacctcagatcatcaggcattcgttagattctcataagaagtgcacaacctagatcccttgcaagcacagttcacgacagggttcgtgctcctctgagaatctaatgcygccgctgatctgacaggaggcggagctcgggcagtaatggtcactggtccaccactcacctcctgctttgcagccagttcctaacaggccacagactggtaccagtccactgcctgaggtttggggacccctggtctgaagtatacaggaggatatacatagcttatatgcaaatacggcaccattttatatcagggacttgagcattcaaagatttgggtattcgtggaaggtcctggaaccagtccatggacagctgtacttgaaggtcctggaaccagataccaacagacagctgtacttagcaggaggaataaggtaaagaacacccactccagctcctgaaagtggagattttcatctgtccatttaaaaccattcagaggaatctcatgattttcctcacctgtgttctctctgcctgtaacatctttttctccttttgcagcatcagccactatgtgattgtcatgtccatgaccatcttkttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctrtccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaagggtgctcagtttttttatctttctttattttgctctttgaggcatatctttttcttaattttgtcctttcaggtcagtgtgagtctgtagaataggttgaacttccttctgacagtatcatagagtttgtggagtttgtgttgtgtgcctgcagccacaggctcgccttgctgcaccgtaactggccccttcagactcacatgggaacaagccttttctgttgcagtttcccagatatctttaaatgttttgaaatgtatatttttatgttgcaaaacagaaaaaagaaacgagttagggaaaaagtatttctatttaaggtatttattttttcattctacctatgccatagatttctgaatcaagacttaggacatttgctgattaacaatgtttaaattaggaattgttataagaattaaaataggcagaacaagttgtgaaaatattgaaccaaaaaaaggccatgctatcatcttagagggcccatgaataaaccttagagggaatcctaaggctttaggaaaccgctgcagcttgtctgtcattttccaatatgttarttattatacttagtgtacagtatttagaatacaaaatgcttttttattttttaggaaaataatgttataaatgattgtatattttcatagtaatgtctttataattatttattaatgatagagctgaattagaaaagctcttcatccattataatatggtttctcatgaaaaacttattacaaatttcagccaactcagatattaagaacatcagtgtcaatcctcctcccctcctgcgacctttttacacttgttttggtggactaggggctccttttctcctcctttttgacatataactgtgccattaaaaacatgatttctgatgaagctggcctagagggaatgaaggagattgcgtgggtatggtctctaggacaggcgtagctgttgcagggccaccctgtccttgggagaacctggtgagctcccatattcacactagatgccatcatgtcagggggctgaagagaatggagctaatcaactctgtcatttggagaagacccccttcagaccagttctgagaactccttcttttaagagaccagagataacttgatcatttctcaccttttcgtagttgttcttttttatgttgacattccccttactgtttttaaaatgcttcaaagcattaatgattgttatgctgtgtgctttcagtactatggcaatatctttgtagcattttcccatttctgtataagcatggttttttgtttttttttttttcgtttttgttttgagacagggtctcactcttgttcaggctagaatgcagtggcaccatctcagctcactgcaacctctgcctcctgggctcaagtgatcctgccacctcagcctcctgagtagctgagactacaggcacatgcccccacacctagctaattttaaaatattttttgatggagacagggtttcactatgttttccaggcagcagcatttttttttgactgggatttctttatgatgctttgttatttaaaaaaaaaatgagaaggaaacattaataatcaaaattatctttaattggcctcacagggctaaaatctagaattattattactcttgggtaaactcatgaaaagyacttaatattcattctataaagaaacaaaaagaacctttgagatgtgtctcttattcatttccttgggtacacttaaaacgggttacagttactgctcaactttctaccttcagaactgcagcatttatttgccacacagcagcatttatcagagattgtcccttagaacattggttccttgtaatacaaataaatgtcataataaaaatagtttcttttttctttctttctttttttttcaagacagactctggctctctcgccaaggctggaatgcagtggcgcaatgtcagctcactgcaagctccgcctccctggttcaagcgattcttctgcctcagcctcctgagtagctgggattacaggtgcccaccaccacgtctggctaattttcatatttttagtactgacaaggtttcaccatgtttgtcaggctcatcttgaactcctgacctcaagcagttcacccgcctcggcctcccaaagtgctgggattacaggcgtgagctgcctcacccagctgaaaagagtttcttaattaaatatatttgagaaacatctagtcaaaccaccttaaataggtatatttacattagttctaagggaatttaacttgtgatgtacgttgtgaagggaggaagatagcattatgccaaaagtttccactagcttgacagcagaccctgtcttagagttttcttcctgattggtaaacataagaaatgtttccaaagccgggcttggtggctcacccctgtaattccagcactttgggaggccgaggtgggtggatcacttgaggtcaggagttcgagaccagtctggccaagatggcaaaaccccatctctactaaacacacacacacacacacacacacacacacacacacacacacacacacacacacacacacacacacccggcggggtggtaggctcctgtaatccttgctactcaggagcctgaggcatgagaattgcttgaacctgggaggtggaatttgcaatgagccgagatggtgccactctgggcgacaaagtgagactctgcctcaaaaagaaatgtctccatataattttgcactaaaaccttaatttgtcatagttttgaaaatagggtgttgtatgttgattgaatttttttccctgagaactggaataccatttttactttaacccttaatgtgagaaaactttacaatttcctgcaatttttcctgcctctgtatatattacacctgtcatcatttagtctttcatgtgggaaaggccagtggtaccagattgcattcggttcatcatggctcattgtctagccctgctagagtatagactaagccttcataccttatgttttatatcttttacctgaaaaataaatttgcaccaaatttcaacttgttttcttatgatttgacagtgtagaaagtgattagtagttaaatttttataatgctttgttatttaaaaaaactatgaaaagaaaacatcagttatcaaaatttcctttaattggcctcaaagggctaaaatctaaaattattattactcttgggtaaactcatgaaaagataaattctttttacagaagaatttaattagcttgactggtatcaaataccaattgcatcaaacatcagtgattccatgaattttttaaagttgtttttactttaagcagataatgttcagtgaatttgactaatgtgattaacgaagggaccaacacaggtaattgtcaatcttacagacataaactgttacctcgaatatccctgtattacttgaaattctagaaatcgtctgtcaacattttaaaagctcctctccttgctgatgagaagtaatattcttaaagttagaaaccatacaattaaatcctgatttgcctgatacatgtttgcttatcatgtcctatctctcatgctattgtgattggttttattttattaaaaactgctcatagcatagccaggtgatctatgtgaacatcaacagtgataagctgacagtatgtaccctggatacatgatgagaatggcactttagctacacggacttcctccccagtgctcataaacccagtctaatcatgagaaaaacagacaaatatcaatataggaacatttggcaaaatacccagtgagtacttttcaaaactaccaaggtcatcaaaaacgagaaaaggctgagaaactgtcaaagccaagagaagcctgtagagacatgaccactgcatggggtgcggcaccctggatgggccctaaacatgcggtgcggcaccctggatggggccctaaacatggggtgcggcaccctggatggggccctaaacatgatgtgcggcaccctggatggggccctaaacatggggtgcggcaccctggaaggggccctaaacatgagttgcggcaccctggctgggccctaaacatggggtgcggcaccctggaaggggccctaaacatggggtgcggcatcgtcgatggggccctaaacatggggtgcggcactctggatggggccctaaacatggggtgcggcaccctggatggggccctaaacatggggtgcggcaccctggatggggccctaaacatgatgtgcggcaccctggatggggccctaaacatggggtgcggcaccctggaaggggccctaaacatgagttgcggcaccctggctgggccctaaacatggggtgcggcaccctggaaggggccctaaacatggggtgcggcatcgtcgatggggccctaaacatggggtgcggcactctggatgggccctaaacatggggtgcggcaccctggatggggccctaaacatgatgtgcggcaccctggatggggccctaaacatggggtgcggcaccctggatgggccctaaacatggggtgcggcaccctgaatgggccctaatcatggggtgcggcactctggatggggccctaaacatggggtgcggcaccctggatggaccctaaacatggggtgcggcaccctggatggaccctaaacatggggtgcggcaccctggatggggccctaaacatgagatgcggtaccctggatggggccctaaacatggggtgcggcatcctggatggggccctgaaacagaaaaggacatcaggtaaaaactaaggaaatctgaataaagtatggaatgtagttaataaaatgtcaatatttgttcattaaatgtgaaaactgtgccttagtagtttttagtaattagtaatcattaggtattaataataagagaaactgggtgagggagtgtgttggaaccctctgtattaattttgcaaattttctataaaactattgtaaaataacaagattatttaaaattgtaattttatgtttttaaaatttttactctatacacataattttacataaatgcattagaagtgtaataacagagaagcagaggattgaaggggtggttcactggtttttttctgttttcgttatttctccctagttctctctctgctctttcactcctgtaactcctctctgagccatgttagagcccaatgtgtataacatttttcttcctgaattactttcaatcaattattgtagctattattattattattattattattattttgagacagggtctcactgtgtcgtgcaagctgtagtgcagtggtacaatgatggctcactgcttccttgacttcctgggttcaaacagccctcttacctcagcctcctgaatagctggaaccacgggctaatttttaaatattttgtttttgtagagacagggtcctgccatgctgcccaggatggtcttgaattcctgggctcatgcaatctgccccttggtctcccaaagtattgggatcagaggcacgagccactgtgcccagccaattattatgttccacataaatctcacatgagtgtgtagtggtcagctgtgcctttgctcagcatttcctcttgagataactgtgcctgcattgctaaccttctgtttctggcaggagccaaaaattttttatgacccttctcaccacatttgactagtttaggggtgcacatccaacccacacaagaccagtctaagttctttgcaagattttcaagctgcaactgagagaaagtttctaacatgtgaagtttcagagctgtttttggccaagttcaattaagtgaaatattctagtaacctcccagtaagtaatcttttcaaaaaaaaaaaaaaaaaaaaacacggagggggattgaattcactgatctctctaagaacacggtggattacgagaaatccgaagctccacttaaaatgtttatttttgttcctggttttt

SEQ ID NO: 1682 - DNA, 20803 bp, Homo sapiens
ctcataggagcctttacaagtgtgaggagtggcactggagacaacaaggtctacgagccacgcggacagcaggtgcctctcctaccctggggctaggacgggagtcaggcagatgtgtgcagtcaaggagggcttccctgtaaaatgacatcttcgcagtttcaggaaggcaaacgaaagcaaacagcctagccaaggagacaggacttggcggtgcctgcacagaggcctaggactctgctgcaaacatggaacagggctggtgagagaggcaggaggtggggcagagcagaatgaggacaagtgaggccggatggaggggctgcttgttcccctgtgccaagcagtgggggacagctctaaagatgggcctagaccctcaccatgggactcacccaagccaccaacaactctacctgcctctctgcagtgccacctgcacagcacaggtgctcatcgcccatcgccagcgtctgctcagtgaggctgaaggctgcccaagccctcgctgaatcaactgctcctgagttgctgttataacaagaacattctgaaaaactggaaagcaaggagagaagctttacaacaacaatgcccaacatttcgccactcaaagagaatgacgtttgtaactctgtcttgccatcctttgtacagaggttactgttttgcatacttataatcacagtgtttacacaaccttgtgttttttctacttactgcataagcatttactccacaaatttagagctttcattgttttcttaatcccccattgttgggcatttagtttaaatctttatttttaacaaggactagctttgcatgtggtatttctccattatgagaattttaaacagatttctgaagtggttaataagatgaaatggtttacttcaaacagtctggataccatactataaatataacttccccaaattttgtaccaattgatagtcccatgagtgatgcttaagtgatgcttcctcactttaccattatcagctttggatgttgctatttaaaataaacatttcctcattgagtgggaccaaaaccaaaatgccgtgatcctgcagcactgctgtgcttttccttcattgccaaagaggatgcatgttctttgatgaattggttaattgcctttctttttctcctgaattgtcctttgatgtcctttgctcatttatatgttagggccctcttcggaaatatctttgcatgtgttcttaatataataaagatgcttgcctgtaagggagtgttgttggatgaatagatggtggaataaatgctacttgttggtttgtcatatttgctgcaagcattttctcccatgtttaggggaatcttgcagtgccccctgtgacccatctgagtaacagagcccccctacatacactctgcctcggggctgctttaagcctaattcaatactgcctggctgtcccccacatcattttctctgggcttaagttactcaggatctctaaatatttgcagtgtgaagaacaaaaccagaggttgttcttgggaaccttggtccttcaacttccttcaccccagagcatggccagggaaggggtcagcatgcagggctgtagctgaaagaaagctgcacagaggaggcagctggctgcccagactccacaggctgcaggtgaacagacagagggaggagctggagagggagaggcacccgccaggcttggattcagagccagcagccacacaacacaatggaagcaggtattttggggtgacccaccatgtcatgagtggtgatggggccagacaggttactggagcccaggatcttgctctggcctaagtagctaggtacaggacacagagacaggaggctggctaacattaatgcacagggagatcttgtatgcagtcaaccccattgctgggcctcagtttcctcatatgtacaatgaaggccagttgtggcctcagcctctaccagtgctgaattctaggattcctgtcctgccagggaagtaaaaaggactcctcttctgaaaagaaggtcagtcacgaaaagaactaaaagaatgggggaaggaattgccctggatcccagctcccagggcagaaaaccagccttgaccagtcaagacccctttctaagcagaccaaggaggtagtgcccagacacctgtgggatttcctggaaagtcacactcctgttatcaccacctcctcttcccagagacttcatctctaaaacaaatgccctgaggatgaactggcttccctgggaatatggactccccatggccacccctacacacacgcaaacacacacacacacacacgcacacacactttctcacatgcaaccttgtagcctgtgcagcctggattcagcagtactctcacatgctgagctgttgcctgaaacatgtttttatttactccacagatagggagtgaacccctgctacatgccaatcactgttgtagatactgaggatgagcaagacagacacccacagacacagacagatcatccacaatgcacccccaaataaatatgaaaatgtacaatttgaggttgctgcacatacaatgaataaactaaaatcggtggcaacacagagagggactgttgttgggcgtatgctcgtgggattagaactggatggtgaatattggagcccaggmtcactgaggagaagagggttgcctgtcagcccctggggaggagcactgcaggtggaggggccagtgagcacaaagaccctgaggtgggaacaggcttggatgtttgaaggtaagacaaggcagagtatctggagcacagcctgtggggagcatggcaggtgctggtcatgattgggtgcgcactgctggggacttggcttccactctgcatgagatcgggagccagtaaagggttcagagcagggacttcccccaggagatcactgtgtgagcagcagggaccatgaagggccaggagtggcctccctcctgtggtcactggttaattcctttccatccttcatatctaactcaatggccctttcctccaggaatttgtccccacctcgtcaccctgtcagatcccctgatgagtctcctagcaccaaccaccctccaggacactgacctctgcaggagtttcacactgatctctgtggtttatagctaatgtctgccttccccactagactctgagctgcttggggacaggcacacagctgccttggctcacctcaaacccccagcacctcgtacaacgcctgggacacagtgggtgctcaataaatgtaaagagaagaaataagcaaatccctggggtctcagcaaaatttccactccctcaaggagtgatgtcctgtttccacttcctccctcctctgtgcccccacacttcacgtctacctcttctgtagaatccagtatgaccatgaatgtgttgacatctgcacacatgcatacacacacacaggcaaggcatgtgtgctgtccttcactgtaccccagggacctccttgaagcagacagtgccactgtacaaagaacggcctcacacatgcccacctgctcagaggccctcggcttgggctcactagacagtctgtgccctgaaggtgtgtcaggggccaagccccctccctcacccagttaggcagcatcccccacagacctgctggcagcaggggcctcatgctctcctgtaccatggctccagaagaactcacacaaacaagggctcagctctgcttgcacagtggctgccttctgcaaaccagagatctgcatacacagactgaggagtgtaactgaggacaaaacactgggacgtctgacctctggtccagcccaagaagctggggaacgttggtccatatttctagagccaactactttttcctgtgaaaactcagtgcccacgatcgctggtgttgttagatcccagttaatcaatcaacatattcttgaaacaaacatgttagaaataaaatcgttaataaaaaataatactttacatgctctaggaaagcttggtatttaagaaattcctttgcagcataaaatatatttttttggaaagcaattggcaatttctatgaaaagtcttaaaatgggcatgtgccatggccccatgattctatttctgagggctgatccaatgtattaaaacctaccccaaaatggagctacaagaatatttgtcaaacagcattggttgtaagagggtaaggttgaaaacaatccaaatgtccagcaaggagtagtcaaattaattctggtacatctgtatgacggaatactctgcagctaaaatcatgataaccgcaatggtcagcacatatcaaacacttactctgtgttggggaccacattaaaagcattacatgcactatctcatttaattctgcctatgctgtacatattattatcatctccatctcacagatgaggaaaccaataccaaatagagttaaggtatttgcccaaagtcacacagctagtccctaggatgcatactcaggcaatttgactccagacaccagcctcttagccattatactacccggcctcagatgaaaccattaagggagctattgttgtagcaaggctagccacatggagcgatgttcacaatatgctaataggtatagcaagcaggttattaaagactacatgcagcctgatcccatgtgtacatgtgcacacaaagcaaaaagaggatgctttgggaagatttcacccaagattttacttgcgtgaaaatgttagttttcttctgcttgggttttctgatttttctgggcaaacgtgttgtttctatattttaaaaaattatttttagagttaaaaactaacataaatgccaaaagtcactccctcatactcatctcatgcataaatgcaaatgtccagctattggctttgctttaggtataggcacaacagcacgcataggcgctgcttgcttttcatggctcagcttcttcttgaagcagcaagggctctccagttgggaagagacgacacagattcttcccattgcacccttcagcagactgtccccatcatccagaagccctctgggcatttttgcctccagggaactgccaggctgatggcatagagctgggtgagctctctcctgacagccaagcccagggactccaagagcttgagatgatccacctcctgtctctgggtctctcaaggcagcaagaagtgaagggcagacaggcctcaaagcaacagagtggtccagggacaggagtcccagttctgcagccgtatatactgaggaccctcctggcctagtcacctgcttcctagctctgtgaccttggacaagttatttcttctctcagagcatgtttccacacctgtcaaataaagaaattaaaagtaccaacttggaagaaaagtaccaattggtaagaatcaaagtaatagataaattagacataaaacgatggtgccaataagtaacatttcctgggtactgacaacatgtatgatttctatagttctcacagccaccctatcagaaacactgtgatgatctgcactttacagatgatgaaacaaaagctgagagcggtaaagtcacttgtgctggaaagtagtgaggagggaatttctgccactatggctgggctcacaccactatacctcgcattctggcacaatgtctagaacatgggaaggccttcatccagatggttaccactgtcatcgctctccactagggctctctacctggctttggagagtagtgtgagagtgaggactcctcctggttctccccaccacccagacactcacacagccaccaggccactgacccactttaaggagctttcctttgggagtcaccaaaactcctccccaatacccgtccccacccccgcayacacacacataccctctttgagtcagttccagtgatcacagtcaatgactttgctgctggacagtctatgacaagcccctgtccagaactggccttgtgttctggcccagcaggggcccttgggggtcaggcctgcaggcactcacacttggcacctgctccaaaaccctttcaggtctttgaggatctgrgccctgggcctgggtctcccgccggctcggaaaagctggcctgccgggccagagagagaaccacacgattcagaaaagcagtgcccttcagcagcctctccaccgtctgggctccccaaaggcagagcgggacgctggaaatgwgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggrgcgggcgackggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacggtgagtgcggggagctccccttgtcgccgtctcgtcttgtcctgtcctggggaayccaagcgccaatttctaggcatcctgggatcccgcggggggtggtctgggtgggcaccaaggtggtcgaggggcaggagaccgcctagcaactaagccgttgccccgcgctcgctcrcagggtccaaatgcaagtgctcccggaagggacccaagatccgctacagcgacgtgaagaagctggaaatgaagccaaagtacccgcactgcgaggagaagatggttatgtgagttctcgctcctcaccttgagggggtgcgcactgctgtcaacccaatgccagggcacagcctgggcctgggtcgggctaacaaacatttctctccgactttgtcaaggccctggaaaagcctttgtaattgcccagagagtccttaggacgctggcgagacactctggaagacagtcgggaakgggggtcactgtcccgctccggaacagcgcctccaagttcacccttgctaggattcaaatgagcagtctccctatttgtaccatgggccacccactctgctagggccatcaagggttaaagggttcccttgtgccaactcagaaaacctagactgaaatcacttaaaacacactcacacccaaactgtgaggcgtgctgccttcctgtcactggatagaggactaatgcaaacactatcttaaatcctgagtctccttcagagccttgttccagtcagagacaagtggaccgcaagtttttggctcctagagattttattttgagaacgctccacgagcttccctcaccgactgtactccttgtgrgtccccaatacggagcagtactgcagaaagtgctctgctggggttaatgtgccacatggctggagccctgcttggtggggatgtggggaatgttggaaaaactggggcagagtgagagaacacttagtttcttgctcctccgccttcccaattaaccacttgaggccagcaccgctgcctcctcatcaatatgctcttggccaggaagggagcccttggcaaagcggctaccaaatatttgccacagaccattggcccctcttcccctcccccagaaacaggacgcactttattctcagtctgggcaagtgccctccaccagctggcccccaccggcgcaaaggccttcacagtgtctgcgaaagcagtgcacacccctacccagcaccccccatccccgtctaggggctacactgtcaggctgaaattaggggaattcagaaatccactggaactgagctgaccccactgccttccttcacagacacctaaattaacttgcttgtccctaccccttgccttgcagaccaaattcaaagaaaatacccaaaaatccttttgggtgggggccaagtgtcaaatgagctgggaaaggagctccaagctcctcagggcttccagtttgggggctaagaatgacaggggaattccaagttaaatctcactcgtctaagagctgaaaaccactctattaaccaaacaagtttctgagaccttgcaggggaagaaagcagggtaaaggatgcagtgatacctaaaaaggacagagccctcagtaaataggcttgctcttttcctggctaaacttttccacatatagagaaaaactatagctaggcaagtgygagaaaggctttacggagccttgtagaaacgtgcaggggcctcaggagatcagcacacaatccaatcaccctctactaaacctctaacccaccccctagggcctcccactccatccctgagggctgggggctcctctccccctccacaatcctaaaactctscaaatcagatgaggggccagcacttttgcaaagcaggttttcagccacaaaggctgaacaaaagcaaattttccagcttaccctgagtcacccagaaatctctgctgaggctgggggtgggggcaggagtaggggcggggggagaggtccgctttgcaagtgggagtccttgcacccagaaggatccaggagagtccgaattctagaaagagcaatttgtgtcataggtccatrgagctctcaccaaaacccttacccccaccgccagaactgtggaggagagggtcacaggactcagaatttctgatagttgctggagtcacaaatccctatgtctgcactccacaaccgattttcataatcccagtattatgacgtggcatttgagcactgtagtgagagggctgagtgacccttcctgctctcccttcctgctctccctgaccttcaggatttgggatgcacagcctgcacactgacctaactgagaaagggtttttatcaggcattaccacgtcctttccttcagaatgctaaagcagccttgtaggcagaaagagaaaagcatttgctaaattcctgcagggtgactgggcacagtgggggagagagacaaccagagttcactctgaagcctggcctgtgctcaaggctagaggaatgacccggagtcacagaggagtccagtcaaggcaggcaccatcacctggcatcagcaggaagacccgcccctgccccaaggagcttaggccctagcagggaccccagaaacccagagcacggagaagggaagagaacaggttgcctaggaacattatgcccccattctggtggcaagatccgattttctttccccatcaactgggagactgaagtaatgggaatcctgtcccttctagaacttagcccatataagccatgacattttccatttggttaacagtggggaactagctgacctctgtccctctcttctcactctttccactctcacttccagtctccccctttgccctccaagcccattccagcaccccagtctaccatcatggcttgcatggctgtgacccctcaagaagtggcatcctcacctctcaccttgcacttttccaaataccctaggtggtctcttattccccacaactcctgtcatgcctgtggcctagaggtgctcagaagttctgagcagcaggcttgcctcgccctccaggctggagcccccacagcaaggctactctttccccttggccacttcatcttccatgaccaatgactagtaacagtaactgttaattgtgcatctaccaggtcctgggtactttctaaagattgtatcttttaatcatcccaataaccctgtgagatagtcctattattatacccattttacagatggccaaactggattcagagaggttacccaaggtcccacagccaaatttgagattcagtcccaggcccttacagtctgcacaacacctgcttctctaccacatggctaggcttctgctgggtgttgggacattggctgatagaggcctgagatcttcaggctgtgcagaagagaggtcttactcttctgcttaggggtgagatacctgggacctcccacaaggccaacaagactttgcctcaggatcaggagatgcccagccctgggacaatctgtggtgggtcagagggaactggggttgaggagacagaaatcagagtgtctgcggggcatgtctgagccttgccatgagctcctcaaatccaaggacagaggttttggcatgtgcaccttgctggcattagctttctccacctcctgatcccaggctcagagaggctgggagtcctctgacctttgttccccaaaagaggcctgagccctggagacaacacactgcatgaggttgggggtgggagagaccatcccagactctcaggactcccaggggaaaagtgagggctgctcactacatacagggttaggccctaacatggagtcagagaataaggggacaaccagaaccttccaaagagccagcttggaagtgagcacacaagtcggctcccttgagaggaggcaggaagccacagtctctcagggccctgacttagcccagggctactcacaggccacacaagaggcaacatgttattcaggctcctcaaccctccacctcatcctgctccrtttcagcatcaccaccaagagcgtgtccaggtaccgaggtcaggagcactgcctgcaccccaagctgcagagcaccaagcgcttcatcaagtggtacaacgcctggaacgagaagcgcaggtacgccccgcctctactcaccttccttcccaccagacccagctgtggctctcaggatgggaagggacccccccaccaggtcatctagccccatctaatatgtgaacacccaccacaacatccacagcaaacagatactcagacaatgcttacatacccccagggacaaggaactcaccacttaccaaagctagctatccatctcttgtccatttgcaagcatggcaggtttgtcattttgtaaactaaagtctgtctcactctaatatttgcattataatcttaattcctctttttatttcagttacgtaagttgttaaatggcagagtgagcactggcatggctgccaggggagctctgaggacttcagtggggtgaaatgtgaccacttaggtgactgtgtatgttggctataaaactgcgctataaaaccatgaggtgctgaggatgatccttgccagaaacatgttttcttctccaaggtgccccactccctctgctgcccagaaacctgataaactccttccttcgcaggtgctggaaggcaccacaggtttggctctttaaaatcagagccactgttaaccaaggcgggcagcagtgttaagaccaccagcaccctgaaccagccctgtacttactgggcactgtttccttaaaatcagaaggtggcttcccatctctggtttcctggggtcttatgtctgtcctcggagggagaatccagttcctagctcccctgtaccatgcgaaggtagcctgtcctgtctcactcctcagatacgcagmgtctgtttacacatttgcctgcatagcatgatcaggaagcacacacacacacacacacacacacacacacacgcatgcatgcacacaccatgcaggtgacttccccaggaactagtgccagcacccctgctgcagagggggatatcaaggctaaatggaagagaggggtgacttgcctgggagcacagggcaaagccaggacagcaaaccaggcctcctggtgctaccccaccagctgccctcacagggtggaaggtacagccatagtgggtgcctgcattgccctcccctcacctggcccagccatgctaccccaagctcagccctgtgaccagctctcccagagctgacactcgggctcaacccctatacctgagccttttttgctgcctccaaaacagcctcatctgcagttgcttgaaatagaaagtgatgagagcaataaattattttctataaatctgctgggaatgaagccctctttctggtcaagccaggcagctcatgtggcaaaggccagaactgcgcagtccacactctgtcaccctccaggccctgtgtcatcaaaactggcagaaggctaatcccatgggcaggttatggaagaggctgagggcatcttgatctgattgctgggggatactcaaacctttagctcaccttgcttctcccctccacctgagctgcagcctggaaaaggaggcacccacaggtctaaacatggccctgcttttttttttcctgaaaattccaataacaaaagcaacgagagcctctcactaccaggccttctctcactttgctataaaattagttcacccctctttcttagagtgttgaggtccctgccctccccacctccctcccctgaaacaagttgaaaatatcttaatgaacatagaacagtgataaaggaagtgtttgaagtcctctttgtacagagagagagagaaagagaatgccaaagctaggttggaggaagtagaagggtatacggtgggctcaggcccatgggggccacacagaggagctctgtgcacttcagagaccagagcttccagggagcttcyggccaccacaggaagcagcctagtcaggcattttatttcaatggataattcagtggtcttactcagaaatcaagaacgagacagaaaagtgataggctaagtgtaacgtatggccccagggcagccatggggcagaactagaagaaagcaaaatatctaactgggcacagcttgagaggtgaggggaaggtggggctgggaacgagtagagatgaggcaatgcagccaggagcagggactgaggggcacaggcctcctgcaccactgccccaccccaccaaccacctcttctgtctccaggaagcagcttctagagctagcattcttctggaggacatgcattatttgggcaaaatacaaagaaatatacaagcctaagtcaagtaagggaatgcctcccacccttgctattttctctaaatagagaggctgagtacagacgcggaaagaaacaaggaggtgtgggagcagcccgccatgctagagaaagactacattcctgccactaacagtcggtggccactgggcaaatcttaagtctgtggtgcctcagtttcctcatatgcaaagcgggtttgttccataggcctctgaggacaaaatgagattgcagaagtgagattgcagatggttagaaaagacaaagccacactggtgtgagttttcatggtccccgggaccacatcctcagaaggatccctcccacttctcctgggggttcctgcagttctgggacaggggcattccctgcagaccagacgtgaatgaagccgcttagccagcatcttgtgaacggcctgcctcatgtcctgagccacttayacatgtgttttttctccccagggtctaygaagaatagggtgaaaaacctcagaagggaaaactccaaaccagttgggagacttgtgcaaaggactttgcagattaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtrttgctccattcctagcttgggaagcttccgcttagaggtcctggcgcctcggcacagctgccacgggctctcctgggcttatggccggtcacagcctcagtgtgactccrcagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacakaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtaccaaaattctagactgccaccttttttctatttaattaagctaggatgacaataaaatgtttaccatgtcctgaaaaaataaggacaaatatgctgggaaagaaaactggtatttcccaaatacctgtcaacaccatcacctctgtggaacgtgtggagctgtcattacagtcaggaagccaagaagccaggccttgaggctaaggctccttccccgacgattcctacccctgcagcaggtgtatcagagcaggcaggttggagcacagggaactagagggtcacgatcccagcctcctccacgcaagaccacactgagcctcagcaccagagggcagcaaagaggctggatgcctcagccaagggctctccaagttccctggggctgcataaggacggcaacaatagaggactggtgtaattattgcctactgtgagccagaccctgtgcggggagccttacatgccctatctctttgaatcctggtaacaaccacaacgggggtggttctattgaagctccattttacagatgaggaaaccaaggcttaaagaggtgagcacatcactcatattctcccacttagagaagatagtagatggggccagtcaagataccctggggtccagggccccaagatgccagggggactcggggaggtgggaaatgcccacctgggaggctgtgggactctggagctgggcagactctggactctggaggcgtgggagccacgcctgggagatactggagctgttcctgctcctgccaggtggacaggtggacagtagggcacacctcattgtgcttctagggactgcatgtcgtaggcccatgtaaagcacttagcaggataccagggcatggtgagcacgtggtaatggaagccctttttttatttttttatttttatttttttcctgagacagggtcttgctctgtcacccaggctggagtgcagtggcacgatcatagttcactgcagccttgaactcctgacctcaagggatcctcctgcctcagcctcccaagtagctgggactacaggcacataccaccatgcctggcaagatgggatctctctatgttgcccaggacagtctcaaactcctggactcaagtgatcctcctcccacctcagcctcccaaagtgctgggattacaggcatgagccaccatgcccagccagaagctattttaataagcacaacaccagaccagccactttgcactttgtaccaactacccacagccctgcatctcaccgtatcctaaagtcagccaggccctgaaacaggcctctctgccttccctgggttctccacacccagaaggactccaccctgtctgctacactagcaactggaagccagtcacccatgtccccttcacctccccrgaagcttcctgaaacactggttctgcacacacttacgaggacacccagcaagtaccctgtctcagcatgtccccggcaagatgctaccacaaacgcttttatcaccatcttatttcctcctggcggcttcagattacaccacatgtattcctgaggaagctgaagatcagagaggttgagaaagttgcccagagtcacacagctaccactcatcacaccctccaatggctgggcctggcagcctttctgctgaggggtggaggaggggcaagctgaggccacagtgagctggtgaccatgaatgccctgcagcagccctgcctttcccttcattatggagaaagaaggtagactagacagggaaaccccaagaccaacagacagaacagaatgcaagagccccagaagacagtgcataccagggcagggcagggcagagcagaggccaagcctcttgctgggagccctgaaccctgcctggcctcagagcagcaccagtggagcctcaggagggaagggcagtgtacaaagctggctgaagagccccggccaccgagagcaaaagctgctccaagacagcacaggccgtggggtgccgcttgtaaacaagccatacacactccctgtctttgctggggctctcctcgtcctgcctgtggctctagtgctaggccaccctcctctaactctgctggccccgatggtccctcccttctctgacatcccaagttacagattggatcattaataacagcaacagtgtcacctcacactggtccagccactgatccgggcactcacccaagcactggccccacatgctctgtctgcactcccacaatgcgctatgtggcaggtgcccagagaagtgaagcactttgcttaggacagtagaggaagtcctggaagtcaagcctcagctggtcaaagcgcagaaacggtggagagtctgcatgtaaatatctccattccctacagagatggggtcccaggacaacagaggctgggctatgcttccagggagagcttgggccctttcctcccgcagacagggattaacctgaccactaagaatagactctgagcccaaacacttcaccaaacaccaaatgaggacccacaggcgcctagaactgtgcgaggctccagggaagaatcttctctccccggctacagacctgtttcctgtacctcttctctgggcctcccagtatccctatgaagtgtccacttgccagcttccaggaaagagagtaatcccagtgcagcaaagcaaggccaggtggcctttcagagcgggctctgcactggtggctctcatgggcttccctggataagagcaagcttctcctctgcacacagggcagacccggcccacatacaggccccacctccactggagccactgcatcctcacagttaggcttgttttgattccaaatgccattgccctgacttcccataggctcgtcctgagcaggccctggtgctgtagtgggctgacaccagcatggccatgtcctcagagagctccagcctagccctgcagttcaactcctccacctcacctgaccgctctcagatctactccactcagagcttctcctggtcatcctggactgactacataatttgcaggcctaggtgcaaaaaaaaaaaaaaaaaaaaaagatgcaggcctcccgttcaaaaattattaagaatttctagacggcaacagcagggcattaaaccaagcatggggccctttccagacatgctctgtgcaactcacatgtcacaaacccatggggccaaccctgcctccagtatcaactctaatatccatataggtgactcattttggtcctgaattattacataatctgcactacagtttaacagttttatttgaacctgagcatctaagaagaagcccttcttagaaaccaggagctgtgtcatatgctgctttgtaaaaacctcccagaatctatgatagcacttacgaggtattcaaacacagttgaattaatattaggatcatagggagatccctgagaacatgctttcttcacgcattcctgagctactgctatgtgcaaaactctgctgggcaccatggggaacagaggtatgactggctgtgctcctttatcctcaaggacagagttcaaccattcattcacccagctactgttgcatgattaaacatctgctctgtgctggatgctggagatggcccctccagaaactcagtctacagggaggcaaagaagctgcctgaaattgcctgttggtctgactgccagacggactcacggcagactctggggcagccccaaagagcgggtgtctcacccagggtcagaggaggagactgatcaagacatctgtcagtcctgggaaggctcatggcagattgcaagtcattatcaggcaagaaaaaaaaaaaaaaggtgctgattccatcctggctctcacatggcccgtggccgccacgcccatgtgcgatgagatgggctagctgcggcagagcaccaggggcagagaagtagagaacactgggggatttagaggaggcccgggagcatcggccatgccccagatgcatgtccacagagcccagccccagcctcagtccccactcccctctcgcccagctcccttctctctgcctgtcctgccaggacaccgtgatgggggcctccggaacctcaaaggcaaagaagcccacacaacccttcctgctcaacctccacacaaggaagacaccgtgctgctttttagagcccctggggtgttttcttctcctcctgtttttgaaaagttacatggatattcttggaggtcttcaagaaagcactaaaaccctaagctattttcttgctttcaaagtaacatttcccagcttcctccacgcaggtccgcgctgagcctcaccaccagagggcagccaagagtccgggtgtctcagccaagagctttccaagttccccgaggctgcatgaggacagcgacaaggactagtgtaattattacctactgtgagccagaccctgtgtggagggccttacataccctatctcattgaatcctggtaacgaccacaacgggggtgttctattgaagctccattttacagatgaggaaaacaaggctcagtgaggtgaacacatcactcgtgttcacacagctagcaggtggaagagacaggattcaaacccacgtgtgtcgggctgcaaggagactgtctgctctctgaagtacacagtgtcttacagttcctgtccaccccagcccacaggatgctccactgtgctctcatgctccggctcagggctgaccccctgtttatcaaatggagattaatcacccagttaacctgggccacacgaacaaccagcctcagccaggtttgttttgctggtgtctagttctgtctcctacaggcagacatctgcagaaatcacatgctcctctagagcctctccccccgatccagaaagggagccccggagctgtgaaacggctgctccagctctcatttggtagacacaaattccacttcagtagaggagcagcagggttggttttcccccaacaccaaatacactgaagacgcaaaatgaccatgatgtcgtcaagttcaactcaacgctttggttagaagcaaaatgatcttctgttgggtaaaaaatcaattcaaagctggatttcaaataatctgccccatttcacaatgaggacagagttgatattccgggatgagtggtaggcatgtctaattagatgcagatgagactctgatctaatattcaaagtttttcccccagagcaacggggatgatgaagcaacaagctctttctttcaacccattgttatttaaaggcagtgctcacacaagaatcatttctaaatcacaaaggcttttttcccctgaaataatggcctgcaaagatagactggagttaggtattcacatcggtacagccaaaaaaaatgtcataagccaagaaaagtacgagacaaagcatacccttcaattcatttatagctactagggtaccaatcctgctgattccacatattttgaggggagcaaagtttaaccaacacaatagcaacaaccgcactttctttctcaccaaactccactataagtcctgttttgcagatgaagaacttaaggtttagagaagctaaattgtcctgggcagtgttaaaagttttggacactcctaggttggatgaccacatattctggttggcctgagacagtcctggtttatggtaattgacccaatgcaattatgaagaatgttccctttcactctcaaaagagtccgagtatggctgatatactgtataatcaccccactgacagggcctagcagaaaagtatatatgacggctaaggaatgatcagtcaacctctccgcttggatcaccaactcgtaagtgagtttgggccctttagaagttatggtaactctttaaccccatagagtaccctaaaatcccctgttccagcctggcctgccttccctgcagcctggatctgatgttgtcagattgttcgctgggaggcaccaggtattttggagactcatctgttgaatgaa

SEQ ID NO: 1683 - DNA, 24961 bp, Homo sapiens
tttctagctatgggaacttggccaagtcatttagcctcactgagtatcagtttcctcagctggagtaataaatatttcaaagagttgctgagagatgttaacggtacagtccatcgagagtacctggcacgtagtagagacttgacaagtgccacctccgcttgccagcccctaaacttgggctccctcacgcagcttgcatcggggaaaatgctcttgaactggcattggttgaaaacaggacgttggagctgaaagtgggtgaagttcaggtgaggcagaaatcagatctccaaggtctctgcacagatgggagcagactctcctgctggtgcccacagaaattcagccaacatctagagatgtttgttctgagtaggagtcagaggcaagatcaagttgctgaggtctggtttcccatcagggatgacaaaagggaggccaggaaaaggggcaggtcacagggctggtggttcctggtgaaagcagtgcaggcccaattgcggctgggcttaccgccaagtggattaaacactcaatgctctgaaacctgccaggctgacccttgctcagctcaatcagatctgccagggacattggcttgatgaggttaagcaagccattcaaggtgatggacaccccaattaccctgatgtgattgtgacacatcatacacccgtgtccaaaatattgcatgcaccccataaatatgtacaactcttatgtattcataataattaaaaataatttttgaccaggcatggtggctgatgcctgcaatcccagcactgtgggaggccaggcaggtggatcacctgaggtcaggagttcaagaccagcctggccaatatggtgaaatcctgtctctactgaaaatacaaaaaattagccaggcgtggtggcgggcacctgtaatccttgctatttgggaggctgaggcaggagaatcacttgaacctgggaggtggaggttgtggtaagctgagatcatgccattgcactccagcttaggcaacaagagtgaaactccgtctcaaaaaaaaataaataaaaataataatttttaaaaagagtaccatgaaagcaaaagtatgtacataagaggtatcttttggccgggtgcggtggctcacgcctgtaatcccagcactttgggaggccaaggcaggtggatcacaagagtttgagaccagcctggccaacatggtgaaaccccgtctctactaaaaatacaaaaaattagctgggtgtggtggcagacacctgtaatcccagctactcgggaggctgagggaggagaattgcttgatcccaggaggtggaggttgcagtgagccaagattatggcactgcactccagcatgggcaacagagtgagactctgtctcaaaaaaaaaaaaaaaaaaaaaaaaaaaaaaagaggtatcttttgcttggctcttgtccatatctgctgtgtgatcttgaataagtcacttcccctttttgttctctgactacacaggtagacatcagagcatcatgattctctatgttaattgttacaccccataaatgtgccgttgtttcctaatcattcgttgaagaccgagacctttttgctgaggacaggccccctgactggagtcccacactatctttctctcaaagcgcaagaatgagtggtgtgtaatttcctgtttctgtttctttaaaggaaacaataatttaaagccacctgcaaaggcatgaaggcataatcctgggcaaaagtggatttgtttcaacttattttctcaatcttctatgggatcatctcactcttagctaattctacgcaatgcttgcctttattgcatctttccaaagaattggatgttggtttcctaaggacagctctcttttgcactcatctgtttacagatatatatatttaatcaaaaatatttaacaactgcaattgccatgaggacatttgggagcaaacaaaattttatttatttatttagagacagggtctcactatgggagcaaacaaagtcttctttatttatttagagacagcatctagctatgttgtccaggctggtctcaaactccggagctcaagtgagcctcctgcctccacctccgaaagtgctgggattacaagcctgaatcactgctcctggccagaatcttttttttttttttcagttaatttagaaagtttattttgccaaggttgaggatgccaacccgtgacacagcctcaggaggacctgaggacatgtgcccaaggcagtcagagacagtttggttttatacattttaggggacatgagacatcaatcaacgtatgtaagatggacattggtttggtctggaaaggcgggacaactcgaagtggggagggggcttccaagtggtaggtatataagacacaaatggttgcattattttgaatttctgattagcctctctgaagggggcaatcagaaatgcatttatctcagtgagcagaggggtgattttgaatagaacgggaggcaggtttgccctgagcaattccccagcttgacttttccctttagctgagtgattttggggccccaagatattttcctttcacatttcctcccttttctttttaaaaatattttagacaaagcattttagaagaaaatgagtctctagtctcaggtttcatctgatttctcttggctaggatggtttattactataggggtaagtccggagttattaggaaagctcatttttagaaggttgtaaagtctcatgtcctgtgaagagaaaatagggggaggaagggagaacacaacaaacaaaagaacaatcctggaaaatcaagatacaggccagagtactccgaagttcacacatcagcagataggtatgaaagtggcttacgtctgtaaatatgtaattatttttttctgaggtttaagttgtctagctccagtttgcagggctttataaaagcacaacttagttttcagtgattccaaattagggaaaatggggggaaaagaaggaaaaaatttaaaatattattttggagacttgtagccaagaaaaattagaattcagtccaaactatagaaaataataaaaattgaaaaacattaggcaagactagaatgcaacaacaggtgtactatagtttttgaagcataatctttctccaatttcccatttttactaaagatgaatcatggtaagggaggagaccacccctcatattgtcttatgcctaatttctgcctccaaagaaagaagatgtaaaaactaaaaggcagaaatgaaatccacaagcaggtagcctggtgccacaccctgggcctggtagttaaagatcgactcctgacctaataggttatttgcataaaaaaggcactgtgaagatccctgtcctattctgttctgttctaattactggtgtatgcaacccccagtcatgtaccccctgcttgctcaatccatcacgaccctctcacatggacccccttagagttgtgagcccttaaaagggacaagaatcgctcactcggggagctcagctcttgagacaggggtcttgcccatgctcccggccgaataaaccccttccttctttaactcggtgtctgaggggtttttgtctgcagctcttcctgctacaatggtatgactggtttgctttatcatacttggcctaattttttgcatacagtgcagcaagaatcttcaactagtaaatgaagtgagtattgcaaagacagcaccccaccctcatggtgacatttagtcttaggccaaagtcaacatcttatacagtaggagtggagagtgtcaactcatgaataatctggttaagaggttaaggggttgtaagaaagatagttggcatttacaaaatatttcatccaacaaaaacaggaaacacattcttctcaaactcacacagaacattcaccaagacatattatgttctgggctagaaaacacactttaacaaatttcaacagagatatgttatgcaaagcatgccctttactacaatggaattaaaaaagaaacccacaaaagaaagatagctggaaaattccaaaatatatggagattaaagaacacacctctaaataacacatggggcaaggaagaagtctcaagagaaattttaaaatattttgggccaggctcagtggcttacgcctataatcctagcactttgggaggctgaggcagatggatcgcttgagcccaggagttcgagaccagactgggccacatgcagaaaccccatctctacaaaaaatacaaaaattagccaggcatggtggcatgtacctgtagtcccagctacttgggaggctgaggtgggaggatcacctgagcccaggaggtcaaggctgcagtgagctaagattgtgccactgcaccccagcctgggcaacagagtgagaccctgtctcaacaaaataaataaatatattttgaattaaattaaaatgaaaaaacagcctatcaaaaagtgtgggatgtagtgaaagtagtgtttagagggaaagttatagcattgaatgcatatattaggagaagaaagatctaactcagagagggatgaacaggtgaggcataggggattttaaggtagtgaaactgttgcagggcaggggagccccaaaactgggacaccgtccgggaaggctcttggcttcgtccaggaaggaattcaagggtgagctagaggaggaagaaaaaggtttattgaggcagcagggttacagttctgtgactgtccctgcagagcagggccaccccataggcagtgcctggagagcagcagctcggggcacttctatagtcacattcatacccacttttaaatacgtgcaaattaagggcaggttattcagaaatttctagaagaagggtggtaactgggtcattgccagggaatgagtaaactgttcatggtgctggtgctcatgccagccagtcttcaatctggccctgagtcaagccccacctcctatctcaaaactattctgcatggtgctgtaatggtggatacatgacatgttatgtttggcaaaatccatagaactgtaggacacaagagtgaaccttaatgtaaaccttaatgtaaatggacttttgttaattatgatgtattaatatcaattcatcaattgtaacaaatgtatcacagtactgttaataatagaggaacttattggcaggagagagagcttatggaactctctgcacattcagctcaatatttctgtaagcctaaaactgctgtgagaaataaaatccaacctgggcaacatagcaagaccttgtctctacaaaaaataaaaaatgagctgggtgcagtaacgcatgcctgtagtcccaggtattcaggaggctggggcaggaggatcgcttgaacccaggaagttgaggttgcacgagtcatgatcatgcccctgcactccagcctggataacaaagcaagatcctgtctccaaaaaataataaaataaaataaaaatctactaattgaaagggaaaaaagcatagtataataccattcttaacaaaaagaaaagagacctgtgtttgtgtgtgtgttaacatttgaaaaaaatctggaaagctctatatcaaaacgtttatagaggcaattttgtagtgttagaatcatagatgatctttccacttcctggtttttctgactttttttctttttgcagtgggcatgtattgctggaaaataccacagacaactgtgaaaggatttcatcaacaacaaaaaaaagataaagaaggaaacacaaaatctgttaaataagatttatgttggctggaggttaaaatgcatttccagagcagagttcagagaaaggctgggctgcttgttgctggctaaaggacaaagggtaagtttcaggaagcagaagagtgagcagatgaaattcagcactgggatcaggggagtgtctgatttgcaaaaggaaagtgcaaagacagctcctcccttctgaggaaacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcraccatgccattgacatcatctgtgggttcctgaaggaaaggtgcttccgaggtagctcctaccctgtgtgtgtgtccaaggtggtaaaggtgagtccaggcctgcctggccaggggaggggtggctgaatgtgcaagagttgagattgagaatgagagagagagagagagagaagcaaaaacctagaacccagggtgcaaatgtgagtacagagagctgagatcttctgggctggtggtttcttatttatccacacagcatgttaaaatagattctggggtgaaatcctacatccctattattaacaagtgaccctccccgctacttcccgctgaagtttatgaaccactgtcctgggcgatgcccatttcagaaatagggaactgaatcccagctctggtaaacagtttgctaattcgtggccaggctaggggctcaccatttctgcagtgaagaatcatatgttttgaaagcaaatagcacctgctggctgcaagaccttgagcaagtcacttaactactctgtgttccaatttcctcagccataatccccaatactgttgcagtcttgccagtgcaccttaatgtagcagcttctcactgaattagtacccaaggttctttgtcctgcatccaagaaaattaaggaacatggacacaaacgtgagcttggagcaaaagttcagtaagcaaaagaagaaagctgtctccactgtggagagggaagtctgagtggattgccagattgcagctgaatgcaaaamacttttataagaaaccactctcctccctgtaactgtttgagaaactttttatcagtaaagctgtgcaacttcccttaccttatgcagctgtgggtatatctctaggcaagcataaagcgctgcttctcttgtatgtataactgtggatttgttttaggtaagtcccactccctgcgccagtttcaggcaggccgctcctccagggcccagccttgaccatttacctaactgatttttcctctactttccctcaatacctcatagggccgtgyagattaagtaaaatagtaagtgtgaaccacccagcataagctagtcctgggcatcgtaaaggacaatgggaaaagaacacagatcctggaagaaggcccccaggtttgaattgtatttgccacctactagctgggtgatggggctgatayattatmtcactgagcatccattttcccatctgtaaaatgggaactaatgataatggcatccaaatcatagcatcattgtgagcattataggagtttaagacatgcaatgccttcagaacagtggctagtgctccataatgttagtgattgctcctgtcattttatttagggaggtttgcctcactaagcatcaattattatttttgtcgtctttttcagggtggctcctcaggcaagggcaccaccctcagaggccgatctgacgctgacctggttgtcttcctcagtcctctcaccacttttcaggatcagttaaatcgccggggagagttcatccaggaaattaggrgacagctggaagcctgtcaaagagagagagcaytttccgtgaagtttgaggtccaggctccacgctggsgcaaccsccgtgcgctcagcttcgtactgagttcgctccagctcggggagggggtggagttcgatgtgctgcctgcctttgatgccctgggtgagagctcccagcttctttttctccctcttcccatttctgagcagaaatctcccacagtttgagagctttttgccccaacagggcatctctctaaagcagggtgggaggagatcttaggatctgtcccggggcaagaatgaatacggkcatgatctatcacaggagagacattaaacagcaaattggcataatgtggggacaaagacatttcttacagaacatctgcaaggcttactggttctgtttaaggcaaaatgtgtgaattttatctttctaaaatcaggcagcaaagatgtggcttaaagttcatgttactctcatctttgtcccaacatgagatctcatcaaacgtatgcagcacgttgggagatagatatttataatttgcaggaacatttggacaggaagtgtaacctctcagaggctcccttgccacatcaggagaattgrtaaaaccacactacctgtatcatatcattattttaagtgataaatgatcatctacattcagctctgatgagtaataggtgttcaaaaataggaacttccagccaagtgtggtggctcatgcttgtaattccaacacttttggaggctgaggcaggagggtcgcttgagcccaggagttcaagaccagcctgggcagcaaagtgaaacctcatctctactaaaaattttaaaacattagccaagtgtggtggtacatgcctgtggtcgcagttattcaggacgctgagactgaacgatcacatgaggccagccaaggattcgaggtgtcagtgagccacgaatgtaccactgcactccatcctaggcacagagcaagagcaagaccctgtctcaatcaatcagtcaatcagtcaaaactatgaatttcccagctgtatatgaaggcacctcaaaacaccacagtgaactcacagagggacacggaatagtttagattttaattttttgagggaaatgcgatgacatctgtcacacaccgcacaaacggctactattaaactgaacttactgattagtggctactaattaatagttggtcattaagcagtaattagtgattaattatcaagtaattaggacttaattaaaggaactgtcacagtttcctttagtcctagggcagccatgaaaaaaaaaatgctgactctccaaagacaccagggtatgagaaagttttggattctctcctttgtgccatctcctgtgttgggggctgaagtacaatggttgtaaaagacaagagggagaaggctggtcacagtggctcacgcctgtaatctcagcactttgggaggccaaagtggggggatcacttgaagtcaggaattcaagaccagcctggccaacatggtgaaatctcacatctactaaaaatacaaaaattagctgggcgtggtggtgtgtgcctgtaatcacagctactcgggaggctgaggcaggagaattgcttgaacccaggagatggaggttgcaatgagccaagatcatgccattgcactccagcctgggcaacagagtgagactccatctcgaaaaaaagaaaaaagaaaagaatataaggagtgattaaaaaagaaaagaaaagaaaactaagtagggtgaaacaatagatagccatgggggttagggagcttttttagacagggtcgtgagggagggtccctgagcctgagtggcgagaaggagtgagccttggggagatctggaggttctgggaagaggaatggcaagtgcagaggccctgaagcagcaatgaccatggcacatttgaggaagagagaaaaagtcagagaagtagaaagtgggcaaaggaagcaagacaggaggtgaggtgggagaggttccagagaccagatcacaccagacatcattggccaccataagatctttgggttttaaaattccagatgttatgggatgcaggaagcagcatgatcagcagcattctctaggtgccaggttgagaacaggctgtgggggaacctgtaaagaggttgctgccatagttccggcgagtgayggtggtggcttggatggggtgatggcagtggagagggcaggagggaggatcaggaatggacctcaagacttcccagccctgggtctsctgcacttttcaatcwaaccccatggccagggagattgtcccctcagagtgactgaaggaaattcagagaagagctgacacctaagttgtagattttgccygaacaggtcagttgactggcrgctataaacctaacccccaaatctatgtcaagctcatcgaggagtgcacckacctgcagaaagasggcgagttctccacctgcttcacagaactacagagagacttcctgaagcagcgccccaccaagctcaagagcctcatccgcctagtcaagcactggtaccaaaatgtatggccctcccaccaggcctggtgggtcctgtctcgactgggagcagaggaggggtggggggaggagagaaagaagggagtgaagggaagaggagggggagtggtggagggaaatagagggatggaaaaaggagagaaaggaaaaagaggtggagagaggagcctgcaacagaagggagaatgaaagggaaggaagagagaaaggaagggattttggtgttctgttcactgctgtatccccagaacttaaaacagagcctggtgcataataggtgtaaataactgttgaataaatgaatcaatgctacatacacacacgcacgcacacacacacagagagagagtcaaccacactcttcagaaggtggataagttaaaacaagagtttcaaacaaatatatgttcagatgccctttcctcccacttactggctggctggccttaagtaagcaacttaacctttctgttctttctgctttcttatctgcaacgagtagcatgccatagctagagtaacacggcatatagttggtcctgataaatgtagcatattttagccaccataggagtacacataataaaagctaacatgtagtatgtgcttagcttatctatgttttgtggatgtgatacaattttctgttcacttttaaatgccctgcatcttagtcaattttaacagtgattctgtaagttagataaggttaggcattattattaaatccattttacaccaagagaaacttgggtcaaaaagagaaactcctgggtcacatggctcattcggccaataagtagcagaagtaaaatttgaatttggctgggcgcggtagctcacaccagtaatcccagcactttgggaagccaaggcaggtagattgcttgagcccaggagttcaagactagcctgagcaacatggcaaaacctcgtctctacaaaataaactaaaaatttagccaggtgtgatggtgagcacctgtagccccagctactgggtaggctgaggtgggaggatcgcttgagcctgggaggaggaggttgcagtaagtcaggattgcactactgccctccagcctgtgagacagagcaagatcttctctcaaacaaacaaacaaacaaacaaacaaaaactcgaatttgggtctattgacttaagagtttgcctgataataataggcattcaatgtatatttcttgaatgaacgaatgaatgaaaataatcaggaataaactttccaatttaaaagtaacacctctaggtaaaaaaaagacaatcatttagttgccagacttctaagtgtttgctgttctatgaattgtaatcatggagcctgagcattgtagaatttacaaaagcagttcctgacaaaagcagcactgcccccagggacatattgaaaattaatgagggtgtttttggtaaccatggtgatgggaggacatgggtgctacttatatttagtggaaagaagacaagaatgctagttattgtacaatgatcaagagagtcctgcacagccaagaattgtctttttctttctttcttgatgctgttctcctttaaaacaagacaagattaacaataatttaactccactaaccaccatcatcaccacctccaacttatatgctacatttcttgtatatttcaagtctgtttatattttcaagtgcctcgaagtattattgttttatagccaaatgtttagttaatctgctcacagatttaccactttcttcactattcattctktcttacacctctaacattccatctggggtaattttcctaaatgatcatgcatcctttgggatttcttttgatgatggtctattggtagtaaactctctcagttattgtttgtctgaaaatgtcatgcttttgccttcattgttgaagggtgcttttgctgggtggtcatttcagtatattgaatatatcattccatcttccagtgtcatcattaaaaagtcagttgccagtctaactgcagctcttttataagtaacctgtcttattcttctggctgcatgtaaaagttttctctttgtctttgattttgtttagcttcaatctgctgtgtcttaatgatgggttcctattgtttgtcctgattgggattccgttaagattcctgaatctgtgggtagatatctttaatcagttttgaaacttctcagccattcttctaaaatattgattctccttcattctctcctcaccttctagaattccaattaaatgtatgttagaccctgctctatctttcatatctctatactctcttctgtgtttttcatccttttgtctatttttccatgctttattctgaatagttccttctaatctaccttccaattaactaattttctctttagctatatctaatttgctgtaattaattacagttgccatttttatcctaaaatttctatttcatatttttgtatctgccatggtacttcttatggctttkaattccctgctaactatttaaagttcttattttatcctgtgaatatgatattcctagttattttatttttaatttttattatttgttaatcttatgttttatttacacttcttttctgtgacatgagcacacacagattcatgtgtatacatatatggctctgatacctctcctttcctgtcctcattcaaaccactgatcacagagagaggactatttttttttatttttaatttttctatttcaataggtttttgggggaacaggtggtgtttggttacatgaataagttctttagtggtgattttggtgcacccatcacccaaacagtgtacattgtacccaatgtgtaatcttttaacccttgccacaccccaccctttccccgcagtccgcaaagtcccatgtatcattcttatgcctttgcttcctcatagcttagctcccacatatgagtgagaacatacaatgtttggttttccattcctgagttatttaattaaaataatagtatccaattccatccaggttgctgtgaatgccattattttgttcctttttatggttgagtagtattccatggtgtgtttgtgtgtgtataacatttttctttatccactcattgattgatgggcattygggctggttccatatttttgcaattgcaaattgtgctgttataaacatgtgtgtgcaagtatcttttttgtataatgacttcttttcctctgggtagatacctagtagtgggattgctggatcaaatggtagatctacttttagttctataaggaatctccacactgttttccatagtggttgtatgagtttacattcccaccaatggtgtaaaagtgttcccttttcaccacatccacaccaacatctattattgtttgattttttattatgaccattcttgcaggagtgaggtggtatcacattgtggttttgatttgcatttccctgataattagggatgttgagcatttttccatatgcttgttggtatttgttttttttttttttttttcattattatactttaagttttagggtacatgtgcacaatgtgcaggttagttacatatgtatacatgtgccatgctggtgtgctgcacccattaacccgtcatttagcattaggtatatctcctaatgctatccctccccaattccccccaccccgcttgttggtatttgtatatcttcatttgagaattctctgttcatgtccttagcccactttttgatgagattttttttttcttgctgattcgtttgagttctttgtagattctggatattagttggatgtatagattgtgaagattttctcccattctgtgggttgtctgttaactctgctaattatttcttttgctttgcagaagctttttagtttaattaagtcccatctatttatctttgtttttgttgcatttgcttttgggttcttggtcatgaagtctttgcctaagccaatgtgtaggagggtttttccaatattatcttctagaatctttatggtttcaggtcttagatttaagtatttgatcgattttgagttgaattttgtataaggggagagagaaggattcagtttcattcttctacatgcaacttgccaattatcctaggaccatttgttgaatagggtgtcctttccccattttatgtttttgtttggtttgtcaaagatcagttggctgtaagtgtttggctttatttctgggttatctattctgttccatttgtctacgtgactatttttataccagtaccatgttgttttggtgactatggccttacagtatagtttgaagtctgataatgtaatgcctccagatttgttctttttacttagtcttgctttggctatgtgagctcttttttggtgccatatgaattttaggattgttttttctagttctgtgaagaatgatggtggtattttgatgggaattgcattgaatttgtagattgtttttgggagtatggtcattttcacaatattgattctacccattcatgagcatgggatgtgtttccatttgtttgtgtcatctatgattttctttcagcaatgttttgtagttttccttgtagagttcctagttattttaaagtctgtgttcggtctttcagcatttaaagtttgtaggtttattactatttctcttctttctgttggtcataactcttagtgttttgtttccttgtgtgcctggttacatatgtgctggtcattgtatttgaaaattatgtgtgaaataatttgaggttttggattatgtatattcctccagaaagaatttcatttgcttctgtgcatttcttaggaacattacaagtccttcttctcagttaattttcgtagtatctttatcagataggtgctattacaaccactcacttagcagatgaaaatcatgaggctctgagagtctaagtcatctacttagaattggacaatggtgaagccaggattcaaacccacatcaataagaatccagcgctcttaacaaggggccagtacacttttttaaaaaataaaaggctagatagtaaatattttagactttgtggactgcacagcctctgttgcaactactcaaccctgcctttgtagcatgaatgcagtcataaactatacataaatgaatgagcctggattcgttccaaggaaactttataaaaacaggtggcaggctggatttggcccatgagaagtgtagtttacacaaaagttgagcaaaccaatttttttctgattgtttttcctcttctcagtgtaagaagaagcttgggaagctgccacctcagtatgccctggagctcctgacggtctatgcttgggagcgagggagcatgaaaacacatttcaacacagcccagggatttcggacrgtcttggaattagtcataaactaccagcaactctgcatctactggacaaagtattatgactttaaaamccccattattgaaaagtacctgagaaggcagctcacgaaacccaggtatgctatccccacatggcttagctcccctatgtaaatgaacacctggatacaggtacagtgccttggaaatggaggaggtgggagggctccccacttagtgagaatctcctgttgcccatcattgtactgggcattttactactgccatctgttttaaacacctacctccaaccctgtgaggcaggcactatgccaattattttacaggtgagtaaactgaggttctgagaggtaaggagcttgtccaacccttaacagaaaatgagtaaaatagctgcagtttgaactgaaataagaacagcagcaacaacaatgatagtaattgctcccaggtattgaaagcttgttgtaagactaacacatgctaatataatagtaaaaattattagcaatattactgatatgtatgttatgttctagtcgctgtgctgagcatttcatataactgggctttttctatcctcacagcatagcctttgagataggtatgtggaactattcccattttacagataagaatcctgaggcttagagagttcaagtgacctacccaagggcacatcactgataaagggcagaggtgggattcaaacccacatctgtcaggtgcaagtgcaaggctccttctcctcatgctcactgcctgctggggaatagggcactggggacataccccagggagcccttcctcatgttctgagtcccagttcatcccatgctgctattttkctctcccaggagcatctggactccctagacagagccccagcttctcacctgtccctctctaaatgctgctctgcaggcctgtgatcctggacccggcggaccctacaggaaacttgggtggtggagacccaaagggttggaggcagctggcacaagaggctgaggcctggctgaattacycatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacmccatttattgactgtctgcttcgggctcaggttctgtcctaagccctttaatatgcactctctcattaaatagtcacaacaatcccatgaggcatttttaaaaattttttattattttagattcagagggcacatgtgccatttgttacacagctatattgtgtaatggtggggtttgggcctctattgatcctgtcgcccaaatagtgaacagagtacccaaaaagaattttttcaacctttgcctttctcccttcctcctccctgttggagtccctagtgtctattgttcccatctttagcagatgttaagtatttgattttctgtttctgggttaattcacttcggataatggcctccagctgcaaccatgatttcattctttcttatggctgcataatactccatggtgtagatataccacactttctttatccagttcacactgatgggcacttaagttgattccatgactttgctattgtgaatcgtactgcgataaacatacgagtgccggtgtcttttgatagaatgatttctttacctttgggtagatacygagtagtgggattgctgggttgaatggacattctacttttagttatttgaaaagtcccatgaggcatgttttctatcattcccatcttacagatgagacaaaggctcagagaggtgaggtcacttgctcaaggacatcagctaacaagtggtggaaatggaattcaagctcagtggactctaaagccagtgctcatgtcactgtgctaaacagcctgccttgtcacatccccacctctcatctgaccaatgggagactctgagcagctgagtgacttgggttgtcacacagctaaacaggggcaaaggacccagtcttggatctttccacctccaagcaggaatctgtctgattccaggggattgatgatgttgcagatggctaggaagcagactccaggatggaatttagtatgcaggatgttctgggggagagccactggaaccagcactcagggaaaggggggaagaaaggataggaaggaagcatgaaagagaatagggagaagtgaacagggatgcagagcgaatgccagtttcagccaactccaaggacagccctggagctggaatggcctttagagctgccccatggtgacagaggtggccaggcttctatacccctacgtggatcactcactgtgcttgggcaccttgggaaagggcatggctttgagcaaaaggctctctgcagctgaggcaacccctaaaagggctgacggctgaagtctgtctgctgaccactgtcccagcagctggggcttgttagtccttcctcaaagggggatccagatggcatgtcacagtgtctaccgtaaatgctcactgaatccagctgcaatgcaggaagactccctgatgtgatcatgtgtctcaccctttcargctgaaagcaacagtrcagacgatgagaccgacgatcccaggasgtatcagaaatatggttacattggaacacatgagtaccctcatttctctcatagacccagcacactccargcagcatccaccccacaggcagaagaggactggacctgcaccatcctctgaatgccagtgcatcttgggggaaagggctccagtgttatctggaccagttccttcattttcaggtgggactcttgatccagagargacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccatttattgggtgtttattaacttcaaggcacagagccaagaagtacagatgcatatctaggggtattgtgtgtgtatatacattgattcaacaagaaatatttattgagcacttactatgtgccaagcatagctctgggcactgggaatatagcaatgcacaaaagcagacagaaatccctgtcctcatgaccctgcagagccaagacttccagaattttttaaataaaaaaatccctgtcctcatggagttgacatttgtgcaaaacatcttaatgttagatggttttcctattactaataattctgaaataagcatccttgatttatcctttctccatatctctgagaaaaattatagaacctccctgtgtgacacagcagccactagccacatgtgtcaaatgcttaaaatgtagctagtctaaatctacatgtgctgtgagtgcaaggtatatacttggtttcaaagacttagtacaaatgaaaagaatgccaagttcttgccaactgataatttttttaattgtgtgctgaaatgacaatttttaaatatatttgagttaaatcaaatgaacttcatctctttcttttccctttttaattgtggctactagaaaatgtgaaatcatacatgtggcttgtgttatattatgtatttctattggacagctctgtcctccaaggtaaatcactggattaaagattcgactatactgacttacattgccacattgtcacactgtccttgggaccaagaatcaacatatcattcataagactctaaaatataaaactctcataaatactcacaaaagaacctagcatgctctgatcacctgagttgctggtcacttttggtggctggtaagcagcctttggtccgtccagattatattcttccatttagtccccccacatccctgtgagatgggttttgttgttattctcataatattaagtggaataacttgaggttctaagaggttacagtgcttgcccagggtcacccagctggtcaggggcagagtctgaacttgaaccctaatccttctctctctaaagctcatgttcttaatcactgcagtatggtcttaatgtgtcctcattcattgaaagcttatgttttcctactctggcgccatgagaaccagaagcatcaatgtccaggggcagggaaagatgaatgtcccagctcaacctgagcacagattcacccttcctcggtctttttgtcctatttgtagactggattagatgatgccagtctactgattcaaatgtgaatctctttcagaaaaaccctcacagatacacctagaaatgatgtttcaccagctatcttggcacccttagcccagtcaacttgtcacataaaatcaatcatcacacactccatgctgataggcaagtgtggacatcccagtgtaatggcttcattgtattttaccgtgtggaaaatgcacttgtgttgccttttgagagtgtttcattttatagcaatgccacaaccaacagtagattaatggaatcagtaattagttgcttgatcgaagagccacatggccacgtgatcagccttccatctacaacaggacccaggagtataccaggattgtttttcaaagggcatagacatttttgctgcaaatgacatgggcttactccagagtcctggaggggtctgtgttataattctctaaatagatattgccataatctctgaatgacaccttttcccatgactaacactttgaacaccatggggtctgccaggctggtgtgggccaagtagaggggcgacttgcaccacagcctataccagctgcagagccctttaggacttaataaaagggtgctaatttctgtatttccctggctctgagatgtaatagtggttttaatttactatcctggccagggaggtggcagtttcaaaggtatccccatgaccttcctcactgtgatagccctcacttaaccctcaggccaatgtggggtagtgtcttttaccaagcatgtcctttttgaatatacattcaggggacagggaaatgatcaccaggtcggtccatagacacagtgggcaaatgacaagcctgacttggccagggctccatttttcactcttggctcctatatgcccctactctgatggggacagaatctgatgacgcttttcgttatcagtgttgatcctctgcccaacagtcttagaaatgttgagtgactccccttttccagtgtatcatcctctgaataaatggccataggtcctttgggggaaaccattactatatatgctatggtgtcacagcrtcctttcccaaggggactctgcctcctctttgttaatggggtctagtctgaaaactgggttggtcagttccaaaaatcaggaagggatgatgactttttattggaatggctccccttaaccccctggtcgtccggccttgatttcttctaatggtataaattgagtagtgccctttcaagatactcatccactaagtcactaagaggccacattgtgttaaccaggtccctaaccctgtatcagtcacgacccctggctgcccctccaacctcaccgttcattatagtcattgcacccacctggcttctattgctctgggagtcctgcctgccctattgcccttatcaatccaagctctgtaacagcccctcttcccaggaggccaccaccagaacacctcatgatgcaggtgtccctctctccacacattccttatggccttggggaatgttttgtcccctgggactctatttccagacttacatagtaaacatatccactcctcttcactgtgcccatttcccttggcctcttaacaccttcttccaccagctccacagcaattctggaatttcatacttttctgcatttctaggagccatcctaggagtcagggaaaacctcggcttcacaagtaaatgggacttcagttgtgtgccaacatgcctggctaatttttaaatttttttgtagagatggggtcttgctgttttgtccaggctggtcttgaactcctggcctcaaacaatctttcctcctcggccactcaaagtgctgggatcacagctaccattcccacacacattttcttatttttaaaggctgtatgtgcactgtatacattaaatgtgtgcactgtatacattaactgtgtgcactgtatacattaattttctttaacgaatttatccatttatagttgctttggttgtttccacttgattattgtgaatagtgctgcagtaaacatgggaatgcagttatctctttgatatcctgatttcaattcttttggatactcagaagtgggattgctggaacatatcgtagttccatttttaattttttgaggaacctccatactgttttttacagtggctcaccaacagtgtgcaagagttcccatccctctacatcctcacacttgctatcttttgttcattctttaaaaaatgatagccatcctaccaggagtaaggtgatattgcattgtgattttgatttgcacttctctgataattagtgatattgagtatattttcatagacctgttatccatttgtgtgtcttctttggagaaagatctattcctatccttagcccatttttaaatcaagttattaatttttttgctagtgagtggtaggagttccttacatattgtggagattaacccttattagatgtatggtttgtaaatgttttcttcattccatagattgtcttttcagcccgttgattgtttcctttgctatgcagaagctttttagtctgatgtagtccaagttgcctatttttgcttttgttgcctgtgctttgcatacgtgtccacctgatctttgacaagattgccaagaatacacaatggggaaaggacagtgtcttcaacaaatggtgtttggaaagctgaatgtccacatgcaaaagaataaaattggacccttaccttacagcatacacaaaatcaactcaaaatggattaaagacttaaacgtaagacctgaaactgaaactactagaagaaaacttaggggaaaacttcatgacattggtctttccagtgatttcagggatgtgacaccaaaagcacagacaacaaaaggcatttatttttatatggcatgtgaggaaggggttcagttccagttcttccaatgtggatgctcaattatcccagcagcatttattgaacggatcatgttctctccacttctttgcaaagccacctcttaaatattcccagagcccatctatgtgggagtctgtttctggactctgctcttttccattggtctattttttgtgtccttcagttaacacaaccttgtcttaattactataaccttataattcttagtatctttgggagaactctgttctctttttatcaagtcattggttcctcttggccctttttatttctacattaattttatactcaatttgtgaagctcctcccaaaatatggggaggcatttgattagaattacacatattagcttgggaagaataacatctatattttatatatatatatctatatagaatttgatgattctgatccatgaacttggagtttcttttcattaatttttgtcctctttagtgacagtgacaatgttttatcattttccctgcagaggtctttcatggtttttgtcgtatgtattcccaaatatttgtttcagtactatcgtacttggcatgctttctttaatttcattttgcaatggttgcttcatgggagacttaaacattttcagtggtgatatttggctatagcattataggtgatctttatacttttctaaattttctgtggccacgggaaataataaagacacttttcttgcacagaaaaaaaaaacttttgggaagtatttctcacagctaagatctgatagtttacgcaaagttggcaggcacaggctacagaaagctctggggtgctgttgtttggagctgctggttcaaggacaaattcacaagatttggaaacagaggagcaagtgtgtaaggacgagggaaactatggtataacattgaagcacctgagctggaaatttctgagccctcagagataaatttcctcagctcctccctgccgagaaaacaaaactaaaaagagttaatgtttagccaacagaaatgagagtgaagttcacagaagaaattagggcacagctggaagtgttcaaaatgaggaaacgttcaatgtcaagtttgaggtccagggttgatgggtgaactckgcacgctcagcttcatgttaggtctcccagctcaacgagggggtgaattttggtgtactgctgtctttgaggccctgcgggaactctcccacaccctcccccttttcctcacacaaatcccctccttgcacacccctcacgcctgtctgtgaggtgccagggcccctctcccagccaaccacaggccagtattgcccctccccaaacttcccttcaggcagatcaaacccagggctctggagtcacactgcctgggctcaaatcctgcttctgaatcttatgagatgtcaagtcacttacctaactccttggtgaaacaggctctcctctgtcaaataggtgtgcatgctttgggaggccaaggcaggaggattgcttgagcccaggagttcaagaccagcctgggtaacgtagtgagaccctgtctctataaaaataaaaaaattagccaggtgtggtggctcatgcctgtagtcccagctactcaggaggctgaggaggaagaattccttgagcccacgaagtcaaggctgcagtgagccatgatcaagctgctgcactccagcctgggcaacagaatgcgaccctgtctcagaaataagtaaataaataaatacataaataaatttgggtgcaattgtggctcttagtgttacagagaggactgaaggagctaatggatgatggatttatggcagtacctcacatatagctt

SEQ ID NO: 1684 - DNA, 32572 bp, Homo sapiens
aaactcagatcatactcctggcccatttaagagatggttatcaaattccaattaaatagagaagtgggtatatttcaaagtgtatcgtacagttcttgtgtaatcaccctcctgttcctccctgaaaatctggcaggtgtatggggtggtggccacgaggctgcagggacatttgcccaggatgaaacagttcccagtgaaagggtcatgttggtcagggttcagcccctctcaaaacccttctgcctggggtaaagcagaaaagtccgccagcaatccgacagcacgccttcttagccacgggactgtggctgagcagtgggcttaggccccttccctctaagtgttaccaataatcctgcactgggatggattcttaacagaggtggggattaacagagctggagctctggaccagcaatctcagttcctctgatagtgagcgaagaattgcagactaacaccaaaatgcaagctcaaggcaaagtgtattgaagcacagtaatatactctcagagggagagcggaatgatttctgcgaagtgaaataagcccctctttacagggtttaaggtgcttttatggggtttgtggggaggagtcaaggtttgggttgtgtctgagtaacaggatgatgtcatttgattggcagtttatggttatataactaaaattaaactggcatggttttacccatcatttataaagaaaagcccactctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttgttctgaaagggtattgacctggttagttagattaataatttgttgagtaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtatgtttgcattttttgttgtcagtgactaagctgacacataattgggtggaaaatagggtacaagtgtgattgcaagccttggaaatattaggaaaaaatccaagtaatggcctcatcctcaatgaagatagaagacaaaggagtgcttagtcagatagtattacagatagacgacaggtcctcggaggttgtaacaggtttgttggtatagacttttaaggagtatgcaattgactgtgggctcgaccctaggattgacagcttattctggtcggttaacagaagtgggggctggaaatgtttctgattgattccactcagaagcaggaatggaaatggctgatagacctctgctagggaaggtgtaaacacagattcaacagtttctgtgatgttgtgcagtccgttgatgttgtgtttaaacaaggttttaaaacttctttgatggtagctaaatatgggtgttggaaaaaaacattaggagaaatgattgcaagggttaatctagtttaaaaagcaaaaatattggttactgcatttaaaacagctattttagcataaaaaattatttcacccattcaggaggaggcaattgaactgcaaatatatgagaataactataacaatccaacttaaagctaatatttaaaaaaaggcactagggaaagtcagtgggcattacttattttttggcagtcttttaaagagaggcttgaggtccactaaagtctcacaagtgtatttgtctgtggagacatcatcagtttgggcagccctctgtggttttacataggagtgtggatgcagctggcaatccagaatacacagcactgagatcaaggtagtctcgacatcccaatatccttgaccattaccaggagagagtgtcccctgctctttagatggaggctccgcctcccctggggcagtctgtgtgtctctcaagttgtacctatgtgtggaccatggctgtgcccagcatggagaccccttcctacagtgggtactacagccttgctgaaaacatttgtcccctagattctgaataaaagtggttagaaagaaagaaaagaaatgaagctctgttcaaaagaaaaaggaaaaaaaattgcaaaacgatcttcagaagctgtgctgctgcctatggcagtgtggcagggagggggcctcgggtggggtgagtgcccaaaagggtgggcraggacgatttggggagttctccaaaggttatgacccactatgggcctacccttcgttcccggctgtaaacctctaaacttagcatttatccaagctatcccatgatctgaatcccaatcggctctcttaatcagtaattttaaaaattgcatccagccaaaatgcccagtctaaagggagttgagggtgattcctggctctgtggccagagcataagaaaccattttgcctctcaaagcttccctgggctgttaacaagctctgggcttcaatggccactacaacctaatgaagttgtttaatcacgttaaacagctaattaaacctaaatccagagaagatttctctaagcccttctctaaaagttattggtggcatgttgggggatataccccctctctaatgcagcaaatacaacactcattgcaacttctcttagccaagcagcgaaacatagcacaaacatcttgacccaaagcgaaaggaagcattttagcaaaatatgtttcagttccccaagctaaaatcaagcacatattaaaagccatgctgaacgtaaatcatccaggtcacagcactaagatattaccaggaattctgcgctgggatggatcctttaactgaggagattaacagagctggagttctggaccagtaatctcagttcttctgagagtgagcaaacaattgcaggctaactccaaaatgcaagctcaaagcaaagtgtattgaagcacagttagacactctcagagggacagtgggctaatttctgtgaagtgaagtcagcccctctatatagagtttaaggtgcttctgtgcggtttgtggagagaagttgaggttggggctgtgtctgagtaaaggacgatgtcatctgattggcagtttatggttatataactaaaattaggcaatgcatgtttttacccataattttcacagaaaagcccactctggggcttttgtataataaaaccacattttattataatgatggtataatgaacttggggtgacctgagggcacagtttcatgttactgggcatgtgcccctttagggaatttccacctgtgccctagtttctctttcttcaggatgtgctggccacaaactataccaccaacttcatcagttaggggggtcttagaatggctctggggctgaacttaggtgggccaggagctgttgcagtgacaggctttctgctctcttttctcctcccagctgctaatgtctacttaactgcctgttgggagctgaaaaggccaaagggattgtgaccaactcagcatttcactggaggctatatgatcaaacagcaaactgtttatcatgaatgcgggatgtgggtaaactcacactgcacccgccgccagaaggtttcctgagggccatcactccctggtgctgggctccttgaagttatctgttgggatatctagcacctattatttgaaggatgcagtcttgcaagcctgctgtgaaccaaacggctgactgacaattacctgacaatcaccccccacctttttctcgtcatctcttttacctaataaactcagagagcttgaaaagctcagagcccttgttcactagaagcaaggaaccccctgaccccttcttcctaatatactcttttgtctttgtcttttactcccacatccaccccccactttgttcagtcaacctgggactgtggccaattacaacagcctaacaaaagtgccacaggagtggaacatggggcagtgggctctgctgaagaggatgctagggggcttctcaggggaggaaatgctagatttgcattctgatagaggagcgtgacttttccaggtgaaggtagcaggtgctcctggcagaagaacccacataaggaagtgtccagaagccacacaggtatggcgttcgacaagagcaggtctggaacggtggctcatgctgaggcaggaggatcatttgaggccagagtttgaaaccaacctggtaaaaatagtaagatttcaccccttcaaaatcattttttaaaagtagccaggccgagtggctcatgcttgtagtcccagctactcaggaggttcatttgaaccctggaatttgaggctacagtgagctattattgtgccaccgcactccagcctgggtgacagagccagaccccatctcaaaaacaaaacaaaacaaaacaacaaaataaccccaacagcaatacaatcaatatgcaataagcgtccacccggcatgtgtgatggactgtggtaatgctgatggcatggagggagtgaggtgggcatctggggagtgtggtgttattgggggtggggagtaatctggagggtctcatagtctttcagtggtaggtctttcttcctgaagacacagcaaacccccaaccctaagtatgggaggcaggtgggttggccaagaaggacgtctggggctgctcttggatcagcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacayagctcagaacagctggatcttgctcacactctttcaagagaagcttccttggtaagttaggggtggtctgaccttccccatctccccatcctcacagcagctctataagagaagggtcattcaccttttgtagatgagctcagagaggttaggtaactgactgaggtcacatctcggtccatggcagagcctgaatttgcacccaggttttagctggacttctccctccctctctctgggcccccaaacagtagagacagaggcagaatcagctcagctgggttcacaaagcttcctagggctcagctctagttccagcctgcgtgagacatggcccggtgaccccagaaggaaggcagatgttgggactgtccattcctttagaatatttggaggaaccagagaaggtggaggacaggaggtgatccagagcctggcctgtccttcttgtggcctggccaccctgaggctggccccagggtgctgctgctgaggcccgatggggacagaggatttcctttgagatacaaggaacctggctgggcgcggtggctcatgcctgtaatcccagcactttgagaggccgagacgggtagatcacttgaggttaggagttcgagacctgcctggccaatatggagaaaccctgcctctactaaaaatacaaaaaattagctgggcgtggtggcacaagccagtaatcccagctacttgggaggctgaggcatgagaatcacttgaacccaggtgatgaaggttgcagtgagtcgagatcgcaccagtcactccagcctgagtgcactcctgacagagtgagactctgtctcaaaaaaaaaaaagagagagagagcgaaaagagataacaaggaacccagaggttgtttcacccaccctgactctgagcacctacttgagccaggccctgtgggtaaactgaggccatgggagatgagtgactcgctgagggtcccatrtcaggaagttgagcaggtagatcacaggactccatgtccctgacactcacctggttccttttcaggcctctgggtgatagagaagaaagaagctgtgctgttccctagtgggaaagatggcccagacaggggcagtgagaacggcatgttgcagaatggtgtctgccacatgatcccagcttgacaatcatgagattaaaagtcaaactgtggaagcgtgagcataactgtgggagcgtgagcttagccctctgtgtttgtagaagcagaaacaaacctggaagattttggattattaacattatactttcttgcttcaatstcagagtcaggaggtcaggtgttgaccttccccctgccctccaagaggtgtgtgacactggggaagtcacttcccctctctgagcctcagggtttttcacctgccwkagggggttaggatgccctaccctgctgacycccagcaggctgctgaccccatctggggtgaggtgggaggcggggcagtgcgagtcaggggaaagttgacattgcagcccagatgcctgcaggggctgcaggaaagtggggagagctggaggcctgcatgggcttctcagatccaggtgatgcccagcaggtgagagggtgggcctggctcctcagagctcagatgacggaacatttgctataaactcaggtgcaattacatttgacatgctggcaaccaaataaaaggcaaaccttgcatatgccacacacacactcacaaattcacacacacacacacacacacacacgcacactcacacctgctattcagatttcacttcatggagccctgtgtttctcacctctgtgtcgtggcctcgaagggtctttgattctgtgcagcttcttttcctcctcatttctttaagggaggcatcgcattcattagtcttttttttctgayggagtcttgctctgtcgcccaggctggagtgcaagtagcaccatcggctcactgcaccctccgcctcctgggttcaagtgattctccagctcaccctcctgagtagctgggactacagaggcgtgccaccacgcccggctaatttttagtatttttagtagagacggggtttcaccatgttagccaggatgttctcgatctcctgaccttgtgatccacccacctccgccacccaaagtgctgggattacaggcatgagccaccgtgccagrcgcattccttagtcttaatgggcatagtgttagggacccgcctactccctatggcaggagatttagtgatttctccctttttggtgatagaaacaacgctgcatggcaccctctaaagcccctgtccctgcacacttgccctctgctccctggaggctgagacctaggagtgggtgctgtgccatgacgtgggggcactttgtaaagtgtgctgagtatcgctgacgatcctccaggacaccagaacctttcacactccatcaacagtgaaggggcttgtgccacctttacctccctaacagtggacattattagtcactttaggtttggcttatctaatgtttcaaaaacgtatgtctctgtgatcacttacatatatggttcaaaagtgagcttgagtgccttttcatatggttaacgttaatttctatttcttcagatcctatcttttacccatttttaaattttatttatttatttatttatttatgagatggagtctggctttgttgcccaggctgaagtgcagtggcgcaatctcagctcactgcaacctccacctccggggttcaagcaattctcctgtctcagcctcccaagtagctaggactacaggcgcgtgcctccacacctggcaaattttgatatttttagtagagtcagagtttcaccatattggtcaggctggtctcgaactcctgacctcaggtgatccacccgccttggcctgccaaagtgctgggattacaggtatgagccaccgcacctggctatatttttagaaacttgatttcagtcttttcatgttgatttgagcatttcttgtggattgtggacagttacctttgctttaagtattgcaaaccgtgcttcctattctttcattttattctggctcttgaatgatgttctttctaatttttaatttgtaagaggtaaaactctattcaattttccctttaagtcttctgggaattgagttttgattcgaaaggtcttcccaactcaacattgtttttaacatttcttctagtatagttttaattttttctttctggggtacacttagatccctttgggattgatttacttatttttggagaagaatttgtttcttcttcttttaaatgtaggacctatttcatgggtacctactacagacaaagaagaacaagacttttttgtgtgtattctaaggcacaacaagtgcaggaaggaaatgacctctttcccgtaaaagtccctggcagtagttggttgctgcataagagtgtcatggacccggagggagctgggcccagatgcaggcctgggccattgccgtgggggaggggaggcttggaaaccatggctatgattcagaggttagctggctcgcgtgtttttagaaatttcttttttctttcycctcgtacaaaagtaataagactggggaggacacgggagaaaataaatggaaactcagaaacctgatagagccaccaaaagtacatgaaatcagagtcatggtcttatttgttcttccccaaaaagagatgagcatctagatagcaaggaaaaacattcaatccctcaactgaaagtgaaactgaagctgggccatgttgtccagaggctggttgcttttagtccaagtgctgcctcccacacctcggatttcagccaggctgtgccacggagggcagaggccacccaggtcagtcataggggatgcagctgggaacaccgcagggtccctgccggatgctcagagtttaacggggagacagaggcccaaagagccacacagaggtagagctgcccccggaaagcagagtgctcagggagcctggggagggctgggggacgctgcagggtccaggcagctttggctgagcctctgaggatgggtgacttgcacatggtggggaaggtgggggaggcattccaaggggagggagcagcctgagcaaaggcctgaggctgggaatgggagtggggggagtagatgggctctgggaggcagggaagcagggcgtcagtgtgtacctggacccaaggtgactgtgtgggcagggagcagtgaggaaagtaggagcccgtgtgcccagttaaggggttgaacttgaccctggcaggtcattaaagattcctcaggagacctaggtattgtggctcagggctgtaattcccgtgctaatgcacgraggctaatgcaggaggatccctcgaacccaggagttcaggacaagcctgggcagcatagcacraccccatctctgcaaaaatgaaaataaaaagattgactgacatagtgatgcacttgtagttcccactactcagaaggatgaggcaggaggatcgattgatcctagaacgtcaacactacagtgagttatggtggtgccactgcgttccagcctgggtaacagagcaaaaaaaaaaaatattgaaaataaaaataaagattcctcaggaggagcacggtgtcttcacccctctctccctctctctctgcctaaggaggaggccccacagccacttgcagggagctgctttgctgagagtctctgtcctctgcatctggagagcttggctcagagctgaggcaggagggagggctccctgtctgggcctcctccaggaactaaagtccctttccgggaattgaccaaactgcaggcttgcccagrgaggacatgctgtgtcctagttcagctcgaggggcagtatccagcttcaaccctcagcggatgccccagacaagattccgagccaggccaacaacgcctaaggaggacgagaccctgggtgtagctcatcagaggtgtcaggtgtggtctgaggccccagctctctctgccctcctgctcctctgctctgtgctggctcctggtccttatggctcatgatgttgagacagctgccctggcctagggggtcacacactgaacaaagcaggaagaaggggaaggggagccctccttctatcacccttatcccttacagcaagaagcacccagaaacccctcagcacactcccctagtgcctctattggcctcactgtcaccatggttgcatgggggccccagacaatagacacctggatgcaagatccctaagacagaggcaggaaataggaagagggaggtgagaggctttcgatgaggatgcttctacacatgaccttgagratgaaaacgcatcagggggtcccgggaaccactgcgttgttaacataaagtctgggagcaaagaccagcggctggaatggatgtgcctgggagccagctgaaacagatgcagccgaagccacagtaaagaagaaagagataggggcctgcttggagccaacccctacctttgaggggcctgacagggccacctcacagctgcctgggcttgttgttgcctcctcactacagaaaccatggaagtctctagagtcartgtttccaggctggggctgccagatcactcctgtaggtggttgaaccagttgagttcattcttctcagtgagggggacacaggtggaggtccatcggcacctccataaggggtgcgagaaggaacctgttagaatatctgggttctggctgggtgattggcaggagggcctatgaaatggagcccactctggattgggtgttgcagaaagtggggggcaagtctaccagtgggtatctcagcaaatctcatctagagagagggagaccaggaagaggttagagttgacttggtgtagaaaaaacaggcattctatttagccaggagagggagtgtttggtattttgtgggtggagcagagactcagtttctgtctatacttagacagtattatgaagtctaattgctctgtctcatttgctcacaatctcagagtcaccctgtgtgtggttactattctgtgacattatttctgtccataggagaataacacagcccttctgggagtccacgccagcttccaaatgtctgtggcagctcttccttcattctcaacacttacgaacaggaacataaataaatagaaggaaaaatatccatttatattaagatgctcttcttgttaaaaccaattaacaattaaacattctctgttacgataagtctttgcatttcaagtaccctgttttagccttttctgtatacttttctcaaatgttctcacttgaatgttagtatcaacccaaggcctttcacagattcatcttggaccaagtaaacatgatcataataatcacaatcaattattactrttgaatataagcggtataaaccaaaagtaagattctaagcctccccctcatttmaaggacttcctcctcagccrgggctcttaaaatttaacctgaaagactggttcaggccrtgaagggaaatgggggtcagacatgcttcattatgcctctctggcattaatatcaacacaggctttcagtctaataagaaacattttacagcctgtttctctgtgaagcctgctagctgaaagcttcatctgcaggataaaactttggtctccacaacctcttatcrcaactcaaacattccttcctattgatctccggtctttrgacaaactcaaccaattgtcaaccagaaaacgtttcaatttacctgtagcctggaaacgcccactttgagttgtcccgcctttctagaccaaaccgatgtatttctcaagtgtacttrattgatgtctcatgctccctaagtgtataaaatcaagctacaccccaaccaccttgggcacatgtcatcaggacttcctgaggctgtgtcacaggcatrcgtcctcaaccttggcaaaataaactttctaaattaactgacaccwgtctcagattttccgggttcacagcggttgggactgaccagtgggcatccctttgaacactgctctgaacatctttggaagcgtccttgctttctggggtaacacatatcacagtctggggaatttggttccccacaagacgtcttggttcctttgggtggaaaagaagcccgtatgttgagtggcaaggtgccactggaaattatactgattcaagataggagttcactctgattatgctgttaatattaacagtttaacataaaatgacaacatccgtacttttcttagcagcttggttaccccagccaccgaggtttctctgaagctgacatttctcccatcaggaggcaggtgtatttctctttggcacttgctcacacttctccatcaactttaaggtggtggcaccacaatccaaaccattattgaggttagcagttactaactactataaagtaacttctgttttgttaaaatttaaaaaaatcaattaataagtgtatacggttcagacaaatcatttaataaagagggctccactcactcccttcccaattaaaagcagctaattttgatgttcagattttcctttttttwttttctgagacagaatttcactcttgttgcccaggctggagtgcaatgtagctatcttggctcaccacaaactccacctcctgggttcaagcgattctcctgcctcagcctcctgagtagctgagataacaggcatgcaccaccatgcccggctaattttttcatttttttagtagagacagagttgctccatgttggtcaggctgctctcgaactcccaacctsaggtgatccacccacctcagcttcctaaagtgctgggattacagatgtgaaccagtgtgcctagccagcttttctttagggagtaaatcattttctttacataatattcttatgctagcagatgaaatagagtgagagtgcatgctctggagattgggcacttgagtttggcttctggctgtcactagctaggggctccaggtgaattacttaacttctccaagctttagttttcccctcagaactattaagatgataacagtgcctacgtaggatggttgttgtgagaactaaacgtgagtttatttaactttatttcttatgcccttaactgtagccagtatttcttgactcttcactttacaaaatggccatattaatcctccccctccttccttcagtgtttcacctcccacctttaccatggaacattaattatactgactggtaacaagtagatttagttctcatatgtaaatgttctgttttgttctaaaagttaaaagttaaccaagtgtttacattttggtgacgytttaaatcttgcttactgttgagctgagttgtacaatatggttgcacatgttttgctgcacggctttagtttttcctgatgtttctaattgcctttgttttttccccctcttgtactgtttgccttcatgatttcctcagtttttctcaaactgtgaattatatgcaatgttctatcgagtcccctttccctacagagccctttccttcttattctatcctggactggttgctttctaggcctgctgcatgcccagctgtgatccttgcatttccttctccctgggttgatttttctctttcacgtctttttctctcttggttttccttatcccctctccatgagtgtgcgtgcacacacacacacacactcacattcttcctcctctcagcctccacagctcattctcaagtaactttcttttctgttatttacttgtttttcttttaacagagacagggtcttgctctgtgacctcttgggctcaagagattctccccagtcagcttccagagtagttgggactagaggcatgcatcaccacacctggttcatttttgtattctttgtaatgatggggtgtcactatgtggcccatactggtctagaactcctggactcaaagaattctcctgcttaccctcccaaagtatggggttataggcatgagccaccatgctcagactcaagtagctttctatgtaattattatgtatggtaactttcttattctatatctagctctgtttttgtttttgtttttttctttttctgtcatccttttagttgattttctggaaagcttccttgcctatctttttgaatcttgtcctagagttgtttattttctcaatcaccttttaattctcaagaagtcttttttgttccatcatctttgttccttttcagtacataatgttctcatttatgaataaaacatttttatgtccctgaggacatgggtttgagtttttaaaaattattttctattttcgcaatcatccatttcttctggactcattttttacttgttatcttgaccttttccccattttttgtctttctgctttatctgatcctagatctattcatattaaagaaaggggcaggtccactggcagtcttccctgtagagtgatgaaatgagaactccttggcatcaggatacaaagatattatttctggggcctttagatgcagttatgaagtctctaattttttccattggtgtagactcacggctactgtgaatcctgtatgggtcgtggggctggtgaacttctcccctctctgaggctctgcttagcaggcaattcttggctgaatgtgctcttggtgttgctgtggattgcagatccctttacccctctctattcagttgtcacttcttcagccagttctgtcttccaaatatctgttgaagtctctgatctcctgttttcctcattcaaattttcatatgtatatattttttgagacagagtcccagtctgtcaccagggtggagtgcagtgacccaatctcggctcactgcaacttctgcctcctgggttcaagcgattctcctgcctcagcctcccgggtaactgggattacaggcacacgccaccacgcccagctaatttgtgtgtgtgtgtgtgtgtgcatttttagtagagacagggtttcactatgttggccagcatggtcttgatctcctgacctcgtgatccacctgcctcggtctcccaaattgctgggattaaggcgtgagccaccacaactggtccattcacattttcattggcagcagagggtgcagaggcagtgtgtgtgttcttgagtccgtctggttgggtgggaacccagtctttacaccttagtagatttctgagattgggcaagtcgctgaacatctgtttcagttttcttatctgaaaatggaaatacaaatggtacccacttaataggctcttggaagaggactgtgagttattatttatamcatcttagagcaattagtggtgcaaagtcgagtccacaaatgttcacccctatttctcattgactgttattatacctataagtgccttgactaacactgtagtcagatcttgaagggatagtcaataaatgttcttctaccttcttagaacaatgcctaaacataatcaacatttgctttcttttttctcatttcccaaggcaagatcatcacaagcagaatgtgaagagtgtttctctgtataaagatcagcatttatttaggctggttgtagtggctgatgcctgcaatcgcaggactttggggggctcaggcaggaggattgcttgaaaccaggagttggagaccagctctgggcaacaaagcaagatccacatttctaaaaaaaatttttttttaatgtgcctagcgtggtggtatgtacctgtagggacaactacttgggaagttgaagcagaagcatcacttgcagccaggacatacaggcagaagcaagggggacaaagggtgtccagcacagcaccagtgaattcaccaagacagacacttgggcatagagtgcaagacacagatttggaatgaggagtcatttacartaagcatgtatgcatgagtcaatatttttatatatttaagggagtrgagcccagtcatggaagacatgggatttgaatcagaagtcctggctctacccctattgtgaaaacatggcaaggttgcttaacatttgaggtttcttctgtttcaaaatgggagccacrgttgcacccatctcctggcctgtgtgtgatcatcgaatgaggcacatatgaggagccctgcagatcacagacacccagtacacactggctrttatcaattagttatcacacatgttgccaggcccaggtcattgtcagaacgttccttcccatctctatttcggtgtatagactctgtagtttctgtgattatcagatgtccatcccttcctctgattatcttctcttcatacccctacaggacaaaaggaccctgccttggtgtgagagtgagggcagagggagctggagcaagtagaatttctctaaataccagctggctggggcccaggagattaaaaaacaccgggctaggttggtcttggcatttgctgacacgcaaagggattgcagagatccagcccctccaacctccctctgtccacaggtggctcacattcagtcccacaatttgctttctcctcctcaagggttaagaaaaaaaacgaacccttccagtcaggtcagtgactggagagctccawggaaagtctctcagtgacctggctgctggcaccatggactcaggtaggcttgcttcttcctcttccctggctggttcctactcgcacctagaatggagggtggcgtttccacaactcagtsagccccagaggaacccggatggtcaagcaggccgatgagtcttccctgagccccaaaagaggccacatggagtcccccgacccaagggtctgtgggggcatctatgtcctgacctctcctcaggggagcatggcccaggtgcccacttcctccctgccctggcacctagcaaaygactcaagtggggcaccacagccttggggaagtggaaacagcagggtcggggagtagggggagagcagggtccaggaggtgcggagggctgagagaggaggttgaccagcagycccgacctctgacctcccgctctgctcccagctgaccctggggtgtttccagcacaggccagtcccctccctccagctcttgccctgcaccagcccctctgctctgagtggccctgtgaaaagagtgactcagcgtcccactgaactgagccccattctggccttygccacgtcttctctgtgtcacctggagcttcttacctcccctcacctggaatgcgagtataatatttccccatgtggtcatgaggatcaaatagtacatgggtacctggcccagccagtgcctgccacacagtagggcctccctaagagttggttcccatcccctttacctgccactgttgattccaggtggaagcccctttttgtcccccagggcgcctgccctgcacggcccatcacaagcacctgcttaccagggatgactgcctcaggcagggcctcattcccatgatctcaaataccccttgtcaaagaaaaatctgaggtccaatcgaattttgaagactttatttgaggaagaagcaagtcatgaagtgggaaacatcaaaatgaaagacatttcatgttatgatggaaaagtgtcagaggcaggtatttatagggtgaatatggaagtggaataaggacattatttgatttgttgcagttgtcaaattatgttttttggtttaccttgttggaaaattcctagtcgtgtacccgtctgtcagctggctgctcatgactggccgaagttaagttttgtttgtgcctaacgtaagcacccatctgaaacgactccagttaagttccccatagttggcagtttaaggggggttacagccwttctgaaggcctgtttgcttttgtttgcccaggtgttcattttaagtttgctttaacaccctggtactcccaccccagcaataaatacacagatctagtgctggaggttccctccatccaaccctggtttccttcatcctttcagtgaaggaggaaaaaataaaagcaaaatacccstcacccaagtcagcactgtgttcatttccctaaggcctgttttctcccctcactgagttgccttggcaaccaagtcacatctgctcaggagccgccctggacagcaaactgggctctgctgagtcctgtccaagatgaggagagggcagggaagattagaagccgggacctaccagccaaccccggaatccttcagaagggcttggctgggaggctcaaggaagaaactctstctccgaaacaagatgatctgtggtttaataacgcggccagctgggttcagaggtgatagtggggagccatgtcccctgagaccagcctgcagaggacagaggtaacacagaagggccacagggatcagtgctgagggtcttgctcccctgcccgcctaaagaaccccctccactgcccatctgagagcgcccatgagcagcaggaggaatcctctgtgcatggtagtttattcaatggtgtagggttgaaatattctttttcaataaaatgtttaaaatcccacaggtatactacagtggagaatgcaggaaccacaggcattttcaaaatatatggagtcttcaaagtaatggcaagggaacgctggccttgagtcaaatcctgagcttcctgcttgctgggttgggtggtgtctttcgctgtctgggtctcaatttctccttctgtgaaatgagaatgaggcctcgcaagtgtgtccacggcaggaaacgattttacctcatgtcccagtgcatacataaatccatactgcttcccagtcccttctctgcagttccataattcccaaatccctgcaaaccacacatttttggggcaactcmtctgggcagtaatcctgctgtgtactaagatgctttgtactgataatattatgtatcccatttaaggtgaatattcattggtttctctgttgaaacatttgtacctttgattacaaggttgaaacatttgtagcgttgaccagtgtgggagtggtcagtgatacagcatatgcaccctgtgtcatattgacacagattgaaaatgctgccatcctaaacacatctakatcccaggaatttacataagggtatatatatatacacccttatgtatatatatattatatatatttcaaatatcttacaaaagaawactcactcttgctgtgttcaatacactctgatattttcaatgctcttttctttttaaaatgctgctcttgacaaaatgaactattttcataacccactgatgggtcgaaactcagattttgaagacactggtgtaaagcgtttgacaataggcacatggcagraggaagcgatcactggaatatttcccgtacatggggagaaarcatggtggaaagctcactttctggtgattctcagctgaaatagatyggttcctccacaaagcaccrtggcacttccctggtgaatcactcttctcaggatgccttagtaaaacgccacaggctgggtggctccaacaactgatgtattttctyacagttctggaggcaaaaaktccaaggtgaaggtgccagcagggttgatgtctggggagggctctgctcctggcttacagagkctgcctcagggctgtgtcctcacatggccttcccagtgtggggggtgtatgtgtgtgtgtgtgtgtgtgtgtgtgtgagtgtgagagagagagagagagagagaaagagagacagggagagagggctggaaggcaagagagacagcgagggcggggtggggtgaggagagagagagagatcttctgcctcttttttttcttttaactagacaccagtcctgtaggattagggccctacccttacgactctctttaaattaatgacttccttaaaggctcaatctccaaatatagttactggggtttarggtctcagtatatgaatttggagggcacacaactcagtctatagcactgatgcctccatcaaaaataccccatgtgacagctggttgaggaggattaacmtcgaaccaccttattctcaatgccatttaggctgtagcacactttcttccaatcttatgctttttgtttccaagtagaaaagaaacgctttactgaagaggccaccaaatacttccgggagagagtcagcccagtgcatctgcaaatcctgctgactaacaatgaagcctggaagagattygtgactgcggctgaattgcccaggtaacctccgtggggttacctccatggggcgccccggctatgccatcctgatctcccctgggctagttttctctggcaggcacacctcctccaggcagccccctctgctgaacttgagaatgtccctctcagcagtccaggaggaatatttcctccaagtccttcgctggcagtgagtgacctcaggctgaggggagaggaagcccacaagggcagggtcagttctgccatctactggtgatgggagctttgcaagctacttgactactttctgccttcctttcttcatccattgagctttattgtgagaaaaataagctaatgcatgtaaagtatttagcataatgactgacacatggtaggtgctccgttaatgttaccttttaaaaagattgctggggagagaccaggaccaaaagtgtttttctttttttttcyttttttttyttttttttttttttttgagacagagtcttgcttgtcccccaggctggagtgcagtggcatgatctcggcycayygcaacctccgcctcccggtttcacgccattctcctgccccagcctcccaagtagctgggactacaggctccggccaccgcatccggctawttttttttgtatttttagtacagacggggtttcatcgtgttagccaggatggtcttgatctcctgacctcgtgatcctcccgcctcggcctcccaaggtgctgggattacaggcatgagccgctgcrcccgaccaagtgtttttcttagagttggatgcccagcaggactttctttgaaaaaagccagaaaaatcttgacctgatcaatgtgtgttcctggagatgctgtccggggcccttttcttccacctctgaggaactgcacaaacacagcaggatcctcctgctgacmcagaacacagagaggctggaatggagttggacagagctgggggtggatcttggctctgtccctgcacagctctggggctgttgttttatgtcttggagactgggacctgccatctctccaatgctaatagtagttcaatcagatgggcrtgtggttaaagcctgagaatgaacagcaggtcaraggtggggaaccaagtagcatgatgccatscaaagacccagagagacgtttcaggggcagagccaggggtcaggatggggcaggggtgggcctgggttggaggagcagcaggaaggctcgggcaccaaggctgggagtagggtgagaagagggaggcactgagggcatgaaakgtaacgtggccatggacttgcagaggaccagtgagtgggagagggatatttcttccctccctgatttgatcccatcactgatgggcatagtgggccatgggtgactgtttccctgacagcatgcctgggaactggggcrttctgaactgccatttgggaccctcttctgttctacatagagtagaggaagtgtttcttcgggccagcttggagagttggaacaagtgtctgccaactgggtaatttgaagggttctcaggagactcacaagtccccaaccaaagagaaaaacactttctctatcatcttgtccaaatgcaggtcttttcagcattagtgatttatagagatgattttcaaagtctcatgagtccataagaggttccatgaaattgcacatggcattggyatgcacacaggtgaagctgtcacctgctaaggcattagtttggctggygacatgtgacagtgagaccctgaagcttggaggtgccaggtcaggaggcmgtcaagtggcttgagagttcatgtgcagccaggactaatagccaggcctttcacttttcagtcaaagggggcagtggctggacccagtggccttcagtcagaagatcaaagggcatgtggcattggaagagagaacatgccaggcaaggtgatctcttccagtctgaggttttatttgatagcttaaggactcagagttagtcaaaatgcaatgtctgaaggcacccttcyttctgacaccagttgcagatttgaaggtgtttcttaagcccccactcaggtttgataattcactacaaagacttacgtaactcactgataactgttattgcacgattgtggtttatcacagggaaagaacacagattaaaatcagcctaaggaagagacacacagggcagagtctgggagggtttcaggtgtgaagcttcgttgtcctcaggacgctgtgttctcctgtgtgaatgtgggacaaaacacatggggtgttgccaaccagagaagctcacccagttaaggaaaaattcctgtgaatcacattagatcaggaagcctttattcaggattgttgttacaggggagggagactgagcccagctcccaatatagtaaagacagagggggagtcacagccaacaccagggtgaggagtgggagatggaccagttctgactggagacaccagaatggggggtttctgctaaactggcctaacaagctgctcaactaaaggcaggtaaggagcgggtgaagaccgtgatcagacagcaagaatgctcagacagcaagtggggaggaccctccctaactgccttgggggattcttgctgaactggggcagtacaggcccagcaagcacgggatgggcatggaaggtcagcgcctagaggagaaaaggctcagagcagcctgactggagtttggccaaggagaaagtctttctcaacctatgcctcaatgtacagagctctttctggggctggatcacaagctgtcctgatggctgacatggagtccccagcccctccctgaggtctaacacccttagttcccagttcctttggaaggcagaaaagatacgtaatagccccaaaacccatcacccataacattgctatactgtgctgtagccaaaccaccagggaaacaaagatgttcctaccaggcaggacattccagggccccagagatcccttcccagggcccaaagacaaaagaacgacctctcttctaataaagttaatccttcactgttctatgatcctctgaatgaaggtctttttgctccgaacccacttctctttgttcatctacaaaatttcccctctccacacactattggagggatgatgttgacctctcttgcttgaggagccatctttatcgaatacctaccactaaagagcatctgaagatgactttaagttttttattcccatacagaataagtactgtggcatatctatgatatacaaaacatgtttaaccttggaaaaattattttaaatttttccatttaaaatttaaagctttatttccatttgactcatagtaatagctctgtgatttatgtagaacagatcttattgagctgattttacagataagtaagctgcctttcttaatcatctgtcctttattggtacagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcagctggggtagggctgggagcagcgtctgctrtgactgggatcaccaccagcatcgtggagcactcatayacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctggacttattcgagtcattccttggtctcctggctcctttctcgctttgggagcaagttcctgtctgaagtttttgtctgaacagtggtaaaggtgatggtgatgatgtcagcagacagcaggaggacttgacaaatgtcagccctgcttggggccaggatacactgagggaacgatgacattccaatgaaactccaaattctgtattggaaaagtcattgatttgtgaagaaaaataaaaggaggctgggcacggtggctcaggcctgtaatcctggcactttgggaggccgaggcgggtggatcacctgaggtcagtagttggagaccagccaggacaacacagtgaaaccccttctctactaaaaatacaaaaattagctgggcatggtggtgggtgcctgtaatcttagctactaaggaggctgaggcaggcggattgcttgaactcaagaggaggaggttgcagtgagccgagatggcgccaatgcactccagtctgggagacagagcgagactccatcccccgcgtcccccccccaaaaaaaaacaaggaagagaaaagcaaaaccagatgccaggaaccaatcaaggaactttgtggtgcattgaggagatgaaccagcctgcagtcaagagaccccgcctctctgagcctcagtttcctcatcagctgggaaagaggggctggacaagatgatatctcaggtccacctggctctctcctcttgtgttctggagatctgggttcaagcaacactgatctatgcctgtgcctttgtggtgctgatggatgggctcccctgggctctcggtgcctgacttcacttcctcatgatccttcttccagggactcagggagctaggcctccatggccccttctgcttgttcttctggtcggtcatttctgggcgaccccagtgcccagtggcctgtgaggcactcagggaaagcttgtagacatctggcttggcccaagtgcaggcatggtccccatctagcagccagggcccacgaatgacatgggtcacacaaggctgactaaaatcagaggggcctgtgtgtaggttgagagaaagtccatgagaaatagaggaacagagagagatagccagacagcaaacaccctcatccagtctgcaaacaccctcatccagtctgcaaacaccctcatccagtcagccctctcatttcacccagactcctgcaaaagcttccagaatggtcttccctgttatacagcccttgccactatccctgcccatcctccacactgggccaakttgccccgtaagaacatagatttcttcaagcccatgcttccatgtcttcaatggcttcctattactcttagcacaaaagcccagagccttcatgctgtctaatgtaggctgctgtggcctgagttcccctgaagggagagccctaggcaaggctcccaggcagaggatttgtttgggaagtgattctaggagcaggactggggtactgggaggagtgacacagagaaggacagaaggctgatgccgggagaaattcttgatagggtcacccatgtgggcgactggagacctcctgaggagtcttcaaggagcgtcttcagaatgttcctctacagggaggagagagggaggcctgtaaccactgctcctgtcccccatggccttgccccagtggacattaattatctgtatttccatgcatagaatatagaactgctgggcgcctcagctggagcccagagcaggggcaagagatacagaatgcacaaaatcaccccagaacctctcctaagtcactcgtaaagtgcacccagggcctacttagtccttttttatgtagcatcctgcagaacacttgcctcagtccctgtaactctccatcagccaaggcttccctgaccttcagttgattcatctatttcttcctgaagaagtcaacagagcaacggccaccgacttgcctaacgccagaacattgtgtttcatttgtttgtcaattgttcatcaattcctggataattcccattcttttcatacatttcacttaagctttgaatgtttctggcactgagtaatttacttcttcagtgatccagccagcatttgccctgacacttagagttgaaatgccatcaggctacctgcatttgatgcaattccactgtactgctagtattgyttaaaaatttttcaattgcaagcaacagaaacagaaactatctgtcttaaacaaaatagaagattcattggatgaaaactagagcaggtcagaggatggaaggaagaacaaaatctacagaatttggaaggacaggagcagaccattaccaacatcaggaatatatggtttgccctttcagggctctgcctgcacctggcttagctccacacactttgattcctagtgtctctgattaaagtttcacatactcagtagacagaatagcttgggttagtgactcttcttgaactaatcagtgaggctatggtatcaggaatggggatgggtaacagagacacaaaccctaatgggaagcctctggccaaacagccacctgaatttgtgctcattgtatacagtcaatcgcttgctactgcacacacactcttcttctcatacaaacaaaaagaactctccttatctgctatgaacccagccatcccaaggaaaaaggcaaatgcacttgcctcttccccagtgagagccacacacagcatctccaccttctgcatgctgaagttatgtcacaggaggagggcctcagcacacgatcaatttttcttttggtccattggcagcttctgtctcagaatttttgtgtgtgtatatttgtagaaaataaagaggtacggtcaaggctacagccactactgaccattgctgccaccatcagaagtcttgaattgttccactcaatgttcctcttacttatgggcaaagtcattctcgtggtgtctaagctccttgatggtctggcctcagtaagttggtgaaatttcctattcacatttacactaatactctaacactttagagtattacaaggagcaatcctaggggatccctcaattcctcctgtcctgctgtgtaataacaacatgagcttccctggaggaacatgatgcatgattatatccaacccagtgacgtcattgctatccctacatcagggagcatgagaagccagctatggtttctgctgaaacaacttttgtcaaccttagatactgaaacttccagacctaaaagtctgtgagttaggagtatgtatcataaacaaaatttttgaaagtggtttattgtgggtaaccatagagctatcaccctcatcttaacctctgactgcccagctccatgaattctggctattacaggaaatggggaaaattctgggtatggattcaaaacatatcacatcctaagggcagctcccagcctctgatatggagctgagtcccctttgggccatttccatgggacctaaggctgtcatttccggggttgagattcactgggtgccaagtggtcagccttgatgagtggggtccgtgttgtgtggttacatagagctccacattaggcaagttggttaatgagcccattctgaaaatgtcaggctgcctggggaacagaggagatttgagccttaaagagtgacttcttcccttgtttattaacagcctctgagccaggcatggtgactcacgcctgtaatcccagcacattgggagaccaaggcgagtggatcagttgaagtcaggagttggagaccagcctggtcaacatggtgaaaccctatttctactagaaatacaaaaactagccaccagacatggtgacgggtgcctgtaatcccagctactttggaggctgaggcacgagaattgcttgaacctgggaggcagaggttgcagtgagccgagattgcaccactgcactccagcctgggcgatacagtgagacccagtctcaaaaaaaaaaaaaaaggagtcttttttgatggtggacatcttccaatgagcattcacatgggacagatttttttttacttctaccgttgttctgaaagctctatgtatgttcctcttccctaaaaatctttgtcaccaagcctccagatttattccttctaaaatgttgaaattccagctaattccttagttgttacccaggaaacaatgcagatcctggtccgaggatgcagctccttccaggcagcctggactgtgaggtgtgctccattgctcttcaggaaccgtccttgagaggcgttccacagcaggccagacctggggggagcaggtgggccaggcggaaagcacagcacaatttgagagatgctgagtactcatgactctgtgtaagcacctgaattcagccctcatggtcttttctgagctgtcagtcatttatctctatttagtcattttgcgaattggagttagcttccttccctctacactcaaagacggcatgtcaacattttaggcctctgggtggaatgaactcccagtttcctgggagggagctgattggcatctattcgcctcttcctagttttgtggggtttcccagcatgtggagtcatagagaaagactggtcccaccttctatgtaatgcccaagagaatagatgactctctgtccacccccaccctggcatccagggcttctggacaagacctaggctggctaattggctgcttccacatgggatcctgaatctggagcaagtgaggcaaagcccagggtgcttagaatccattctcagtgagagcagcaggactgcccgggaggggaatagagacggggacgaccgagtcctgcaccagcagagatgacgtccgcaggtggcagggcagcgctgtggccgtgtcactcctcacaaagcagggctcttgtgctcgcagccttcgataccgtctcactgtcttggcttctatttatcttccaagccaatttccagcctcctacacacgtggggttcttctggtatcattccagtgaatttcatgttgttttctgccctaagaaaacagagttggtacctctgctcgaccaagaagcctgattgatacagactgagagctgcaggctgtgtttatttgcttcattaacaagaacaacttaggaatggcaacttccattgatgagcttcctactttgttctgcggttggaaaacaaacagttgtttccctgttgacgactggccacactggagaggtgaacaggtgagtcacaggaatcactgcttctgctccctttaaatcttgatgatggcagaaatctctgtaactgcctctgtaactcctccatgaagttggtgttgactttgagtaaaatatttaggcaggtatgtaaaaccaatggcctccactggcgtatgtcactgaaatagtccccgtccgtgggtctgggtgaacaatctgaagcttccaagagtattctttccagttatccacccaggaatttgaaaaatgatgaccaggtgagggtgggaccctgatggacttaatcaaaggtaaacgaatatagatattcactaattacttgtgccctataatctccccctctgacccaggcctaagaattgggtgacaagcagggactatccagcctgatgacctgtgacaggtatccactcaccagattgggggttttgtaaagtcagtggactgtcttccagctctattttggaaccttgttcctatcaaatgtcccttgagccatgatcatgcgccctcctggtgcgtgacctggcgcccgcactctcttttcttctggcagttacctgcctcccctacagtcggcctcttggaatttctcccaccctaaagagaccagagtcccagcccctcccctattatagagagttcctggttatccattgactcttctcgttaaaggagcgggaaatcttttgggccctggcaggaaacagtgtgggcaggaagtgcttgagaaatcaaatctagcatttcagcctcctacacacttt

SEQ ID NO: 1685 - DNA, 19007 bp, Homo sapiens
aggctggagtgcagcggtgctatcttggctcactgcaatctctgcctcctgggttcaagcaattctcctgcctcagcctcccaagtagctgggactacaggcacctgccaccatgcccagctaatttttgtatttttagtagagacagggtttcaccatgttggccaggatggtctcgatctcttgaccttgtgatccacccacctcagcctcccaaagtgctgggattacaggtgtgagccaccatgcccggccaatatagttattttgtctaaatagtgccagcgtgcattccaaactggctaggcatcccgtayrggattcccagaaccctacaacctcctatatctctggcaacactcggcatgaactagtttcctaaattttaccagtctaatagctgtaaagtcgtatcttgtgagtacttcaatttgtatatttctgattactaataacttttcgaatgcttgctagcttcctgggtttcttttctgagacctacgtattcatatcttatgcatccccattttaagatgggaaacctaaagttcaggaaggttaaataattggtccaggatgatactgtgaatacatggtgtacctgggattcaaacccaggtagtctgaatccagagcccagattcttaaccacagcactggcctgcctaaacctctgcccctctgccctctgggcagcccctaagtgggcaacaagcaccctgaggagtccctttccaccaccacatgcaccttgaccaggccacggctgaagagcatctccacgatctccttgaggatgggcaggatgccgctatggtgcacacccaggccgcgattcaggagctctgacatgtgcaggacctttggtgggaggaggcccatggtcagggatggagtctcggaacaccctatccccaccagtctgccaaatgtgtgcatgcacgcacacagacgcacacagacgcacctggggcagctggcggtcagagccacggaggcgagcaaggcagcgctgcaggaagaggtggatctcgctcttctccgaactggtggtgaggtcaagggaggtgagrcctgaggcctgctcatcacagcggccccgggagaaggtgaacaccaccacgggcaactgggcacgtgtgcggagggaggccaggagggacaggtacactccgcggtcctggagaaggaaggggaaggggaaggagcagaggttgagttcctgaaccaatgagaggtgagctagtgttaactggggcagtgctcaaagctcaagtcaaaacccctgggggacaaggggaaaaaaaagataggaggaaaaacaggtgctggcaggtacaaaaccctcccagttctcacctgtgcagggcccccctgatgtgtgggctgcttggccccaaaggtctgggcgtgtttgctcattctctccttcttggcctccacagctgcatagtacctggggcacagggaggggtagccacaatgtccagctgggggcccagccctaactctttcccccatctcgaggcttacccttttgtatggaaggctcctcgggagtccagcaacaaaaagagctccccctgggtcttggagctgttccctgtgaaaagatagtgctccaggggcacggggcgggttacagtgctaatcacatagatctgacgacgcttcagccgcctgaagaaaggagagggaagcaggtcaggggtgggaacgtgggaaggaacccgcatccccacccccttccctacccctccaactttacccagtcttttctgagacccagaatggaaggctatcccccaacatctcatcccatttcaacatgcaaagtaatctggacccaaaggggatcccacagccaccaggtgggacatgttccccagcatcacccctaaggcctgaccgctctccttgctgtggtagacttagtcccccacccgaatcaaggagtactgtagcccccttcacccaggcaacccgggacacacgtctcacccaatccagtcagcaaactcaagggcgttggggacggtggcactcagaaggatgatagaaacgtggtcaggtagcatgataagcacctcctcccacacgaccccacgctgggcacagagagggaagggaggtcacatgagggcaggggccgcccttctgcccataaagaggcacaggattccatatgggggtaaagaaagcagtaaggggccctgagtgtgtggaataagggagacgctcaactggtcccaaaggagaggactgccgggttctggggagcccatggcccttacctcgacatcgttgatatagtgaacctcatcaaagatgacccactccaggtcccgaataacatctgagccactgtacagcatggagctggggagaagaggccaaggattgactccccagtggctcgtctccacccactcctcagacagcacactctccacaacggccacatcttcccagccaaaactcccctgtattgagtgtccatctctcaccgaaggatctctgtggtcatgatgaggcaggaggcctccggatgcagctgtacatccccggtgagcagccccacatccccgaatgtgtttcggaagtcccggaacttctggttgctcagggccttgatgggcgaagtgtagatggtgctgggaagagagcatgaagttagccagtccctccgcagactcatggcccgcacttcctctcccacatggagccctcgtggaagcatgccccagaagctcaggtgctcctcttcttcacccaaactgcccttacattctcctgcatgatataaccccagaaaaattctgtccccaaccccttcctaaactaacccaggtcattcttctaaactttctccccaccatgtcttttcatttctctctgggctcttgtctcagtcttagccctgaacctctcacttaaaggatgagctagagaggtgggggaagagatgagattttcaaaggatgcaggagaaaatggggctggctggtgaagggggaggttggcaaaggaactcataccgtgtcatgtgtttctgggccagggcaatggcatattcagccacaactgtttttcctgcagatgtgtgagctgcgacaaagacagagtcatgccgttccaagtgcaggatggcctgtttctgaaacacatctggctcaaatgcccactatgggagagagaaatagacaggagctgaagaaaggagcggggccttgctgcctcctgctcatggagcacgcagggcgggcggatgaaggccggagccagccgaggctgggactgagtaccaagactggcctgggatggatctgacctctggccaatagaggagacaaggggtcggctgggagtgtgacccagaaagaggtagaggagcgtgtgaagatggggccaaagtacctggaaggctggctggggaatgaggcgatagaaatcaccaacaggggaggtggcgtccacagggatggcccactgctcctgagatggaggctctggggcctctggggtggatacagctgtggacgcttcctggaagagtcaggggtagcagtgataaagatacaaccagagggctctcaattagcactcctcccaaaagatgtccctttcttcccctcagacccatcctagccagcccacatcctggtggcaaggctctttcttgcctccactacacagaaccaccaaccttcaacactaggtcttccaagctgcttgctcgggccaggggagcactgcagggagaggctgaaacagtgtcccctctgggacctcctggctgtcccactgcctcattctcatcctcgtcacccccacccaaatccagaggctccaacagacagctaaggcttagtagtccaggagctggagttggacaatctgaggagcaagccaacaaggtcaaccttgtcatgtccatctctgttccttaggagaaggacatgacttctcctacaccccactcaaaaactaaaactaaccttttggtgcaaagtccatgcctttcttgaaaccaggtggaatagtaagaagatctgtaggatagggacatggaatcaggtcactgcacactggtgaacaaattgtgtacattatataaacctaaaagataccatttacaggacagatgctgtagatagggatgtttgctatgacactttcccaacagatgacagtaaaggttgttgtagaaatttcccagcagatgacagtaaaggttgttatggacagaatatctttttctaattttctcaaaaacatgggagggctagcagtagcccagtgatagcctgggctcttcctcctcaaggctcagactcagagccccaccttacctttctcaaagtctatctcctcctcagcctcctcccgtgtgttcagatctgttatggtgggttcatccatcccccctgggaagagacaggacagacagggattcatgggatgagggtaatacgagataggtggggaacccttccctggagattaaagacaccctcttctaccatcccatctccacaagagtcacctggccagaagggatactgagttggatttccccataaggactgggaggctggccctggaggccggcgaagagacaaggaggttgtagccgagagatttgtgttctccagcaagacctaaggcaagagatcagagccccaatgaggctgagcttgtctctgaccacctccccttctccccaactgtttctcatgacccctgacctcctacctctttgtaacccagtatctggcctgtggttgggtgtctttgggcctgtaggtcggatgggactggggctcccaggacagccaaaagagaccagggatccgtcttcctctgccattttctggagagaaaaatagtaacttttgggtcttctttcttcctctgtcccagcttccttcaggaacccatcaccctagtctaagcccctccagactcctcaccgggctgagtgctccacaccatgcagaggcagccaggctggggatgacagaaacaactgttctgcttcttgctgcagatctggggcacaaggagggaggccatggggaagctgaaacaagggcaagatgagaggcattaggtaaggaaagaggataaaatgcagacaaaagagatgatgggacttgtgttcagatcagaaatggcagatgtgtcaaacagactaggacaatcaggcttggccaaaaactacctgctactgaattacctggggcagattttggatttcagaaacatggaggctggacctaggaatgtgcatttttaaaaagctccctggctaatcatgaagcacactgaaattggagactcactgattttagaaaaaggggtcccagacctaaggatgaaaggttggaggctcaaagcctatcatctcagtcaccaagtgccctggtgcttggatacagaagggagctccacggagaaatgccacatttgaaagagcagctctcaaagcaaaaatatccccagccctttctgctctgtcctcacacgtactgcaggtacactgggctgtaatctgtccagcaccccttcaggctgggatggacaggagtacaggcacagatgaacaaggttaagctagatcctactgtgaggagggtgaaggaggtttggactcaatgcgggtcaaaggttagggtcaaaagtcactcacgctactctctggagctccaggcaagttcagcagctcccagtgccccgtgcatccgagctccacggcccgaaggggtaggtccaggggatctggagggggtagcactacggggaaaggtcaaaagtcaggggtcaaagttcattccatatcggctactccgttccatttccctcccctccccctcaccaagtcgctctgtctccatcatcctggagccacagcagctgcctggcagcccggaagtgcggcaagtagtcgctgcgaagtaagccccgccccggaacgggcggaagtagaggcaacttccggtacagcccygccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcrgccagcgcgggcgcggccggagaccgtggggmccccggttgccgccccctcgggtaaggccctctgcttctcactcttcggccctttttctcatagccgtttctctgttcttcctctttgcrttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggtgctggtgtctgtgatccctggagacaggagggaatgctggatgatcccgaccagcgggagcttggacagcagcctggtttaagcaaggggtagggaaagccaaagacaagagtaggcagacctgaaggggtggggttgggtrcagtgtggacggcgtgtgaaccccgggtggtaacagtggagaaagatgtcttgggccctgcccctgaactaggagccaccatgttggtgataccccccggactgagcgaggaagaggaggctctgcagaagaaattcaacaagctcaagaaaaaggtgagggactgtgtgtggacatggcctaacctttcacagactctgcactctgagaagatatggggtgagtgtgagcgaatggggaagtttttctggcccatacctagagacatatcacctcacagtgtagcttcgagaggtgggctttcccaagccttggtgtggaccttctgtcttttctatgcaatttgccatggattgtcttcctttcccatggcttttagtaccgcttaagagctgatgatccccaagtttgttttttccagttctatccagtgttatactgaaaaacttcagatactcagtgttgaagctatcatctttctattcttgatcttccaaataagattgactacaccaattctgccacatgtttggactcaaaactctgacttccccactatttgcatagtcaaacctttgccaagtcttattgtttcttcttttgaagkaatttttcctgtttattcttcactgtgcattcccccgagcagggctttattgacattcatgtgggccattgtaatggtctctcaacaaatttctcagtctttttttttgaacagacttcttcactcctgttcaaatgatccattgaaaacacaaaattctgctccctctgtttctcaaaaaccataaatggcttcacattgtctataaaaaagcctcaaaaccttagtttggcagccttgtctagtaaagtagaactattcactacttccaaaagatgcattcccaaagccttcttatctctgcatctttgccaccctgttttctttttctaaaatacccttctcctctctgtgttgtgcagagatacgggagagggcctagtttaatagccattaaacatcagaaaatcttactagctttcagctatgaataatctgcacctcttataattgtattgctaactcaatgtattttatttctcagactgtaagcttcttgagggtaggaacaatgcattagcctcctggatatccctgttacgaagtcatggctgggcctcattcaatatgcaggaaatagatggatgaagcttccaggaaaggcacataaacttatacttacttgcagcttatatcctaggattctagtccatgattgagttatttgtcttcaacttcaaaaatgtaacactctggaaaacctctgggttccgtggtttggttagattaggaatttccagcatcatacatgatctaggggaccagaggcaagaggcagagcacatcagtgtaccactctgagggcatcaagaaagayggtccctggagtgatgtgcccaggggccttaggagaggaaccggctaggggctggccctcacttacctctctcttctcacccttgttcccagaaaaaggcattgctggctctgaagaagcaaagtagcagcagcacaaccagccaaggtggtgtcaaacgctgtgagtgacaggggaaatggggatggactggaagtgggcagcatggagctgaccttcatcatggcttggccaacataatgcctcttccccttgtctctccagcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggtgagcacaagcagaaagattgtttaaagggcatccctccaagttggaatgtagatgggtttggggaaaaatatgcatactcaagcactggcaaattgctgtaccattctgagtttcacctctcatgtataaaatgaaaaaaytagacgactcctgaattctccattttacaaattctgtggttctaatccaccttggattggagctcttggaatatgttgccctaagggatggaaagggctgaaaatgttatcaggttcaagagaggttcaaataaactgaatacataatatatcgagtcacttataaaaaataccagctgggcgtggtggctcatgcctgtaatcccagcactttgggaggctgaggtgggcagatcacttgagattaggagtttaagaccaacctggccaacatggtaaaaccccgtctctactaaaaatacaaaaatcagcagggtgtgaggccgggcrcggtggctcacacctgtaatcccagcactttgggaggccgaggcaggcggatcacgaggtcaggagatcgagaccatcctggctaacaaggtgaaaccccatctctactaaaaatacaaaaattagccgggcgtggtggcgggcgcctgtagtcccagctacttgggaggctgaggcaggagaattgcttgaacccaggaggcggagcttgcagtgagtcgagattgtgccactgcactccagcctgggtgacagcgagactccgtctcaaaaaaaaaaaaaattagcagaatgtggtggtgcacacttatagtcccagttactgaggaggctgaggccagagaatcacttgaacccaggaggcagaggttgcagtgagtggagatcacaccactgcactccagcctggacgacagagcaagattctgtctcaaaaacaaaacaaaacaagccacaatggcaggtgcggcaatggctcattcctggttaatttcagcactttaggaggccgaggtaggaggattgcttgagcccaggagtttgagaccagccctggcaacatagtgaaaccctatctctacaaaaaaaaaaaaaaatacagaaattagccaagcatggtagagcacatctctagtcccagctactagggaggctgaggtaggaggattgcttgagcatgggaggtcaaggctgcagcaagctacgattgctctattgcactccagcctggacaacagagcaggaccgtgtctcaaaaaaaaaaaaaaaaaataagtaaaaccacgtcaaataagaaatgtatgtagaattaaaagggaagaaaagatcagaggaaacctagaagagggtgagggaagaggaacacctctggtccatggttgggcaacctcctgctccacactgaggtaggtctytcaccactccaggaccccgagaagggaccagtccccactttccagccgttccagaggagcatatctgctgatgatgacctgcaagaggtaaaggctcctaatttctgtccctgaggggttggggatggaggaatatgagagacaaatatattttggaccacatgtcagcaactggaaatcatcttaactgttcttggtctcttttacagtcatccagacgtccccagaggaaatctctgtatgagaggttagagagtagagataaggctgggcccatttggtggagttgattgcctgagtccttgggaggtttgggctgtaggagctgggctatagagggaatattgagtctccacagggtctgaggggagaaggtaaaacccccctttgatcttcagtctgcatctccccagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgrgatcgagatcgagaccgggaacgggacagggatcgggagcgggatcgagaccgagaccgagagggtcctttccgcagtgagtgattttggctggaggtcaaggtgaccttaactgaggtttatgtgggtcctactaagtgaaatgtggcatggkctatgtcttgtgactatgatttgtgctcccaaagggtcggattcattccctgaacggcgagcccctaggaaagggaatactctctatgtatatgkagaagacatgacacccacccttctccgtggggccttctctccttttggaaacatcattgacctctccatggacccacccagaaagtaaggatgacaacagggcatgatgagaagtcctgggagaatcctggggtgtgagacctgagggaagaagctgccctccctgcagccgcctattatcactgggtttggttgggtccagaagagccccttggctctccactgaccgtgttttctcttatcccagctgtgccttcgtcacctatgaaaagatggagtcagcagatcaggccgttgctgaggttggaacttcccaaatctgttcttcccatcgcttctgctgttctcatgtgttctcctcaaaatactagatgccaggaagaagttggttcctcttgataaagaaagcctctccctattcacacagaaaaactcacattctcagattccttattcagtctcctcctaggatagcaactcctggaataacttctttggtttatctgtaatgttttcctccccatcctctgcctcccctcttctgcttcagctcaacgggacccaggtggagtctgtacagctcaaagtcaacatagcccgaaaacagcccatgctggatgccgctactggcaagtctgtctggggctccctcggtaagaatgggattcttccyttcccatcctytcccccacaggccattccttttggttcccccacacatccttgggtttcctagagatgatcgaggtcagagtgtgtgcggaggctatgggaatgggaaggaaaatttcagatcctctgtcagttagaggtaaagaaaggagagaaaaggattgaaaacagcttccaaagcagtgactggaacagggaagaaagtgggagctggagtgagattggtgaggaagatgagtgtctcatggggcttgttcattttgagatggagtagagtgagtttcataagtattcgaaatcagggatctggaactcaggtgtgaggtaaggaaggaaaacatagattaagtcatccacatcacagggtggctgccaaacaataggatcatcagggagactctgatttcagagaaaaaaaaacgacccaggactcagtttgaggagtactctgggactatgttaggaaacaggactgttcacctcacaccccacatgtccccagctgtcctgacatgttaggctaacgttgagcctaacgttagcaaaggagacaggaggaggggtcggagggctgggagcagcaccgcaggggcctgggccactgaagcaaaaggacacacactttgagaaagagggagtagccagcagtgttgaggcacagagatcacaggatgggagtgggtgagagagattctctgtagctcaagggtggtggggatggaaccattggatggggtgaagagagtaacatgtctggtggagggaggaaagaggaaggggaagaaacagctagaggcttragagagaatggtgagggccaaagctacaccctgaatgagttctggtggagctagtagcatttcttagtgtgaataatccattttccctgaaagtagattttcctgggaaaggagtgagcagaaagaagggctcagctacagtggcccttcaggcaaaagaaaggaactagaattgaccagcatgtcaaaaaagggctacagaggttttctagtttttagcttctgacatactgactgtaagtagtgggttaatatcattcacgtgtctcaacaatgacatttgggatttttctaagaacaaaacattcatcaaaatgtccacttatacttttcttggccatgggttggcacaaaggagctaaggaagacaggccatcctggccaccagagggcagcgtggaaactgggcttccaggggccagtggccaggagtgaggtggtcaggagtcagcctcagggtctgttctrtgatctcctttagaccttaactgttcctctcctccctccctagctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcascacttgggattggggttaarcctttaaaaacrgctgtcaggtttgatctcagtgtaacracatggccagtgcctgttccccactcccttgccccaaaaggatctggaacacaggtgttgtcgcagctgttttaattcaatcccacgcccctgtccagcaggaaaccccttatagaaaacccaaatcctcatcttggagtttctccttcagccagggcagcacttgaaagaggttgatgtgaaagtctcgggcgtgagcrggtacctgcttttgccgcttctggtttttgcagacatccactactccccagctgattacaccaacctgcagaggcagtggggtgccatggatcattcagtagaattcctaatcctggaagcatggctgttcctgcttgcgtcttagctgacctaaaggaatcagactagggacccagctcagcctcgttcttgacacacgcaggcaagacatgcggtcctaaggtgaggcaggctctgcctacctcgaattactagccacatgcattgagctttcctgctttggggcccatgctgaccacttggcatctccccagataggaaagggaggactcacttgaatgaaacgacttctcttgtgaactatcaaggggccgccagaatcacctgcaaggagagsagaagctgtagagaaaaggactgttgggccttgggcacttgtagcacraccaaagagcattctctcacctctgcaagtattggggtcagcatagggactcactcctccagtacaaaggaaccgaggggtgaccacctctgagatgtccttgactttgtcatagcctggggcatattgagcatctctctcacagctgcctttctgtaggggaggtgggaagcatggagaagtaatgaacagaagtggcttaggaaggattggggcctagagtgcctccttaggatgcccgtttctcaccttatccccattcttgatgtagacctccttccgagtcagctttttctcctcctcagacacaaacagagctttgatatcctgtgcagggagcagctcttcctctggacgaatagactgcgtcacttcagctgctcccaccactgtcatctccccattgcctttgtcactcagtagatgtcccctaagcccttctagagctaggttctgggccaggcatcatctcttcctattgcacctccctctcatgccccacttgtctcttgggatctcatccttatcctcttgccaagtatgtcttactttgttgctggcaagtggtagttggaggaagcctcaaagctcgagttgttccctcggtgcaggggagacaaatgggcctataaaggacaaggagaacagcaaaccaggcctgctcctcaccccagtcctccagcctttcccagcctttcctcagggatctggacgctctcacctgatagtctggccatatttcagcttattcttgagcttgatcagggcaacgtcatagtcataaaattcaggaattcctgctkcttytttcccattaatgttgtagttrgggtgaaataggactacttctatctccaggtcccgcttctcccctcctgaagtaggagagtaggtaccacctctttgtgggcagcttcctgcctctggccccgtgtcattcctaacttcacgtcttcccccatccctgactggtctggggtgcaaggaatggggctgcattgaggatgggtggagtgtaggatctgtagaaagtgggaggtgttgcctggagagcataggtgcagcccaggaccttcagttgcatccttacctacgctgaccttgattgagtgttccttgtcatccacagtgaaacaatgtgctgctgtcagcacaaagtactcagacaccacagcccccatacagctctcgtgtccctttgaagggcgctggggacacaacagtagagagggaaagctcaactttcacaaaccaccatctcttatggccattttttccttcccctactcccatttcaccttgacctcacctcccccaagtccccactactgggattctgtgcttacaatgactgagatcttggcctgccatggttgcttgtggtaatcggtacccttcctgtgttcccaaaccatgccacagagactcagagactggctttcatctggcagagaaggagaatgtgctgaaaactcggaacacttcattcccaaatggcagcagccttttgggtaggagtctatggggagcaaaggcccaaaaggagaaagggaaagaccacgggtatttgtttcctcgtgttaggagaaaactgctatggtggactgaaaagggaaagaacttgggatcaagctgtcagaggcctggctgttttcaagcccacccttgttgctaacttgctgtcccttgacctcctttggcttctgtttccacgtgtcaaatgtaggactatagaaagatctctgaagtgctcagagctctgtgattctaaggttaagtgaacagtgccaggaaacaagaatagtgacactgaggtagagaaggaggaatgaagaaggctttccaggcaactagagcttcaggtgtagaggaagaatgaattacttcaggggaacctgaggagagttgtgttctttattcccttgtatckccctaccgatcatttggtagaaaacatcttccaggttttccatatccttractttgaacacatgttgctcattgtctttcttggaagccaaagcattgatgttcacttggttcaccaaaggcccgaccccaaacacatagacatctgagggataaaaaggaaggatgagggtccaagccctgaggaagtggggtgctgggtcctaggcaggttactcacccagataatcctcccttgggtttttgcgatccttgccaatgtatagcaagtcccggatctcatcaatgacagtaattgggtccccgcccatgttgtgcaatcctgcagaagagacaggaccatgagggtaggagataaggaagataaactggctaaaggcagggatacacatggcagggtgagcaagttgaggaagggttagagatagttgatcacagggcttaggaagaattccttatgaagggtcacaggagagatgaacagccagctatgagtcacattcagggccccaaccatgggtatagtgttacaagtggacttaagggccacatgctggtctgagaaggtggggaggctgggacaggagagaggtcccttctgaccatcagtcatgaggatgatgacatggcgggtgcggttccagccttcaggagggacgtcatctggccagctcatmatgctgtacactgcctggagggccttcttggtgttagtccctgacttcaacttgtggtctgtggagagggaagagaccatcacctcacctggtcttccaagccatcttttaaccccagagaccaatctgcaactgaaatcccacatctttcaactttttaagttaatcatcattacacggacttccctttgaccacaaagtggcccttccagcccccaacaggttcccactaacctccattgcccaacgatcctgctgttcaacctttgactacaaagtggtcctccctgtcgccctcaaggtagtctcatgaccccctccaccctgaacctcctgaccccaaagtgaacctcccaccattccctaacctctgaccttcataattgatttcattgagctgcttcgtgacccagtctgcattactgctgtctgcttcagacactttgacccaaattttggggtatgtggcatatgtcactagaccatatcttggcttcacaccataacttgccacctgtgggtgaggagaacaaggcgccatggcattgaaaatagaatactgtgattgggagatttcagcgactttgctgggacagggaggctctcagtaagaggctcaagggctgaggttcatggaggaattaccagtcaagaaactgcttcaagtaaaagggaaggaggacagaataggacctggagattttcctggggccctgttgttcagaggggctggaatgatcagggagctagtcctggaagatcagcgagattccattcccccgagttcagggataggaggattccaccttctcaattaagttgactagacactttttggctcctgtgaagttgctggccccaatgctgtctgatccatctagcaccaggtagatgttcatggagcctgaagggtccaggacgatcttccgcttctgttgttcccctgggtgccaggagagtggctcaggctccagcattaacagttctgtcccttctccattttcccccagttccctgccctgcctcccttctctgtcttcaaacctgggcygtgcccatcctcagcatcgactccttctatggtctctgtcagggaagacaggaaagcttcggccacctcttgaggggtgtcrtacatgaaggagtctgggagagtcagaaatgaggtcaaatgtctgggagtgtcagggatacagtgaccaaagagacgggggatcatgggtttccagggtataaaaggctcagaagtgagatagttgtacagggaggtttaaacaaagtgaggaaagagcagggttgaggtggggagagaagacagtaggatggaagaccaggatctgacctgggggtacaggtcaaaggtcaccttggcaggaaggctccgtcccgctccaagagccaccttcctgacacgttcgccgctgggagccacgcagggtaagcccccggctgcagtggtaggtgacgctgtcttcaaggcggtactggctgcccaccttccttgtgccaatggggatgcccgggttggagcagtaccccgctgcagaggtatgagacatcgaggtaagcactgaagcctgaggccccgtgagcaaggtagagagcaagagttacagtgtccggagccgagtgcccactcctcgggctgggcgccgtcagggagacagcaatgtagggggaggggatgcttctcacctccgttgtcacagatcgctgtctgcccactccaccggccattcacttggcaggtgcgattggcagagccccggagagtgtaaccgtcatagcagtggaaagagatctcatcactcacattgtagtagggagaccggggccagtattccccgttctcgaagtcgtgtggtcttggacagtggattgctttgagaaggggggacaagtagaagtcatcaagagggaaaggctgccttaggtgtatccctcctggtctcggagaccatgtcactgagaaacagcgcattcccagtcccgcagaagcagcatcttacctactcctcaacccatatggatttccactgcttctccctccccatttctgagtgttctcttgacttccagggctgcctggaagcccagggtaaatgcttagtaagggttaactccgctttttcttgccccctttccgcctgccaccctaaaactgctcctactcccggtcagcccaccttgtcaccctgcctagtctcatcctagtcctgaccttgctgccgcctgccctgtttctgccttaggccactgcccacactcattgccctcaaacctctgcactctgccttcctgacagtcttttggtcttgagtcttcagggtgctccaggaccccgtagatctgcaggtacgtgtctgcacagggtacgggtagaagccagaaggacacacgtactccagtgcctggccctcttggagaagtcggaaggagccgcctttgatctctaccccctccagagagcaggatccctggggccaggccaaagaccatggagtggtggtcacacctgaagagaaaggctgatgaagcctggccccaaaaggccaaggagggatgctggagacagcaggaagggaaggttaccctcgcttacctccagacaagaggcccaagataaagggcatcaggcagagttgggggctgagattgctccccatggcgttggaaggcaggagagaagctgggcctggggcaggatggtgtgtcctggcttgctttgcttgtctgcttggctcagtgtccaagctgaaactccagacctagacctggtcacattcccttcccctgctcccc

SEQ ID NO: 1686 - DNA, 23248 bp, Homo sapiens
caggaaaatctactttcagggaaaatggattattcacactaagaaatgctactagctccaccagaactcattcagggtgtagctttggccctcaccattctctctcaagcctctagctgtttcttccccttcctctttcctccctccaccagacatgttactctcttcaccccatccaatggttccatccccaccacccttgagctacagagaatctctctcacccactcccatcctgtgatctctgtgcctcaacactgctggctactccctctttctcaaagtgtgtgtccttttgcttcagtggcccaggcccctgcggtgctgctcccagccctccgacccctcctcctgtctcctttgctaacgttaggctcaacgttagcctaacatgtcaggacagctggggacatgtggggtgtgaggtgaacagtcctgtttcctaacatagtcccagagtactcctcaaactgagtcctgggtcgtttttttttctctgaaatcagagtctccctgatgatcctattgtttggcagccaccctgtgatgtggatgacttaatctatgttttccttccttacctcacacctgagttccagatccctgatttcgaatacttatgaaactcactctactccatctcaaaatgaacaagccccatgagacactcatcttcctcaccaatctcactccagctcccactttcttccctgttccagtcactgctttggaagctgttttcaatccttttctctcctttctttacctctaactgacagaggatctgaaattttccttcccattcccatagcctccgcacacactctgacctcgatcatctctaggaaacccaaggatgtgtgggggaaccaaaaggaatggcctgtgggggagaggatgggaarggaagaatcccattcttaccgagggagccccagacagacttgccagtagcggcatccagcatgggctgttttcgggctatgttgactttgagctgtacagactccacctgggtcccgttgagctgaagcagaagaggggaggcagaggatggggaggaaaacattacagataaaccaaagaagttattccaggagttgctatcctaggaggagactgaataaggaatctgagaatgtgagtttttctgtgtgaatagggagaggctttctttatcaagaggaaccaacttcttcctggcatctagtattttgaggagaacacatgagaacagcagaagcgatgggaagaacagatttgggaagttccaacctcagcaacggcctgatctgctgactccatcttttcataggtgacgaaggcacagctgggataagagaaaacacggtcagtggagagccaaggggctcttctggacccaaccaaacccagtgataataggcggctgcagggagggcagcttcttccctcaggtctcacaccccaggattctcccaggacttctcatcatgccctgttgtcatccttactttctgggtgggtccatggagaggtcaatgatgtttccaaaaggagagaaggccccacggagaagggtgggtgtcatgtcttctmcatatacatagagagtattccctttcctaggggctcgccgttcagggaatgaatccgaccctttgggagcacaaatcatagtcacaagacatagcccatgccacatttcacttagtaggacccacataaacctcagttaaggtcaccttgacctccagccaaaatcactcactgcggaaaggaccctctcggtctcggtctcgatcccgctcccgatccctgtcccgttcccggtctcgatctcgatcccgatcccgatccctgtcccgctctctgtctctgtctcgatcccggtctcgatcccgctcccgatctcggtctctgtcccggttcctctcatggctgcggtcccggctgcggcttcggggaggggaggctgaggagtgggcaccactgcgttcttcatagccccagtcaaagcttcgagggggaccatcaccagcccctgggccctctgcctcttctccatctggtcctagttctcgaagtcgatcactagaagacacaaagctggggagatgcagactgaagatcaaaggggggttttaccttctcccctcagaccctgtggagactcaatattccctctatagcccagctcctacagcccaaacctcccaaggactcaggcaatcaactccaccaaatgggcccagccttatctctactctctaacctctcatacagagatttcctctggggacgtctggatgactgtaaaagagaccaagaacagttaagatgatttccagttgctgacatgtggtccaaaatatatttgtctctcatattcctccatccccaacccctcagggacagaaattaggagcctttacctcttgcaggtcatcatcagcagatatgctcctctggaacggctggaaagtggggactggtcccttctcggggtcctggagtggtgagagacctacctcagtgtggagcaggaggttgcccaaccatggaccagaggtgttcctcttccctcaccctcttctaggtttcctctgatcttttcttcccttttaattctacatacatttcttatttgacgtggttttacttattttttttttttttttttgagacacggtcctgctctgttgtccaggctggagtgcaatagagcaatcgtagcttgctgcagccttgacctcccatgctcaagcaatcctcctacctcagcctccctagtagctgggactagagatgtgctctaccatgcttggctaatttctgtatttttttttttttttgtagagatagggtttcactatgttgccagggctggtctcaaactcctgggctcaagcaatcctcctacctcggcctcctaaagtgctgaaattaaccaggaatgagccattgccgcacctgccattgtggcttgttttgttttgtttttgagacagaatcttgctctgtcgtccaggctggagtgcagtggtgtgatctccactcactgcaacctctgcctcctgggttcaagtgattctctggcctcagcctcctcagtaactgggactataagtgtgcaccaccacattctgctaattttttttttttttgagacggagtctcgctgtcacccaggctggagtgcagtggcacaatctcgactcactgcaagctccgcctcctgggttcaagcaattctcctgcctcagcctcccaagtagctgggactacaggcgcccgccaccacgcccggctaatttttgtatttttagtagagatggggtttcaccttgttagccaggatggtctcgatctcctgacctcgtgatccgcctgcctcggcctcccaaagtgctgggattacaggtgtgagccaccgcgcccggcctcacaccctgctgatttttgtatttttagtagagacggggttttaccatgttggccaggttggtcttaaactcctaatctcaagtgatctgcccacctcagcctcccaaagtgctgggattacaggcatgagccaccacgcccagctggtattttttataagtgactcgatatattatgtattcagtttatttgaacctctcttgaacctgataacattttcagccctttccatcccttagggcaacatattccaagagctccaatccaaggtggattagaaccacagaatttgtaaaatggagaattcaggagtcgtctagttttttcattttatacatgagaggtgaaactcagaatggtacagcaatttgccagtgcttgagtatgcatatttttccccaaacccatctacattccaacttggagggatgccctttaaacaatctttctgcttgtgctcacctttaacttcccctcaagggttcgagaacgcttgaagcctgagttcttggtctcagccttgatggcactgatggctcctgacttcaccagctgctttgcctgctctgttgctgtggctgtgtccatgacaggctgctctgatagtgctggagagacaaggggaagaggcattatgttggccaagccatgatgaaggtcagctccatgctgcccacttccagtccatccccatttcccctgtcactcacagcgtttgacaccaccttggctggttgtgctgctgctactttgcttcttcagagccagcaatgcctttttctgggaacaagggtgagaagagagaggtaagtgagggccagcccctagccggttcctctcctaaggcccctgggcacatcactccagggaccrtctttcttgatgccctcagagtggtacactgatgtgctctgcctcttgcctctggtcccctagatcatgtatgatgctggaaattcctaatctaaccaaaccacggaacccagaggttttccagagtgttacatttttgaagttgaagacaaataactcaatcatggactagaatcctaggatataagctgcaagtaagtataagtttatgtgcctttcctggaagcttcatccatctatttcctgcatattgaatgaggcccagccatgacttcgtaacagggatatccaggaggctaatgcattgttcctaccctcaagaagcttacagtctgagaaataaaatacattgagttagcaatacaattataagaggtgcagattattcatagctgaaagctagtaagattttctgatgtttaatggctattaaactaggccctctcccgtatctctgcacaacacagagaggagaagggtattttagaaaaagaaaacagggtggcaaagatgcagagataagaaggctttgggaatgcatcttttggaagtagtgaatagttctactttactagacaaggctgccaaactaaggttttgaggcttttttatagacaatgtgaagccatttatggtttttgagaaacagagggagcagaattttgtgttttcaatggatcatttgaacaggagtgaagaagtctgttcaaaaaaaaagactgagaaatttgttgagagaccattacaatggcccacatgaatgtcaataaagccctgctcgggggaatgcacagtgaagaataaacaggaaaaattacttcaaaagaagaaacaataagacttggcaaaggtttgactatgcaaatagtggggaagtcagagttttgagtccaaacatgtggcagaattggtgtagtcaatcttatttggaagatcaagaatagaaagatgatagcttcaacactgagtatctgaagtttttcagtataacactggatagaactggaaaaaacaaacttggggatcatcagctcttaagcggtactaaaagccatgggaaaggaagacaatccatggcaaattgcatagaaaagacagaaggtccacaccaaggcttgggaaagcccacctctcgaagctacactgtgaggtgatatgtctctaggtatgggccagaaaaacttccccattcgctcacactcaccccatatcttctcagagtgcagagtctgtgaaaggttaggccatgtccacacacagtccctcacctttttcttgagcttgttgaatttcttctgcagagcctcctcttcctcgctcagtccggggggtatcaccaacatggtggctcctagttcaggggcagggcccaagacatctttctccactgttaccacccggggttcacacgccgtccacactgyacccaaccccaccccttcaggtctgcctactcttgtctttggctttccctaccccttgcttaaaccaggctgctgtccaagctcccgctggtcgggatcatccagcattccctcctgtctccagggatcacagacaccagcacctttaggtaccatgtggttcaaggagggacaaatatccactccgtcggaaagacgatggcacccgacccccctaccctcgctagggtaaggacaaccgcggggtttgaacggcagagaaggcggtggagccagcgtagcgcccgcagagcaaygcaaagaggaagaacagagaaacggctatgagaaaaagggccgaagagtgagaagcagagggccttacccgagggggcggcaaccggggkccccacggtctccggccgcgcccgcgctggcygctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcrgggctgtaccggaagttscctctacttccgcccgttccggggcggggcttacttcgcagcgactacttgccgcacttccgggctgccaggcagctgctgtggctccaggatgatggagacagagcgacttggtgagggggaggggagggaaatggaacggagtagccgatatggaatgaactttgacccctgacttttgacctttccccgtagtgctaccccctccagatcccctggacctaccccttcgggccgtggagctcggatgcacggggcactgggagctgctgaacttgcctggagctccagagagtagcgtgagtgacttttgaccctaacctttgacccgcattgagtccaaacctccttcaccctcctcacagtaggatctagcttaaccttgttcatctgtgcctgtactcctgtccatcccagcctgaaggggtgctggacagattacagcccagtgtacctgcagtacrtgtgaggacagagcagaaagggctggggatatttttgctttgagagctgctctttcaaatgtggcatttctccgtggagctcccttctgtatccaagcaccagggcacttggtgactgagatgataggctttgagcctccaacctttcatccttaggtctgggacccctttttctaaaatcagtgagtctccaatttcagtgtgcttcatgattagccagggagctttttaaaaatgcacattcctaggtccagcctccatgtttctgaaatccaaaatctgccccaggtaattcagtagcaggtagtttttggccaagcctgattgtcctagtctgtttgacacatctgccatttctgatctgaacacaagtcccatcatctcttttgtctgcattttatcctctttccttacctaatgcctctcatcttgcccttgtttcagcttccccatggcctccctccttgtgccccagatctgcagcaagaagcagaacrgttgtttctgtcatccccagcctggctgcctctgcatggtgtggagcactcagcccggtgaggagtctggaggggcttagactagggtgatgggttcctgaaggaagctgggacagaggaagaaagaagacccaaaagttactatttttctctccagaaaatggcagaggaagacggatccctggtctcttttggctgtcctgggagccccagtcccatccgacctacaggcccaaagacacccaaccacaggccagatactgggttacaaagaggtaggaggtcaggggtcatgagaammagttgggkagaaggggaggtggtcagagacaagctcagcctcattggggctctgatctcttgccttaggtcttgctggagaacacaaatctctcggcyacaacctccttgtctcttcgccggcctccagggccagcctcccagtccttatggggaaatccaactcrgtatcccttctggccaggtgactcttgtggagatgggatggtmgaagagggtgtctttaatctccagggaagggttccccacctatctcgtattaccckcatcccatgaatccctgtctgtcctgtctcttcccaggggggatggatgaacccaccataacagatctgaacacacgggaggaggctgaggaggagatagactttgagaaaggtaaggtggggctctgagtctgagccttgaggaggaagagcccaggctatcactgggctactgctagccctcccatgtttttgagaaaattagaaaaagatattctgtccataacaacctttactgtcatctgctgggaaatttctacaacaacctttactgtcatctgttggraaagtgtcatagcaaacatccctatctacagcatctgtcctgtaaatggtatcttttaggtttatataatgtacacaatttgttcaccagtgtgcagtgacctgattycatgtccctatcctacagatcttcttactattccacctggtttcaagaaaggcatggactttgcaccaaaaggttagttttagtttttgagtggggtgtaggagaagtcatgtccttctcctaaggaacagagatggacatgacaaggttgaccttgttggcttgctcctcagattgtccaactccagctcctggactactaagccttagctgtmtgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggttggtggttctgtgtagtggaggcaagaaagagccttgccaccaggatgtgggctggctaggatgggtctgaggggaagaaagggacatcttttkggaggagtgctaattgagagccctctggttgtatctttatcactgctacccctgactcttccaggaagcgtccacagctgtatccaccccagaggccccagagcctccatctcaggagcagtgggccatccctgtggacgccacctcccctgttggtgatttctatcgcctcattccccagccagccttccaggtactttggccccatcttcacacgctcctctacctctttctgggtcacactcccagccgaccccttgtctcctctattggccagaggtcagatccatcccaggccagtcttggtactcagtcccagcctcggctggctccggccttcatccgcccgccctgcgtgctccatgagcaggaggcagcaaggccccgctcctttcttcagctcctgtctatttctctctcccatagtgggcatttgagccagatgtgtttcagaaacaggccatcctgcacttggaayggcatgactctgtctttgtcgcagctcacacatctgcaggaaaaacagttgtggctgaatatgccattgcyctggcccagaaacacatgacacggtatgagttcctttgccaacctcccccttcaccagccagccccattttctcctgcatcctttgaaaatctcatctcttcccccacctctctagctcatcctttaagtgagaggttcagggctaagactgagacaagagcccagagagaaatgaaaagacatggtggggagaaagtttagaagaatgacctgggttagtttaggaaggggttggggacagaatttttctgggrttatatcatgcaggagaatgtaagggcagtttgggtgaagaagaggagcacctgagcttctggggcatgcttccacgagggctccatgtgggagaggaagtgcgggccatgagtctgcggagggactggctaacttcatgctctcttcccagcaccatctacacttcgcccatcaaggccctgagcaaccagaagttccgggacttccgaaacacattcggggatgtggggctgctcaccggggatgtacagctgcatccggaggcctcctgcctcatcatgaccacrgagatccttcggtgagagatggacactcaatacaggggagttttggctgggaagatgtggccgttgtggagagtgtgctgtctgaggagkgggtggagacgagccactggrgagtcaatccttggcctcttctccccagctccatgctgtacagtggctcagatgttattcgggacctggagtgggtcatctttgatgaggttcactatatcaacgatgtcgaggtaagggccatgggctccccagaacccggcagtcctctcctttgggaccagttgagcgtctcccttattccacacactcagggccccttactgctttctttacccccatatggaatcctgtgcctctttatgggcagaagggcggcccctgccctcatgtgacctcccttccctctctgtgcccagcgtggggtcgtgtgggaggaggtgcttatcatgctacctgaccacgtttctatcatccttctgagtgccaccgtccccaacgcccttgagtttgctgactggattgggtgagacgtgtgtcccgggttgcctgggtgaagggggctacagtactccttgattcgggtgggggactaagtctaccacagcaaggagagcggtcaggccttaggggtgatgctggggaacatgtcccacctggtggctgtgggatcccctttgggtccagattactttgcatgttgaaatgggatgagatgttgggggatagccttccattctgggtctcagaaaagactgggtaaagttggaggggtagggaagggggtggggatgygggttccttcccacgttcccacccctgacctgcttccctctcctttcttcaggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtaagcctcgagatgggggaaagagttagggctgggcccccagctggacattgtggctacccctccctgtgccccaggtactatgcagctgtggaggccaagaaggagagaatgagcaaacacgcccagacctttggggccaagcagcccacacatcaggggggccctgcacaggtgagaactgggagggttttgtacctgccagcacctgtttttcctcctatcttttttttccccttgtcccccaggggttttgacttgagctttgagcaytgccccagttaacactagctcacctctcattggttcaggaactcaacctctgctccttcccctyccccttccttctccaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtgcgtctgtgtgcgtctgtgtgcgtgcatgcacacatttggcagactggtggggatagggtgttccgagactccatccctgaccatgggcctcctcccaccaaaggtcctgcacatgtcagagctcctgaatcgcggcctgggtgtgcaccatagcggcatcctgcccatcctcaaggagatcgtggagatgctcttcagccgtggcctggtcaaggtgcatgtggtggtggaaagggactcctcagggtgcttgttgcccacttaggggctgyccagagggcagaggggcagaggtttaggcaggccagtgctgtggttaagaatctgggctctggattcagactacctgggtttgaatcccaggtacaccatgtattcacagtatcatcctggaccaattatttaaccttcctgaactttaggtttcccatcttaaaatggggatgcataagatatgaatacgtaggtctcagaaaagaaacccaggaagctagcaagcattcgaaaagttattagtaatcagaaatatacaaattgaagtactcacaagatacgactttacagctattagactggtaaaatttaggaaactagttcatgccgagtgttgccagagatataggaggttgtagggttctgggaatcctttacgggatgcctagccagtttggaatgcacgctggcactatttagacaaaataactatattggccgggcatggtggctcacacctgtaatcccagcactttgggaggctgaggtgggtggatcacaaggtcaagagatcgagaccatcctggccaacatggtgaaaccctgtctctactaaaaatacaaaaattagctgggcatggtggcagrtgcctgtagtcccagctacttgggaggctgaggcaggagaattgcttgaacccaggaggcagagattgcagtgagccaagatagcaccgctgcactccagcctgggcaacagagggagactccatctcaaaacaaaaacaaacaaagaaacaaacaaaaactatatcatactctgagcttatatttcattcctgggtatatatcacaaagaaattctcaccctggtctgtgagagaacatgtacacccatcctttgtttgtggtggcatggtgttggtagtaccagggtgcccttcactgggagagagggaaggttagtgtgggggatgcacccatagagtgttctgcagcagttggaagcagtgggttagatgtggccacaggaacatggacaratgttgaaacactaggtggagaaaaagaagcaaaaaaaaatcagatatataaccactttttatatgaattataaactacaagctcacaaaagaagacatgttctataagatcatatttatataaaaagatatttgttggatacattggaatgattgcagtcagggatgggaatgggatatgaaggtaaaagttaagaaatagaaataagtagctacataagtaaaatgaggaaaacaataatacctgccctatagatttgcctggagagttcagtgagatcccataagtaacaactgggatggtgccttatgcctacaaagtaaggtgggcttggccagggctgggggtgtgtgtaygtagagcctttgctgatcctttctgttctcctctgtcccaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggtgagcgggccagcatgctcggcagggccccagctccaggaccttgctggattctgtcttcgattctcctctcttctttttcttcttccttttttttttggagacagggtcttgctctgttacctaggctggagtgcagtggcacaatctcgggtcaccgcaacctctgccttccaggctcaagggatcctcccacctcagcctcccaagtaggtgggattccaggcacatgccacacaggcctggctaattttttttttttttttatgctttgtagagatgaggttttgctatgttgcacaggttggtcttgaacttctgggctcaagcagtctgtctgcctcagcttcccaaagtactgggattataggtgtgggccacagcgcccaacttcctccgacttttttgttttgcctgggagaagctgaggtaggagtgagtgaatccaaggatgagattggagcccatctcttccagttttctcccatgtgaatatggagctagatggggcctttgagtccatttatttcagtttgctcccttatgttacagaagaggtgagcaagtggtttgtccaaggcyccatggttgcagagctaggaccggatctgacgggagtaggcccagtccagaagactggctggggttcagtaggtcccaccctgatctcagtgacttctgtgrcctgactccaggggaagccrtcccagctgcagtcccagttccgcctcacgtacactatgatcctcaacttgctgcgagtggatgccctcagggtggaggacatgatgaagaggagcttctctgagtttccctcccgcaaagacagcaaggtaaggagcctggggtaaccagtgtgtggagcaggaggttggccaaagacaggctgggaataggtaggcatccagaggccagtgtgttgagggtggggagtgtgacagattgggcctggagactcccctttcacagcttcccctgctcccacccaaggcccatgaacaggccctggctgaactgaccaagaggctgggagctttggaggagcctgacatgactggccaactggtcgacctgcctgaatattacagctggggggaggaactgacagagacccagcacatgatccaggtgagcaagtgtgagwgctgaggaggtgataggagaagggaagagaagatcgtgttactctaggtgctactaaacttagtccaagtgtctgtccctgtgatgcctcctcccatctgtcctttgctcttcagcgacgcatcatggagtctgtgaacgggctgaagtctctctcagcaggaagggtggtggttgtgaagaatcaggagcatcacaacgcattgggagtgatcctacaggtgagggtgatgggaatttggactccagagggtgggagggagcaagccctctctccattttccccacttggccagggcaggttgcgtcatcatagggccctcattttcccctcttgccctccttttcaccctctcccttcccatcaccacatcatgytcactccttcctcccaccaccccaagaagtctgctctgatcgcttgacttggktgcccctctctactggtgagctctgcatggttgcttcctgattcctgcccaagggtgggtatctggtctctgcctttgatgtctactcatcacacccccstctcctggcctctctgaccacccccaggtctcctcgaactccaccagcagagtattcacaaccctggtcttgtgtgataagcccttgtcccaggacccacagracagggggccagccactgcagaggtgccctatccagatgacctcgtgggattcaagctgttcctgcctgaaggtgagagtgtggcagatgtctgttttctgccagcagtataagcaggatgcctgggtccatggcaatgtctgccctgctctccccttttcacagggccttgtgaccacaccrtggtcaagctccagccaggagatatggctgccatcaccaccaaggtgctccgggtgaatggggagaagatcttggaggacttcagcaagaggcagcagccaaaattcaagtcagagatgctagggaggcccttctcctccagaggggcacgtagaggcagggaggggcagtggtctgsgagtttcctccagcctgagggagaccatgaagtggtggggttgtagtgagggggctcccccagcctaagggagactgtgaagtggaggttgtagtaagagggcttccacagcctgagggaggcttctgkgggagagaagatcttaccccagatcttaagatctgctccctcttcaggaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccaggtaggaccctgggtggtaactcccaagctgggagtaggggcttttcctctgtggtcccctgtagactgaccgcccccatctcagcccttgtcctcagtgcacccctgctaaggggcaaggagaaggctgacgggtggctctctgcagtacctgaagctgcgggagcgaatgcagatacagaaggagatggagcggctgcgcttcctactgtcggatcagtcattgctgctgcttcctgagtaccatcagcgagtagaggtgggtggggcagtggttggggcaggggggctaggggacagcagtgtgtccaatgcycaccctttttcttgcaggtgctccgaaccctgggttaygtggaygaggygggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcaggtaggggacaccacccctttctccctgccagggctgtggcattcctgaccttcaccttcaggtagtcccccaggtgaccccctccagccctgtaagtgccccaaggatggaaaatggctgccttcttgatctggtccttccctgtcctggagcaggaaggcaggccttaayctctccttctttcctgcagggaatagaacgtgtccgggctgtggccaagcggattggtgaggtccaggtggcttgtsgsctgaaccagacggtggaggaatttgtgggggagctgaattttgggctggttgaggttgtatatgagtgggcccggggcatggtgagtacctgaggtttgggattttgcagacggctggctggggagaacctgcccaggctgagtgcatccagtcctcaccctactttccccacagcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgkatttgcggccagcctctacacccagtgaatgccccatgtaaaaacaygatgataaaacagcaaagcactgttgtgtgcttgagttgctggacagggatgactcasctaagaagacagcgagagaacytyttagaaatatgcttttattatctgcacacagagatatgactgcctccctctaaagcattactatttgggagagggagtcttggggggtgatgggaggtcctgagtcatagcttccacataccatatgggcaggaaggcgtaaggtgcatcttggtgtacagacacggtgactgggccgccaggctcccaagagaagagatgaacgagcctggggggcagatggaggcatcagttgagggccagaggctggatcctgggatccagaggggagggacagagctgaatgcctcacctggggtcatcctggacaaccgtgctctgggcaaagctaaggaaggcggcacagaagttcatgcacacagagggattccagccgtcacggtcattctggagcaggcagaggaggaggcagaagatgggcagtgggggtggtgggaggagagaaggcaggctgttgccctggatgctagacctgtggtcttggtgtttggggatacgggtgggagctgcaacatcgttcccttaccctgacatattcaaacatcttcatggtaggaaaggtcttgagggaagagacaaaaccgtctgggttacggaagccagcaacaacattcgggacccctgggaggaatgactgagcccaccatttcaggagcttgtgtctgacaggaaaagcaagggatcagtgggacccctcgtgcaccctccattctgccttcaccctcctccccaagtccctttcccagccttcaagcctaagctctcgccctgcccaccccgatcctgaacctgtagaaactcctccattggccagggctgtgcatctccttggaggtcttgagctccacatagcaggttgggggctgtgtggatggggcttgggggtctgtgcagtctacctcccctgagaagagcagagggtggcttcccaggcggctgcgtagcacagagcagaaggccacgttggtgttaacctccccagaggggtctggggagcttccaggtttgtctgcacaaggagagaagcagcagcaggcgtggggggctctcaacctctgggaaggggaagggggctatgaagcaggggcaactcacctgcacacatgtactgctcaaatttgtatcccatgtacataagctcccggaggagcggtggccgagcaagcctctgggcccgagcgttcggtgtctccacttcactcaggtatagtgttccctggaaccgggaggctgccagctgccagccctcctgccgctcatacggtgtcgtcagcagttttgtcaggtgcccccgccacgtcactatggcctctgccagccagcctggacccctgagaggcaggagttacaggctgaaggtctgacacaagcattagtgagatgctcccctcgaagaatagtcttgtttcttctaaggactgattctcaccccggctttggctctcctaattttagagggtaggtacgggtctccagatatactgcctaccacgctttgctcacccctccaaccggcctcggtgttccaggagccagcacagcaggtggtccagcctttcctggacctcctcgtcccggggctggtatcgatccgggtatccgtctctgaggtcaaagttggggcctggaccgttagtggggggtgggctatagtagcgcagggctcgggcatctccatggtactggcgttgagcatccagggagaagcagcccagttccgaagggcgccggtagaaaggaaagggcccagagtagagggcagggtctgtgggcagagaaggtgctggacgaggtagtttgttccgaggctcagctacctctgtcttctcagctcctctcttggtccccctgggatccatgaggtcctaagacaagcaggggtacagagtttccattctacagaggaggcctggagaaggatgactggtttaggactaagcgagccacctgatcgccaggctctggccttgaaacattcaggcccctcagacgccaccgcggccaagctctcatcctgcctctttccttgcccttcacccaccctccctccaggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccaggtaaccatggcaaccccgggggtggggcctcgcttccggtagccgagagttttgttagaaccgcgtccccgccccagttccctgtccgtgagccgatttatctgcccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctggtgaggggcgtcggtgcgaccgccggaagcccctttcctaactcctggaattccctgtcactcagtcactccgccagccgttcagcaagcattaggcctttcaggcgagggcactgtgccaggcactggggtgccacagagaccctgttaaaagtcccgcaggtagtacagggcatttcaaatcatggaggtagaagaacgaggcttttggggaaaccgagtcatggggcatggttcgaacatacagcgctgggagtgcagtcagacgtcagatcatgacaggccttgtacatcagtgttgtttccatcttacactgaggcgatgggctggtagagaatatcatagagagagggaatggtgtattggagatagtggatgaggcagggaggtcagctaagaagatactgcatctgagaagtggtgaaggcctaaattaggtcagtgcagtagggagggagaggagagtgaggaagagggaggagtccaggacaactcagactttccagatgactgcgtggctggtggtattaggagcacatttagttgttggactacagataatgtgtttaattttatacaagttgagttgatggtgcatgtggagcatccaaagacaaaggtattagacagttggatatgagagttggagagaattctgggccagtgataatagaattacaagtcatggaggtgtgaatagcaagtggttaattctgtgatgtggtgagatccagtaggaagagtgggtagaggagtgatttctaacctttttgtaatctttagaaggtgataaaagctatggctatctctctccagaaaaatgcacgtttgccacatatacatagggtgtatgtatagttaggggggaaatattttactaatcctgcgaggtccgtggttaaggactccaggtttagagtggaagttaatagggtcaaatccacaatgctgggaaacaccatcatttaaggcagtgttactgaatatatgagctgagttattatgcctgtgtcaaaattacgtgggctgcttgttaaaaaaaatacaggttcctgggactcatccaaggttaatgaattacgctctcttggggcgggatttgggactctacatttttgaactgcctcaagtgctttttaagtgtgccttaaaatttgagatccactgacataaagggaaagcagaagaagaggaatctgtgacagaggcagagagggacttgcctgagttaagaggaacccagaggccggcgcggtggctcacacctgtaatcccagcactttgggaggccgaggtgggtggatctcttgagctcatgagtttgataccagcatgggcaacatgacataaccccatctctacaaaaaatacaaaaattagccaggcgtggtggtacgcgcctatagagctactggggaggctgaggtgggaggattgcttgagctggggaggcggaggttgcagtgagctgagatagcaccgctgcaccccaccctgggtgatagagctagactttgtctcaaaaaaaaaaaaaaaaaaagtaacccaggaagaggcctactgtgaaagtaaagagatttttgagaaagtgaagtagttggcagtattagaacctgtgattcaagacagtggtctaagaagagggaagaggtaaagtaaaatataaactgaaatctaggctgagtgtggtggctcatgcctgtactcccaccactttgggagactgaggcaggagtatagcttgaaaccaaaagtttgagaccagcctgggcaacaaagtgagaccccatctttactaaataactgagatcccatctctactaaataaataaattaaaacacaaaaattcttagctgggcatggtggtgtgcacctattgttctagctgtttgggaagttgaggcagaaggagtgcttgagcccaggaatttgaggctgcagtgagctatgattgcacgactgcactccaggctgggtaacagagggagaccctgtctctaaaaaaatgaaaacaacaacaaaaaaacccagaactgaaatctgtccattggatttagcaggtagaaggttaatagtgatctttcaagaaaagaggaaagaaaaggaaggcagtctagcactcacttgaggtgagctagtctccctgactaggtctcccgtgaggaagcatgccagatggaaccactccttaaggagtatttgttgattttaatgtattggtgttagcttttgtttttaaaaacctttaaaagttgcagaatgaaaatataaacatatataatttaaatgatgtttataaagcagatacctatctagccactccctaggtcaaactatagaatatgaccagtatcccacatatatccctctctgatcaaaatgtctctgatcagaatgtccctgggaggtgactgctgtggtcattgttgccttagttttcccttttttttttttttttttgaggtggagtgtcgctctgttgcccaggctggagtgcagtggtgtgatctcaactcactgcaacctctgcctcctgggttcaagcaattctcctgcctcactgtcctgattagctgagactacaggcacgcgccaccatgcccagctaattttggtatttttagtagagatgggggtttcatcatgttggccataatggtcttgatctcctgacctcgtgatctgccctcctcggcctcccaaagtgctgggattacaggcatgatccaccgcacccggcctaattttgtatttttatagggatggggtttcaccctgttggccaggctggtctcaaactcctgactcagatgatctgcctgcctcggcctcccaaagtgctgttttttttttttttaattgtctttttgataattccactatttttttttttttttgaaaagtctcccatgtctacctctttccacacagacacggcaaccatccgatttctcaatcttttccccaccttttcccgctttctagtccacaaaaccaccattgtcatcgtggcccgttctcaatgagctgttgggcacacctcccagatggggtggtggccgggcagaggggctcctcacttcccagcaggggcggccgggcagaggcgcccctcacctcccggacagggcggctggccgggcggggggctgacccccccacctccctcccggacggggcggctggccgggcagaggggctcctcacttcccagtaggggcggccgggcagaggcgcccctcacctcccggacgaggcggctggccgggcggggggggctgaccccaccacct

SEQ ID NO: 1687 - DNA, 14682 bp, Homo sapiens
ctgttgaaaattaactaaaatcctggataaaaatgttattttaaaattgtttaagaccaggtacagtggctcatgcctgtaattcagcattttgggaggctgaggtagcaggatcaattgaggacaggagttcgagaccagtctgggcaacacagtgagacccccccacccgccacatctctacaaaaaatgtaaaaacagccaggcgtgggggcagacacctatggtcctagctacttgggagactaaggcaagaggatcacttgacccaggagtttgaggctgcagtaagatatgattgcaactgggcaacacagtgagaccccatctcttaaaaaaaattgtttagacactaaagagctcacaggataacaggaattaccactaatataacatctaagtaggccgggcgagatggctcaagcctgtaatcccggcactttgggaggctgacgtgggtggatcacctgaggtcaggagttcaatatcagcctgaccaatatggtaaaaccccgtctctactaaaactacaaaaattagccgggcgtggtgatgtgtgcctgtagtcccagctactcaggaggctgacacaggagaactgcttgaacccagaaagttgctgtgagccgagatcatgccactgcgctccagcctgggtgacagagtgagactctaactcaaaaaataaaaataaaaataactggggccgggcacggtggctcatgcctgtaatcccagcactttgggacgctaagggtggatcacttgaggtcagaagttcaagttcaagaccagcctggccaacatgatgaaacccggtctccattaaaaatacaaaaataggccagatgcggtggctcatgcctgtaatcccagcactttggcaggctgagacgggtggatcacgaggtccggagatcaagaccatcctggctaacacggtgaaaccccatctctactaaaaatacaaaaaaaaaaacaattagccaggcatagtggcgggcacctgtagtcccagctactcgggaggctgaggcgggagaatgggtgaacccaggaggcagagcttgcagtaagccaagatcatgccactgaactccagcctgggtgacagagcgagactccgtctcaaaaaaaaaaaaaaaaaaaaaattagctgggcgtggtgtcaggtgcctgtaatgccagctacttgggaggctgaggcaggagaatcacttgaactcaggaggcagaggttgcagtgagccaagatcataccactgcactccagcttggtgacagggtaagacactgtctcaaaaaaaaaaaagtaattggaacatggagggcatttattaatctaggcaaatctgcccagaacattttcaaaagtaactgggcgcataaggaaacaaaactcaaagagagaataaaaacaaaccccaaaagacaagtaatagtggaattatcctttccacggtctccctctgatgccgagccgaagctggactgtactgctgccatctcagctcactgcaacctccctgcctgactctcctgcctcagcctgccgagtgcctgcgattgcaggcgcgcgccgccacgcctgactggttttcgtattttgttagtggagacggggtttcgctgtgttggccgggctggtctccagctcctaaccgcgagtgatccgccagcctcggcctccggaggtgccgcgattgcagacggtgtctggttcactcagtgctcaatggtgcccaggctggagtgcagtggcgggatctcggcttgctacaacctccacctcccagccgcctgccttggcctcccaaagtgcccagagtgcagcctctgcccggccgccaccccgtctgggaagtgaggggcgtctctgcctggccgcccatcgtctgggatgtgaggagcccctctgcctggctgcccagtctggaaagtgaggagcgtctctgcccggccgccatcccatctaggaagtgaggagcgtctctgcccggccgctcatcgtctgagatgtggggagcgcctttgccccgccgccccgtctgggatgtgaggagcgcctctgcccggccgcgaccccgtctgggaggtgaggagggtctctgcccagcctccccgtctgagaagggaggagaccctccgcccggcagccgccccgtctgagaagtgaggagcatctccgcccggcagccgccccctccaggagggaggtgggggggtcagccccctgcccggccagccaccccgtccgggaggtgaggggcgcccctgcccagccacccctactgggaagtgaggagcccctctgcccggccagccgccctgtccgggagggaggtgggggggtcagccccccacgcagccagccgccccgtccgggagggaggtggggggtcagccccccacccggccagccgccccgtctgggagggaggtggtggggtcagccccccccgcccggccagccgcctcgtccgggaggtgaggggcgcctctgcccggccgcccctactgggaagtgaggagcccctctgcccggccagccgccccgtccgggagggaggtgggggggtcagccccccgcccggccagccgccctgtccgggaggtgaggggcgcctctgcccggccgcccctgctgggaagtgaggagcccctctgcccggccaccaccccatctgggaggtgtgcccaacagctcattgagaacgggccacgatgacaatggtggttttgtggactagaaagcgggaaaaggtggggaaaagattgagaaatcggatggttgccgtgtctgtgtggaaagaggtagacatgggagacttttcaaaaaaaaaaaaaaatagtggaattatcaaaaagacaattaaaaaaaaaaaaaacagcactttgggaggccgaggcaggcagatcatctgagtcaggagtttgagaccagcctggccaacagggtgaaaccccatccctataaaaatacaaaattaggccgggtgcggtggatcatgcctgtaatcccagcactttgggaggccgaggagggcagatcacgaggtcaggagatcaagaccattatggccaacatgatgaaacccccatctctactaaaaataccaaaattagctgggcatggtggcgcgtgcctgtagtctcagctaatcaggacagtgaggcaggagaattgcttgaacccaggaggcagaggttgcagtgagttgagatcacaccactgcactccagcctgggcaacagagcgacactccacctcaaaaaaaaaaaaaaaaaagggaaaactaaggcaacaatgaccacagcagtcacctcccagggacattctgatcagagacattttgatcagagagggatatatgtgggatactggtcatattctatagtttgacctagggagtggctagataggtatctgctttataaacatcatttaaattatatatgtttatattttcattctgcaacttttaaaggtttttaaaaacaaaagctaacaccaatacattaaaatcaacaaatactccttaaggagtggttccatctggcatgcttcctcacgggagacctagtcagggagactagctcacctcaagtgagtgctagactgccttccttttctttcctcttttcttgaaagatcactattaaccttctacctgctaaatccaatggacagatttcagttctgggtttttttgttgttgttttcatttttttagagacagggtctccctctgtyacccagcctggagtgcagtcgtgcaatcatagctcactgcagcctcaaattcctgggctcaagcactccttctgcctcaacttcccaaacagctagaacaataggtgcacaccaccatgcccagctaagaatttttgtgttttaatttatttatttagtagagatgggatctcagttatttagtaaagatggggtctcactttgttgcccaggctggtctcaaacttttggtttcaagctatactcctgcctcagtctcccaaagtggtgggagtacaggcatgagccaccacactcagcctagatttcagtttatattttactttacctcttccctcttcttagaccactgtcttgaatcacaggttctaatactgccaactacttcactttctcaaaaatctctttactttcacagtaggcctcttcctgggttactttttttttttttttttttgagacaaagtctagctctatcacccagggtggggtgcagcggtgctatctcagctcactgcaacctccgcctccccagctcaagcaatcctcccacctcagcctccccagtagctctataggcgcgtaccaccacgcctggctaatttttgtattttttgtagagatggggttatgtcatgttgcccatgctggtatcaaactcatgagctcaagagatccacccacctcggcctcccaaagtgctgggattacaggtgtgagccaccgcgccggcctctgggttcctcttaactcaggcaagtccctctctgcctctgtcacagattcctcttcttctgctttccctttatgtcagtggatctcaaattttaaggcacacttaaaaagcacttgaggcagttcaaaaatgtagagtcccaaatcccgccccaagagagcgtaattcattaaccttggatgagtcccaggaacctgtattttttttaacaagcagcccacgtaattttgacacaggcataataactcagctcatatattcagtaacactgccttaaatgatggtgtttcccagcattgtggatttgaccctattaacttccactctaaacctggagtccttaaccacggacctcgcaggattagtaaaatatttcccccctaactatacatacaccctatgtatatgtggcaaacgtgcatttttctggagagagatagccatagcttttatcaccttctaaagattacaaaaaggttagaaatcactcctctacccactcttcctactggatctcaccacatcacagaattaaccacttgctattcacacctccatgacttgtaattctattatcactggcccagaattctctccaactctcatatccaactgtctaatacctttgtctttggatgctccacatgcaccatcaactcaacttgtataaaattaaacacattatctgtagtccaacaactaaatgtgctcctaataccaccagccacgcagtcatctggaaagtctgagttgtcctggactcctccctcttcctcactctcctctccctccctactgcactgacctaatttaggccttcaccacttctcagatgcagtatcttcttagctgacctccctgcctcatccactatctccaayacaccattccctctctctatgatattctctaccagcccatcgcctcagtgtaagatggaaacaacactgatgtacaaggcctgtcatgatctgacgtctgactgcactcccagcgctgtatgttcgaaccatgccccatgactcggtttccccaaaagcctcgttcttctacctccatgatttgaaatgccctgtactacctgcgggacttttaacagggtctctgtggcaccccagtgcctggcacagtgccctcgcctgaaaggcctaatgcttgctgaacggctggcggagtgactgagtgacagggaattccaggagttaggaaaggggcttccggcggtcgcaccgacgcccctcaccagctgccggtcggccacggtcctgtcaggcacaaggctgtacacctggctcctcagcacgatgggcggcagcgcgtcctcaaacaggcctcgcgggaacagctgcatgagttctgagacagccgcgcgcgccgaccctgggcagataaatcggctcacggacagggaactggggcggggacgcggttctaacaaaactctcggctaccggaagcgaggmcccacccccggggttgccatggttacctggctcaccccgaagaggatccgactccacaggccctcgcttccgccgcctcttaactccaaaggtctccgggatcaggtgatgcctcttccagctcatatcccgggattttatggtaccggggaaggggtaggaatggagggaagagaacctgaaaatagggtcttccggcgcagagcagtgacgtacggtctccccgggcgtccctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtgkccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggtaactggattcttgatctgagcgcagacgtccttcctaacctcactgcatttggaggacctggagggagggtgggtgaagggcaaggaaagaggcaggatgagagcttggccgcggtggcgtctgaggggcctgaatgtttcaaggccagagcctggcgatcaggtggctcgcttagtcckaaaccagtcatccttctccaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggtgagcaaagcgtggtaggcagtatatctggagacccgtacctaccctctaaaattaggagagccaaagccggggtgagaatcagtccttagaagaaacaagactattcttcgaggggagcatctcactaatgcttgtgtcagaccttcagcctgtaactcctgcctctcaggggtccaggctggctggcagaggccatagtgacgtggcgggggcacctgacaaaactgctgacgacaycgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcaggtgagttgcccctgcttcatagcccccttccccttcccagaggttgagagcccsccamkcctgctgctgcttctctccttgtgcagacaaacctggaagwwccccagacccctctggggaggttaacaccaacgtggccttctgctctgtgctacgcagccgcctgggaagccaccctctyctcttctcaggggaggtagactgcawagacccccaagccccatccacacagcccccracctgctatgtggagctcaagacctccaaggagatgcahagccctggccaatggaggagtttctacaggttcaggatcggggtgggcagggcgagassttaggcttgaaggctgggaaagggacttggggaggagggtgaaggcagaatggagggtgcacgaggggtcccactgatcccttgcttttcctgtcagacacaagctcctgaaatggtgggctcagtcattcctcccaggggtcccgaatgttgttgctggcttccgtaacccagacggttttgtctcttccctcaagacctttcctaccatgaagatgtttgaatatgtcagggtaagggaacgaygttgcagctcccacccgtatccccaaacaccaasrccacaggtctagcatccagggcaacagcctgccttctctcctcccaccacccccactgcccatcttctgcctcctcctctgcctgctccagaatgaccgtgacggctggaatccctctgtgtgcatgaacttctgtgccgccttccttagctttgcccagagcacggttgtccaggatgaccccaggtgaggcattcagctctgtmcctcccctctggatcccaggatccagcctctggccctcaactgatgcctccatctgccccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaarargttctctcgctgtcttcttagstgagtcatccctgtccagcaactcaagcacacaacagtgctttgctgttttatcatcatgtttttacatggggcattcactgggtgtagaggctggccgcaaatmcgatgtcccgccgtagcaaggtagccgctgtctccatcttggcacccagcacaggctctcctaccaggcgggctgccccccgcagtgagcgacacatctcagccaggcgctgaatgcagcggaccaccaggccctcaggggtccctgagagccctgccaactcggagaagggctgtggggaaagtagggtgaggactggatgcactcagcctgggcaggttctccccagccagccgtctgcaaaatcccaaacctcaggtactcaccatgccccgggcccactcatatacaacctcaaccagcccaaaattcagctcccccacaaattcctccaccgtctggttcagscsacaagccacctggacctcaccaatccgcttggccacagcccggacacgttctattccctgcaggaaagaaggagagrttaaggcctgccttcctgctccaggacagggaaggaccagatcaagaaggcagccattttccatccttggggcacttacagggctggagggggtcacctgggggactacctgaaggtgaaggtcaggaatgccacagccctggcagggagaaaggggtggtgtcccctacctgcttgagggtgtttgggagctgatccccagcgtccccagggctctggcagaccaggccagagagcaaggcagcaatctcctcaggccgcagggtgctcagtgcattgtcaaacatgagctcagtgaggagcaactcatggctgctcatggcacaagccacccgccctgccagcttcacagtgcccrcctcrtccacrtaacccagggttcggagcacctgcaagaaaaagggtgggcattggacacactgctgtcccctagcccccctgccccaaccactgccccacccacctctactcgctgatggtactcaggaagcagcagcaatgactgatccgacagtaggaagcgcagccgctccatctccttctgtatctgcattcgctcccgcagcttcaggtactgcagagagccacccgtcagccttctccttgccccttagcaggggtgcactgaggacaagggctgagatgggggcggtcagtctacaggggaccacagaggaaaagcccctactcccagcttgggagttaccacccagggtcctacctgggcaggaaaacgggggctgtgtacacactgagccccctggatcagctcctccagcttccgggcccggagcccaccctctacaactgacatatctttgagctgcaggtcattgacagggtcgagggtgggaggtccggctgggtgggcctgagccagacgcagcagttcctggacagcagtggtcacggctgcaaggggaggatccttcctgaagagggagcagatcttaagatctggggtaagatcttctctcccccagaagcctccctcaggctgtggaagccctcttactacaacctccacttcacagtctcccttaggctgggggagccccctcactacaaccccaccacttcatggtctccctcaggctggaggaaactcscagaccactgcccctccctgcctctacgtgcccctctggaggagaagggcctccctagcatctctgacttgaattttggctgctgcctcttgctgaagtcctccaagatcttctccccattcacccggagcaccttggtggtgatggcagccatatctcctggctggagcttgaccayggtgtggtcacaaggccctgtgaaaaggggagagcagggcagacattgccatggacccaggcatcctgcttatactgctggcagaaaacagacatctgccacactctcaccttcaggcaggaacagcttgaatcccacgaggtcatctggatagggcacctctgcagtggctggccccctgtyctgtgggtcctgggacaagggcttatcacacaagaccagggttgtgaatactctgctggtggagttcgaggagacctgggggtggtcagagaggccaggagaggggggtgtgatgagtagacatcaaaggcagagaccagatacccacccttgggcaggaatcaggaagcaaccatgcagagctcaccagtagagaggggcaaccaagtcaagcgatcagagcagacttcttggggtggtgggaggaaggagtgagcatgatgtggtgatgggaagggagagggtgaaaaggagggcaagaggggaaaatgagggccctatgatgacgcaacctgccctggccaagtggggaaaatggagagagggcttgctccctcccaccctctggagtccaaattcccatcaccctcacctgtaggatcactcccaatgcgttgtgatgctcctgattcttcacaaccaccacccttcctgctgagagagacttcagcccgttcacagactccatgatgcgtcgctgaagagcaaaggacagatgggaggaggcatcacagggacagacacttggactaagtttagtagcacctagagtaacacgatcttctcttcccttctcctatcacctcctcagcactcacacttgctcacctggatcatgtgctgggtctctgtcagttcctccccccagctgtaatattcaggcaggtcgaccagttggccagtcatgtcaggctcctccaaagctcccagcctcttggtcagttcagccagggcctgttcatgggccttgggtgggagcaggggaagctgtgaaaggggagtctccaggcccaatctgtcacactccccaccctcaacacactggcctctggatgcctacctattcccagcctgtctttggccaacctcctgctccacacactggttaccccaggctccttaccttgctgtctttgcgggagggaaactcagagaagctcctcttcatcatgtcctccaccctgagggcatccactcgcagcaagttgaggatcatagtgtacgtgaggcggaactgggactgcagctgggayggcttcccctggagtcaggycacagaagtcactgagatcagggtgggacctactgaaccccagccagtcttctggactgggcctactcccgtcagatccggtcctagctctgcaaccatggggccttggacaaaccacttgctcacctcttctgtaacataagggagcaaactgaaataaatggactcaaaggccccatctagctccatattcacatgggagaaaactggaagagatgggctccaatctcatccttggattcactcactcctacctcagcttctcccaggcaaaacaaaaaagtcggaggaagttgggcgctgtggcccacacctataatcccagtactttgggaagctgaggcagacagactgcttgagcccagaagttcaagaccaacctgtgcaacatagcaaaacctcatctctacaaagcataaaaaaaaaaaaaaaattagccaggcctgtgtggcatgtgcctggaatcccacctacttgggaggctgaggtgggaggatcccttgagcctggaaggcagaggttgcggtgacccgagattgtgccactgcactccagcctaggtaacagagcaagaccctgtctccaaaaaaaaaaggaagaagaaaaagaagagaggagaatcgaagacagaatccagcaaggtcctggagctggggccctgccgagcatgctggcccgctcaccatcatcatgcggtgcaggtctgccatctcgggcactcggcccttgcagagcaggataacggtgcctgtggggtccaggcccctccgccctgcccggcctgccatctgcacatactccccagggagcaggtcccggaaggtggagccatcgtgtttgcgcatggagtcaaacactactgtacgagcaggcatgtttactcccatggcaaaggtctctgtggcaaacaagacctgggacagaggagaacagaaaggatcagcaaaggctctacatacacacacccccagccctggccaagcccaccttactttgtaggcataaggcaccatcccagttgttacttatgggatctcactgaactctccaggcaaatctatagggcaggtattattgttttcctcattttacttatgtagctacttatttctatttcttaacttttaccttcatatcccattcccatccctgactgcaatcattccaatgtatccaacaaatatctttttatataaatatgatcttatagaacatgtcttcttttgtgagcttgtagtttataattcatataaaaagtggttatatatctgatttttttttgcttctttttctccacctagtgtttcaacatytgtccatgttcctgtggccacatctaacccactgcttccaactgctgcagaacactctatgggtgcatcccccacactaaccttccctctctcccagtgaagggcaccctggtactaccaacaccatgccaccacaaacaaaggatgggtgtacatgttctctcacagaccagggtgagaatttctttgtgatatatacccaggaatgaaatataagctcagagtatgatatagtttttgtttgtttctttgtttgtttttgttttgagatggagtctccctctgttgcccaggctggagtgcagcggtgctatcttggctcactgcaatctctgcctcctgggttcaagcaattctcctgcctcagcctcccaagtagctgggactacaggcacctgccaccatgcccagctaatttttgtatttttagtagagacagggtttcaccatgttggccaggatggtctcgatctcttgaccttgtgatccacccacctcagcctcccaaagtgctgggattacaggtgtgagccaccatgcccggccaatatagttattttgtctaaatagtgccagcgtgcattccaaactggctaggcatcccgtaaaggattcccagaaccctacaacctcctatatctctggcaacactcggcatgaactagtttcctaaattttaccagtctaatagctgtaaagtcgtatcttgtgagtacttcaatttgtatatttctgattactaataacttttcgaatgcttgctagcttcctgggtttcttttctgagacctacgtattcatatcttatgcatccccattttaagatgggaaacctaaagttcaggaaggttaaataattggtccaggatgatactgtgaatacatggtgtacctgggattcaaacccaggtagtctgaatccagagcccagattcttaaccacagcactggcctgcctaaacctctgcccctctgccctctgggcagcccctaagtgggcaacaagcaccctgaggagtccctttccaccaccacatgcaccttgaccaggccacggctgaagagcatctccacgatctccttgaggatgggcaggatgccgctatggtgcacacccaggccgcgattcaggagctctgacatgtgcaggacctttggtgggaggaggcccatggtcagggatggagtctcggaacaccctatccccaccagtctgccaaatgtgtgcatgcacgcacacagacgcacacagacgcacctggggcagctggcggtcagagccacggaggcgagcaaggcagcgctgcaggaagaggtggatctcgctcttctccgaactggtggtgaggtcaagggaggtgaggcctgaggcctgctcatcacagcggccccgggagaaggtgaacaccaccacgggcaactgggcacgtgtgcggagggaggccaggagggacaggtacactccgcggtcctggagaaggaaggggaaggggaaggagcagaggttgagttcctgaaccaatgagaggtgagctagtgttaactggggcagtgctcaaagctcaagtcaaaacc

SEQ ID NO: 1688 - DNA, 40947 bp, Homo sapiens
  misc_feature (1)...(40947): n = A,T,C or G, or insertion/deletion polymorphism (see Tables 1-2)
tagctgtagctcctttgtttccattgctatataatattccattgtgtgactctaccacaatacatcctgttggtggtggtatttggtctgttttcaatttttggctattatgtatatggctactatgagcattgtatgactgtcctgatgcacgaatatgtgcacttctgtaggcacgtatttaggagtgcaattgctggttcatagggtatgtttgtttgactttagtggttttaccaaactgctttacaaaggggagtttgccctctcctagcagtgctcacgttcttcatatatccactaacacttgttagctctagaccttcagagatgactagcaggtgggtgggtggttatagcccccttcatctgtaaaatagctgaaatttaaataaactgtttgataagccttttttttgaatgtatagaatacaaaactattcccttatatatcagcttaatacattttttcatatgtaggctgttgcacttcaggcagccaagctgagtagctggatgtctagccagaaaagcaggggtaggatctaagcctgcctatcctctagcccctcctggtatggtctctgcccctagcttggcctgagccaggttggggtctcccaaaagcagcccctatgttgtggggaagtggagagtagtacagctaagccagaccccattgtgcccgcaggttagagcctggcaatgccgtttgggtgtgtgactctgggygacaagaagaactataaccagccatcggaggtgactgacagatatgatttgggacaggtcatcaagacgtgagtgccgggcctgtcaggcaaggctgggtgggctggtgagcaggggctagggaagtggcagtggagtgcagctgatgctaaggccaggcctgagtgggtgcctgtcggctgcagtgaggagttttgtgaaatcttccgggccaaggacaagacgacaggcaagctgcacacctgcaagaagttccagaagcgggacggccgcaaggtgcggaaagctgccaagaacgagataggcatcctcaagatgtgagtttgaggcctgggattggggcggggtgggaggcagcagggaagggcttagagggcaagtggcctcaggcagtcccagcctctggccaattagtctgctgtggccactgtggtgaccacagcctctcccaggggttcatccagccctaactactggctcccctccctgtcgccagggtgaagcatcccaacatcctacagctggtggatgtgtttgtgacccgcaaggagtactttatcttcctggagctgtgagtgtgggtctggggacccaagattccccagcgcccagggctttcacctgtcccaccctctgcagctaaggaaaccccctttctggacccttggcgtcccaggtccctgtgccttgctcagccagctgcctggcgtaggcagctcacccaagtgctcctgccctacccctgattctgcccacgccaggctcaggggctggtgtccctcagggccacggggagggaggtgtttgactggatcctggaccagggctactactcggagcgagacacaagcaacgtggtacggcaagtcctggaggccgtggcctatttgcactcactcaagatcgtgcacaggaatctcaaggtgagggcagagccagagtcaaagggccagttggcagctgggctggtgctggggtgggcagcacctcagggccttggtctagcctccaaggtcctcatggtgtcttctgctcacccacatgctattctcacaccacagctggagaacctggtttactacaaccggctgaagaactcgaagattgtcatcagtgacttccatctggctaagctagaaaatggcctcatcaaggagccctgtgggacccccgagtatctgggcaagcagggggtggggcaggggcagggggataatggggggcagccttcagggagctgctctgggcagggggaaaatgtgctcatctcaggaagctggtgtggatggtactggacctggctaggcctgatactgaccagcagatgggcgctgtgtttgtagccccagaggtggtaggccggcagcggtatggacgccctgtggactgctgggccattggagtcatcatgtacatcctgtgagtggacagatggacaagcaggcttgcagtcagatggggtgggggcatgtgtctstggcctttctgtgtgacccttcccccatgcaggctttcaggcaayccacctttctatgaggaggtggaagaagatgattatgagaaccatgataagaatctcttccgcaagatcctggctggtgactatgagtttgactctccatattgggatgatatttcgcaggcaggtgaggaggtgcctgcccagcacttggtagaacgcaagggagtggggagggtgtcctgctctcatcttcctctgtggtattctgcttctgtcccccagcccatttatcacctctagacattgagatggggtgcccatgactatcccctycttggttttgtccacagccaaagacctggtcacaaggctgatggaggtggagcaagaccagcggatcactgcagaagaggccatctcccatgagtggtgagcagggtccaggggagggtgggagaggccagggtccccctcacacccagcagccccatctttgaggcctagaaggggtgcaggtacctagagctcagggcagcccagaggctctgcctggtagtccctggatgccacatagaagggctgagcagagtctccacaaaggctcattctctcagatccagacacacttgcaccctttccaggatttctggcaatgctgcttctgataagaacatcaaggatggtgtctgtgcccagattgaaaagaactttgccagggccaagtggaaggtaaggcttggataactcccttcttggctctatcccaagtattgcttctggcactcagtttcttgcctgcatcacacccctgcagccacacacaagcttttctcaggccatcaggtgtgggtgtagccactgtgattaccttaagtaggagtgctgagcagctgagtacttggccctggggtggatggaggtggccgggggtactatggaaggagtttggtttggtcactgccaagcaatggatccagcaagcctcacccttagcctttctccactgtgctcctttcagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcatwactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcctctggccaccctctcgcctttgcttcctctgtcctactggggaggagcccctggaaggcagtggggaagggagaggctgggagcaggttcacaagtagtggctgggagtagtagtgaacagtgccctgtggatttcttgggctgagggtgaagatcatcctcaccacagtgtattcctcaatggtggtggtggtgggggtcctctgaactctagaaatccatgtgagtagtgggtcttgggctgcatttggaccaaggaatactccctgggctgagagctcaagtaagggctgctgtttttgactcctgttgaccgaggagccttactcttgatttaggcatagagctggaatctacctgggccagccagcgcaaggacagaccctgctcatagccaaagatagcttccctgagctagggagagggtgtagggtgagcaatgcacaaagattctatgctgctctgtgttgattccttctttctgtgaacacctgtgctttccacctatgccccaaatgaaatctcactctgggtctatttcagctggagcagatcagctttatattatgggactatgcacagggtttcttctgggtagagggagtaacactgccacagatactaagcctaaaaacccaaaagttgacttactccagcccaggtgggcctgggtgaactcaccagggatgctgctctctgggaggacctcaaagataacctcctcaaagataacttctctgatgtgggaataataaaaaggatttgttagtctctagtctttgaagcatctgggcctccaaaattccaaccctactacagtctcaagcataactgatcctcctgagagctaagagctaaagtcagggtactggccctagtgtctccaaactcaaggatagtcatatcttacttggatgaagccaaggttggcctggggtgacctgagggactggggcctatgtgtccatctttctagaatcgcccggaactgaggactgagagggtagggtattgtggtctatgggaactacagaccatagcgcatggtccatcactgtccagagcccaagggacccatcgggaccattgttctattcccttgcggctgcggttttctctgccttggcccagcctgcctcgcgccagctctggcatgggaccacaatgcgctgccttgccctggaaaagggtccagctggcagcctcgctgctccccgccttgatataatgctgcgctctcaagtggcaggtcgagtctccccagaggacgcctgagagcgaccgcgctccgcccaggattctctacggcctcggggccgctaagccccgcccatagttccgcccatccgagaatttgtccaatccaggcgaagtattcacgctccgcccaargttttgtgttgtcacttccggcccgctccaggaagtcgtgctgcggagccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtggtgagtgactgcagtgttggggcccggtgtttgcccgggtaccgcttcagggccttgaggtgttgggcctccaggcggtccaaccccggaatccagacaagtgatgagaaccttcctcctagacgaggccccacgggagcttcccaacctgggcagaagtgggtcaggacaggctttctggtagaggtgatagctgagctaagcctgagggggactaagatggctcagtgaagatagatgcttccttgatcacctatacaaacagatgtgatttcaaaaccgttagsctgggcaagggtgagctttcaccacatcaacaagtccttttatttcttccagatagaaacctgctaggcttctggctacccaagagagtttgctgtgccttacttgatggtttggaattattctacccagagtcatctcactgtccagacaccccaatgtattcgccatgtcagcaaacccgtttaacatggggaaggcaaggagatgctcccctatccaggggtcctgctgaccgtgtagggccattctgttgagtgtacagctagtggggaaagattcccctagcagatgtggacaggccggtttggacctcctagcaaaagagataaggcagcgttacccctgggaatggtgggtgataataatcacagggtcttgtggggctaaaggccctaggaagcagaaaggcaggcatgacactgatggctgctggcttacttgcaaagctttgtttaggcctgtgttgctgacagcctgagccccatgctgagggagccactgctgtttggttagactagaaattaagctcgcctctaagcgtactctattttctgtttgcctactctattttcttctatccttttactttatttatttatttttaytttattttatttttgagatggagtctcgctcctgtcgtgtaggctggagtgcagtggcgtgatctcggctcactgcaacctccacctcctgagttcaagtgattctccttcctcagcctcccaagtagctgacattacaggcgtgcgccaccacgcccagctaatttttgtgtttttcatagacagggtttctccatgttggccaggctggtctcgaactcctgacttcaggtgatccacccaccttggcctctcaaagtgctagggcctatccttttactttaaacttttctgtgtccttgtgttttacatgtatcccttgaaacagcatttatttctttttttgtatattaaaaagtactttagcttactgcaaagatctttattttattttattttgagacagggtctcactctgttacacaggctgcagtgcagtggtgccatctcggctcactgcagcctctacctcctgggctaaggtgattctcccatcttagcctcccaagtagctgggactacaggcgcctgccaccatgcttgactatttttttttttttgtatttttagtagagatggggtcttgctatgttgcccaggctggtcttgaacccctggactcaagtaatccacccacctctgcctcccaaagtgctaggattacaggtgtgaaccaccgcacccagccttggaaaacaacatttagttggacttttaaaaatccagtctgataatctttgtatttaactggaccatttagtctacttaaaattgttgcaattactgattaaataaagagtaaacatattgtctttagtcgattctgttttgccttgcctattatatcttattgtctcctttcttgccttggtaggaattggttaaatattctgtatttctccatttttccctcagttagttgggtcgttatataccccatttccatttataagtggttatcctagaaattaaggtatgtatccttaacttaccaatttcaaggttaatcarcacctttctcattttcccaggcaactcaaagagcttagaatactaacattcttttcccacttctacgttattgttgaatattttaattgtgtgtatgtgtggtatttttttcgttggtgttatttttgagacagagtcctgctctcttgcccaagctggtctgcagtggtacaatctctgctcactgcagccttgacctcctggactcaagcgatcctcctgcctcagcctcacaactagctgggactacaggtgcatgtcaccatgcccagctaatttttgttttttgtagagacaggatttcgccatgctgcccaggctggtttgaaactcctgtactcaagtgatccaccctccttggcctgccaaagtgctggggtttacaggcatgagccaccacgaccggccaattgtatgtttttaagtaaagtttttgtttggaataatttttttttttttttgaaacaggatcgtgctgtgtcgcccaggctggagtttataattgtttcttcttgcaggattgaactttttttaaatgttcttctttgtccttctttgtctcttgtaactttaattcaaagtctgtcttgcctaattttttttttgagatggagtctcgttctgtggcccagactggagtgcagtggcgcaatcttggctcactgcaacctctgcctcttgggttcacgtgattctcctacctcagcctcccgagtagctgggattacaggcacacaccactgtgcctggctaattttttttgtatttttagtagaggcagagtttcactatgttggccagactggtctcaaactcctgacctcgtgatccgcccacctcggcctcccaaagtgctgggattacaggcgtgagctaccgtgcstggcctatcttgtctaatttaaagtccattttatctgctattagtatagccacttcagctgtcttttggtgactgcatggtatatcttttttcatctgttttattttattttattttattattgtttttagagacaaggtctcgctatgttagccaggctggtctcaaactcctggcctaaagcaatcctcctgccttggccttccaaagtgctgggaatacaggtgtgagccaccacactcggcccttatccaacttctagcttccgttgtagctattgaagtcagattttagtttatcagttactcctttaagcatactttggaactttatcctcagactctcattacctttagaattttctctgattttggctttctgcagttttrgtatagtgtatccaatatgaatttctttttacctttttcttttcttttttttttttttgagacagagtcttgctctgttgcccaggctggagcacagtgggacaatctcaactcactgcaacctccacctccctggttcaagcaattctcctgcctcagcctcccgagtagctgggactaaaggcacgtgtcatcatgcccggctaaattttgtacttgtagcagagacagggtttcaccatgttggccaggctggtctcgaactcctgacctcaggtgatcttcccaccttggtctcccaaagtgccgggattacagccatgagccattgtgcctggccgaatttctttttacaaattctgctcgggattcattagatttctttaacgtgtagagcaatttctttctttctttcttttttttttgagacggagtctcgctgtgtcacccaggctggagtgcagtggcacgatcttggctcactgcaagctctgcctcccgggttcacgccattctcctgcctcagcctcccgagtagctgggactacaggcgcctgccaccatgcccagctaattttttgtatttttagtagagatggggtttcactgtgttagtcaggatggtcttgatctcctgacctcatgatctgcctgcctcggcctcccaaagtgctgggattacaggcgtgagccaccgcgcctggccgtgtggagcaatttctttaatcagttctggaaaattatcagccattatctcttcatatattgcctctattccattaacttttttatcctgtgttattatttatttttgaggtagagtctcgctctgtcacccaggctggagtgcaatggtccgatctcggctcactgcaacctccacctcctgggttcaagcaattctcctgcgtcaacctcccgagtagctgggattacaggcgctcgccaccgtgcctggctaatttttgtatttttagtagagacggggtttcaccatgttggccaggctggtctcgaactcctgacctcaagtgatctgcccctctcagcagattgttgttgttgttgttgttgagacagggtctcactctgttgccaaggctggagtgcaatggcaccaacacagctcactgcagccttgacttgggctcaagcagtcctcccatctcagccttcccagtagcacatgccacagccagctaattttcttttcttcttcttctttttttttttttttttgagacggagtttcgctgttgttaccctggctggagtgcaatggcgtaatctcggctcaccgcaacctccacctcccaggttcaagagattctcctgcctcagcctcccggggtagctgggattacaggcatgcacctggctaattttgtatttttagtagagacggggtttctctgtgttggtcaggctgctctcgaactcccgacctcaagtgatccgcctgcctcggcctccnnnnnnnnnnnnnnnnnnnncccgcctcggcctcccaaagtgctgggattacaggcgtgagccactgcacctggcctacctaaagtctttgtgggcatttcttctggtttgttttcatagtgcttttttttcttgtgtacctgtttacttaaaaaaatgtttttttggctgggcgcggtggctcacaactgtaatcccagcactttgggaggccgaggctggtggatcacgaggtcaggagatcgagaccatcctggctaacatggtgaaaccccgtctttactaaaaatacaaaaaaattagccgggcatggtggcgggcgcctctagtcccagctacttggaaggctgaggcaggagaatcgcttgaactcaggaggtggaggttgcagtgagccgagattgcaccactgcactcccgcctgggtgacagagcgagactcagtcttaaaaaaaaaaaaagtgtttttttggctaggcatgatggctcacccctttaatcccagcactttgggaggtggctggattgcttgagcccaggggtccaagaccagtctgggcaacacagtgacaccccatctctacaaaaaagtgaaaaaaatataaattacctgggcatgatggcctgtgcctgcagtcccaactacttgcaaggctgaggcaggaggatcgcttgagcctgggaggttgaggctgcagtgactcatgattgtgctgctgcactccagcctggatgacagagtgagaccccatttcaaaaaaagaacattttaaaattgaagtataatatagttcagaaaagtacacatattctaagtatatggcttacagaatgtttacaaattgaacatatctatgcagccagaattcagatcaagaaacagggtatggctgggcgtgttgattcacgcctgtgatcccagcactttgggaggctgaggtaggcagattgcttgagcccagaagttctagaacagcctgagcaacatgatgaaatctctactaaaaacacagaaaattagccgagcatagtggcatgtgcctgtggtcccagctacccaggatgctgaggtgatcatcacctgagcctgggaggtagagtcagctgtgagccatgattgctttactgcattccagcctgggtgacagagtgagaccctgtctcgaaagtccccccaccaaaaaaaaaaaagaaaacaggaaaacgcaggctattggccgggcatggtggctcatgcctgtaatcccagcattttgggagtccgaggcgggtggatcaggagtttgagagcagcctggccaacatggtgaaaccctgtctctactaaaaaaatataaaaatgagctgggcatggtggcgtgcacccgtaaccccagctactcgggaggctgaggcaggagaattgcttgaacctgggaggtggaggttgcagtgagccgagatcgtgccactgaactccagcctggctgacagagcaagactctgtctcaaaaaaaaaaaaaaaaaaaaaaaaatgcagactattatcagctctagaaaccttctagaaacctccttatatgctcttccaacccctaccaacacctccctccacctccccatattaagatagctactgtcttgactttgagagcatagatgaattttgcctactttttttttttttgagacagagtctcactatgtccctcacgctggagtgcagtggcgtgatctcggctcactgcaacctccacctcccaggttcaaacgattcttctgccttagtctcccaagtagctgggattacaggcgtgcgccaccacacccggctaatttttctatttttagtagagacggggtttcaccatgttggtcaggctggtctcaaacttctgacctgatgatccacccgcctcgacctcccaaagtgctgggattacagacgtgagccactgggcctggcctgcctacttttaaactctgtgtaaatagaatcatacaaaatataactttttgtatctggcttctcttcctcagtgttatgtttttgtgatttattcataatattgttcttagctgtagactcatttattcttgctgtgtagtattccactgcgcctggttactcttgattatatgttgtacatggtatttgaaaacttatgggaattttagctgggcatggtggtgcacgcctgtggtcccagctactcgggaggctgaggtgggaggattgctcgagcctgggaggcgaaggttgcagtaagccaagatcacaccactgcgctccagcctgggtgacagattgagaccccatctcaaaaaaaaaaaaaaaaaaaaaaaagaaaagaaaagaaaatgtacttataggaatctttgaggccaggatgatggtatcattttccagagaggacttagtttctccctggtccctaggagtaggggagtctactagtaggagactaattaaagtttaaggcttgagctttgctggaccacctgcatagatgatgcaaagctcagctgtgttttgcttttaccactacttacttttttttttgagatggagtctcgctctgtcgcccaggctggagtgtagtggcacaatctcagctcactgcaatctccgcctcccaggttcacaccattctcctgcctcagcctcccgagtagctgggactacaggtgcctgccaccacgtccggctaatgttttgtatttttagtagagatggagtttcaccatgttagtcaggatggtctcaatctcctgaccttgtgatctgcccgcctcggcctcccaaagtgctgggattacaggcgtgagccactgcgcccggccactcttttttttttttaattaaaaaaatttttttgattgggcacagtggcttataccaatagttccagcactttgggaggctgaggtgggaggagcacttaagctcaggagttgagaccagcttgggcagcacagtgagaccctgcctctattctgtaaaaaacaaaaaaacaaaaaatttaatttaaaaaaattttatggctgggtatggtggctcatacctgtaatcccagcactttgggaggctgaggcaggtggatcacttgaggtcaggagttcaagaccagcctggccaacatggtgaaaccctgtctctactaaaaacaaaaattagctgggcgtggtcgcgcatgcctgtaatcccagctacctgggaggctgaggtaggagaatcgtttgaaccaaggaggcggagtttgcagtgaaccaagatcgtgccactgcactccagcctgggcgacagagcaagactccacctcaaaaaaaaaaaaaaagttatgagtacatagtaggtatacatatttattgggtttatgagatattttgatgcagggatacactgtaataatcacttcagggtaaacagagtagccatcacctcaagcatttatcatttttttgtgttacaaacattcctattcttttagttactttaaaatgtacagtagattattgttgactgtagtcactctgttgtgctatcaaatactagattttattccttatatctaactttatttttgtacccttacttacttttatttctggttgatccttaccttgaaagtgtagtctttgggattccagcttaaaatgggggtgttatcagagtcctyatctctgagggcccctgagcttcgactatcatctctcccaaccccagtcaaagcccagaatgttgcctaaaggacagcttttggccaagccaacagggccaaaaaaagggccagctggttggagtcctgagtacccatcaggccttgcgggaggtgctgtaactgcctatgctactgtcctcttatttgggcaggcattgggtcaaggaggagcagaacagaccctttcgtggtcagaatgtttgcctggcttatgtccccagacaaaccagggctcatcagtctattgttctgcttttcattccagcctaattcagtggtttgagacagcaccaagtcggacctgcccacagtgccgaatccaggtgagagtattggggtgggaccacctcaactgaagagatctccttagcagagagcaggaatgtgaaaagagctctgaaactgcaatatctctgaccttttttggaccctcctggtttaaggccagttgagcctcacttgtgcccttgagtgtttgggaggtctgcttacacccacaggtagctggcagatggacttgttgcctgggccagttttcacttgggtagatttggctggcctccttccctgtcttttcatcagtgactccgcacctagagttcaggtatcttttgagcacttaaccgtgtaggtctgtagtaatatgacttcagtgaccacgaaaccagcagccccaacttggggtacctgcaggagtaaagaggkcttttgactctaaaggatgtactttgaaaaattaggtctgagaacaggcctgacatgcatgtcaggcaggtagtcagacccatgtacaacactctyctccttgcgcatgacccagctacacaatcatactcttaccttgttctcccatccaggttggcaaaagaaccattatcaataagctcttctttgatcttgcccaggaggaggagaatgtcttggatgcagaattcttaaaggtacccagaatttatctgattctactgaactccaagccttgtgcragttcacttttcttttttcttttcttttcttttttctcttctcttctcttctcttctcttttctcttttcttttcttttcttttcttttctttttttagagacagggtcttactttgttgcccacactggagtgcagtggtgcaatcatagctcactataacctcaaactcctgagttcaagggatctccccacctcagcctacctagtagctaggactgtaggggtgcaccaccatgctcggktaatttttttattttatttatttatttatttatttatttatttatttatttattttgagatgaagtctcactctgtcacccaggctggagtgtagtggcgtgatcttggctcactgcaacctctgcctcctaggttaaaacaattctcctgcttcagcctcccgagtagctgggactacaggcacgtgccaccatacccggctagttttgtgtttttagtacagacggggtttcaccttgttggccaggctggtctcgaactcctgacctgaagtgatccacccacctcggcctcccaaagtgctgagattgcaggcgtgggccaccgtgcccagccctaatttataaaaaaaaatttttatagagatagggccttgctatgttacccaggctggtcttgaactcttaggctcgagcaatcctcccaccttggcctcccaaagggctgagattacaggcatgagccactgtgcctggcctgggagttcactttctatttccacataagtggagggttcctggaatatggagatgaagttatagaggtgagacttggtacagttttcaaggtggggacacaaaaatcagaggacaactgatgagacacagtcatcagagaaatgcactgtgagggaagaggggagctgcttgactgtaaaccctccctttgggatttcaggtcaattccaacctgaattctctcctgcggtcttgtctcctcatcttttaaagaacctacagccatcctgtacagcctactttgctgcttggacagttagtgacagattagaaaactcttctactccccagccacgggagatttttggattcagtgttccctagcctgcctgtgcctcaaaattgcctggggaggctgggcgtgatggctcacacctgtaatcccagcactttgggtgaccaaggtgggcagatcacttgagcccaggagttcaagaccagcctgagcaacatgggaccccatctctattaaataaaaaaagttaaaagaaaaaaaattgcctagggagcttggtataaagtcagatgcctgggccttccccagaccagagctcttggaatcaagagttgcagctcaggtgggaatggatatattaggggaaagtgggtagtttccctcctatacgtctaactgcttcccctcctaatctaaaatttagctttttttgtgtgcaagcaggctgcgttggcagagaactcttgaggaagttggatttgggttcacaaatgatccctggactctgagggttaatttgctggatatctgtcagatcagagttcatttggctctggccccagggtgtcatgatgtccttggaacctcactgcttcaggaacatggagcttttgtgcttagagcaagcatgttcatcgtcatggtaactgctcccagttttaagtagtgtcttccctgtgatgaaggcaacaaaggcagtttcatttatttccagctttcaaagccaggtttgtgagacaggtagcaacatcttgggtagtttggagcaagggcttggaagcccctgctggagtgtggaagaagtcaggggactatgggtagtggtgcagcagccatgtcctggtatctgttctcaggcagcccttgcgtgctcttccttacccaccacctccactcccagctgttcagcctatgctaaccagcccagccaccagaagctcttgcccccagagtcctaggtggagagtttgacagtaggggcttgtttacccactgggcctgggccatactattggtcacatgtgaaattctgagtcttctgttgatcttagacaagtgatctacagtaaggtttgcctggattccatctagctaccaccatggacccttggtcaagcgtttcagttttgtaaaaccttggatttctttgttatggagcaggcacctctcttgctcatggggatgttgagttctgtggcatcctgaacaggaactgggttcaattctgccacagcttctcaatgattctgtggcatggctgtgaaacatttgcaggggctttgagaggctcacttgatcctcacaatagtctagttagagactagacacatgggaggtttcatccaggggtacaaagctgtcctggcatagctacctccattggatactaggtctggaaggtttgtggtacacagagccagttcagagcttggaggaaagtcgactatgaatcaggaagacccagggtggagaggaggagtagtcgcccaaggtccttggccattcctattgtgtgtccctggtgagtcagctgatgcccagagggaatgagaccaacatagagcratgaggccaaggaagtgatagaaacttctgctatggagactgatcacaggggccctactttaacttcccttccactattctacctctttacctgtcctggggccttgcccctgagattgttttcctccatcttacctacttttcaaaagggcacatagagctacagcagtgcttatctttccattgttagcttagcttggccttgaggcactgcaggattcatgccctagaaggcctcattgttcaatcctggggctccccacagccttatgggagaccacgtggaggtcagctatgatgctttcctgctgcttattgtgggtattgcctttcagaatgaactggacaatgtcagagcccagctttcccagaaaggtgagttagcaagagacgaggggtgctgggaagcccctgacttggatgctggaggaagggggccctaggaggaaggtttcaaaccgtttgggagagccagggcctttccctgctttgtatgtccaagagtcctgctagctgttgtggtgggcagaaaaagagagggaagggaggtgactgaagctgttcacctagaccaggtgagcctcttgtctctgagtgcagcttcttgcccaggaaccaagatgggagggggttrcctgatgggactgaatatcttcgggagagggctcagctgctgagtttggctggaacctgcttgagtcctgggttgatgaactaactggacccatggcaggtagggaatgggcagtaaaatattttcctaagtagttcaagcagcagaaggtgggcttttccctgaatgaaggctctggctcagcttctctggtttggcacatcccagagaaagaagcgggccacccagctttcaggcctgagccttgtttctcacctgcctaagggatgaggcactgaatccaagggcccaagttcttctgctgatggatggacaggcctttccctttcctccgccctctacccctgctccagacaaggagaaacgagacagccaggtcatcatcgacactctgcgggatacgctggaagaacgcaatgctactgtggtatctctgcagcaggccttgggcaaggccgagatgctgtgctccacactgaaagtaggtcctcaggttttatgggtacagaattcatagggaggtattgccccagaactggactccccattctgggcttatcttctggttctgctccagtcawcaccttggtttggggagttgtaaaatagaggcaaatcacttcttccccttgcccttccatactgtacccatccatcccataagaaaagggccatattggctatacttgtgggttttgtactaggtagtttgaagagtcaaggccttcccagtacctcacagaggggatgctcaactaagacctcagtgagrctgggccatatttccgaaagtggttcatactctactgatgaggccagcctgaagaaccttccattagcactctagtccttggctgggctgctctcctgagccagatcaaacagcatcctagggaggagcaagggcctttgaagtcagctgtgctgagctgaccaaccagatcaaagtctgcagagtgaacagccttagacccagatgaattttgcatcagcctgggttggtgagcctcttgctctccaaggggcatgagaggcgattgatctgaacccacgattgatattctggccttgtaggcaggagcagtccttgctggatgccatttgaaagggaaagggagccatccttgtgaacagacaaggccccaggatattcattgtctctgttcctgcttgggggctgggctggatcacatggtctggctggtgggagggagcaaactggcacctggctgcagagcaggagtctctcatggtattctcaggtcagagacaagtggtcttaggctgaaggcagcctggccagcttcccctggctcaattattcattcttggcaactgtccatgggtctgggtgttggatggtgaggcctgggtttgtgctctggacttcttcagccacctgcacaacatgtaccatgaggcccagaccactggaccttggcagcccacagtgggcctgtaaatgctggcagtgggctgtgtctactgtaagatacctttcaggaggaagcaggcagggaggtgaagaagcagctggcttagagccttttagaagaagaagcacaagcgagagtgggacccaggagctttacctcctggggtttgggagtacatggttatcagcattttcaaaacataagctgcagagagttctggagcagagttttcctagtgactttagcaatggctcctgagggcctccaagcatcaggtatgggtgtatttgctcttcagaagcagatgaagtacttagagcagcagcaggatgagaccaaacaagcacaagaggaggcccgccggctcaggagcaagatgaagaccatggagcagtgagtttggagctgggtcctgcactgtgcctttgcccccagggcctgcaagtggtacagttcttaggactgcagcagggagtgggattgggtcatgtccgaggctcaaatctccataggccatggagggctcaggtcagctgggtgtgggcacagatcttagcctctatgaactcttcccccattccaaggaatgggagcccttgccacattcctccctgtctctgctgcctgtggccagatgacctggtgggtctttccttccagaaacctctctccaggaaatccctgaccttgagaccctctttcagcacctcttctttctcagcagcatccttggagctatgctcatctctgccacagggcctttccttgggcacacccacctactaaagcatcctggcagcctagcctgttaccttagcaacggcagcaaaggaaggcagagcggcactgggtacctacccatcagcctccagattgcaaatgccgtgggctgggtgtatttttcaggattgagcttctactccagagccagcgccctgaggtggaggagatgatccgagacatgggtgtgggacagtcagcggtggaacagctggctgtgtactgtgtgtctctcaagaagtgcgtactgtggcccctctcagcaaacacaggagataggccatggggccccagccrtgtcattgctccccatctcttgtaaagcagatggaactaaggggcaaactctggagccatgctgcctttgtttgaaccctgattccacctttcagcaactatgtggcctgctgccagtttcttggcctctttgaccctcaacttcctgaatggaaatagtagtagacctgcctcataggattgttgaggatttagtgtgaatcttaagygctgtttctaagggagttgacctagctctctgggctataagccccattgtgattgatatgtagagcctgttccccattagcactatgatcctgcctggctgggatcaaactctactcatattcttcactctggtgggtgtaaggttggcaggaagggtggagggccacttagctgagaggcatagagggtccaagatgcctcctttaagaccaggtggtttagggagccccctagtgagactggggctttctgcatgccctctcaagtcaccagtgcctgcaggacaggcaggaggaaatagtcacttccttgcattctctgcaggaccctccacagtgcyacctggtacttgttgggctcaggtgtcaaagtaggaatgagagtgagttgaggggttgggcrgtgctttgtgttagattagtgctgtggctcagtctgacctgcaggtgttcttttctggcatctctttccatggccacattgcagagagtacgagaatctaaaagaggcacggaaggcctcaggggaggtggctgacaagctgaggaaggatttgttttcctccagaagcaaggtaacttagcagtgaacagaggytgaaggagaagtggctctccttttgtcatgttcactctggtctcctgagcaaggccatgggacctgatggcacagctgactccctggggcagctggaggacttacagaaatttgttaccagtccttactgsgcattggcctgaatatgtggcttgtccactaggggtggacagatcacagaggtatcccccaacatgtggacactgatgctcccctctgctcttcctggctcctgggtacctctcagctggctggagagcacaggcctcaaatgtgacagcrtcagaggcctatttttgtaccacatctggagtagragggctcctggaacctgattcggtcagcacagctgcttttacttctggcatggtgcatccacaggctgcaggatgtaggaagcagcctttgcttctaggcagctccggatgtgcattgccagactgaggcctagcctcagagagctgggatctctgcccatatctctagtctcttctgggctaccttgatcactccctggggagcagcaggagggggcagggcacaaggctaccacttggcttgtctttcattccctacactttcttatagttgcagacagtctactctgaattggatcaggccaagttagaactgaagtcagcccagaaggacttacagagtgctgacaaggaaatcatggtgagggacatccctggcttgacaggaatgaggggtggtttgtgtgccctcccagagcagggctgggctatctctgcccaggacccttgcaccagtcagtggtggttctgggcccctgcatcctcctgggtcagggtgtgccccttggccctggtccggactggagcctgggcctcctcaacagagggcagacagaaccatgagtcttccctcatagtctgtcctgcacttacatccctgaggtcccttatcagaggaggggctctacctggggcttggcctcctgagcctaatgatgaggtatcaggccttgctctgttcccagtgggctggcctttcatgcatgctgctcatgtcctctgcattatctcyggacttgatgcctcagcctttctctcacacacttttctttccctccccaagagcctgaaaaagaagctaacgatgctgcaggaaaccttgaacctgccaccagtggccagtgagactgtcgaccgcctggttttagagaggtttgttgagccttgggcggtacaggggtcacaaggtgggagagctttctggtaacagtctttactcctcctggctttggtggggtgggtgacctctgtggacctgatgtctgcagacagcctgccctgggagccagccaagatttagctggcaagcagccttgaagcaaattaggctctgacacggagaggccagagaaggccagaggacctagaagtggtctgagaatagggcagaagcactgactgtcttggggcatcctgtttatggagtagctccccacatttatctgtccaccccagattttgaaacaaatatgaaaccactgtaaaataattcccttagtgccaggagtgcgtgctttaaagctgccagcagagggagccacgaggcagaaggattggtgtccctgcaagcatgggcatccatttctgctcctgagagtttcacagaagcagactagctgagagcatcctcaaggctacctcctgcctgccaaaagtccccagcaaggacccagacagaaagcacacaactcctgtcagtggccccagtcttttttttttttttcctttttctttttttaatggagtcttactctgttgccaggctggagtgcagtggcactatctcggctcactgcaatctctgcctcctggattcaaacaattctcctgcctcagcctcctgagtagctgggattacaggcgcgcaccaccacgcctggctaattttttgtattttagtagagacggggtttcaccatgttggccaggatggtctcgatctcctgacctcgtgagccacctgcctcggcctcccaatgtgctgggattacaggcgtgagccactgcgcccagcccagtctttaatcttttttttttttagatggagtctcactctgtttcccagactggagtacagtggtgcgatctcggctcactgcaacctccgcctcccaggttcaagcgattctcctgcctcaacctcctgagtagctgggattacaggcatgtgtcaccatgcccagctaatttttgtatgttttggcagagacgggtttcaccatgttggccaggctggtcttgaactcctgacctcaagcaatctgcccacttgggcctcccaaagtgctgggattacaggtgtgagccaccgtgcctggttgcttttgtttactttctttacctcttcagggtgctggaaggcctggactcctacagcaggtccttgatgagtgcccactgcatggcagaccttctctgttctcttggagcttatgttccagtgggatagatgagcttggagcttagatggctaagcccacagccaaccagctatatactacattatagaatctggtctgtagctcccagttggggacgggcccacctcattctgagtaagcttcatgccagggcctgcagcccatcttggtacagggaggacagcaatggtctcccttggctttcaggccagcaggacactaaacttgacaagccttcttctgtaagctgggctgggcttctcatcaagccacatgaggatgacttcattcatttttgtctccagtatttttctgggcataaatattgaagtggttggctgggtgcattgactcatacctgtaatctcagtgctttgggaggccaaggtgggaggattgcttgagtccaggagttcaagaccagcctgggcaacatagtgagaccctgtatcaaaaaacttaaaacttagccaagcatggtggcacacacttgtagttctagttactcaggaggccaaggcaggaggatcacttgagcccaagagtcgagctatgattgtgccactgcactccagcctgggagacagagtaagaccccgtctctcttggaaaaaaaaaaaaagtccgggcgtggtggctcacacctgtagccccagcactttgggaggctgaggtgagtggatcacctgaggtcaggagttcgagaccagcctgaccaatatggtgaaaccccgtctctactaaaaatagaaaaattagctgggtgtggtggcaggcgcctgtaatcccagttacttgagaggttgaggcaggacaatcgcttgaccctgggaggtagaggttgcagtgagccgagatcgtgccactgcactccagcctgggtgacagagagactccgtctcaagcaaaaacaaaaaaaaattacggtggcaggtctgtttgtttttagcaaaagcccttcttttaactaggcattaggcagcaccagcacagtctattcttgtgtttgtttgttggtttgtttgttggtttgtttgttttgagatagggcctcattctgttgcccaggctggagtgcagtggygygatcacagctcactgcagcctcaacctcctgggctcaggtgatgtgatcctgcctcagcctcctgggtagctgggactaaagtgctgggattacgagcgtgagccaccatgcccagcctaggcacagcctcttctaaactcatagcctcaaactctcaaaaatagttgttgaatcctcagcaacggcattgccctgtcttctttgtgttctgatggcaagaccctcagaactacaagtgacctcaaagactctgcctctacctttctcctgtgactgctaatgtgttactacagaggtctggaagaagtcttaagttttcttgggccacctactcgggaggctgaggtgagaggatcacttgagcctgggaggtcaagactgcagtaagtgatgatcacgccactgcactctagtctgggcgacagagtgagacctgtctcaaaaaaaaaaaaaaaaaaaaaaagtcatgtcaaggaagatggaagagtagaaagctccaggaatccatctctccatggcaacagttgatctggttgaaaccatctgaagcaaccactttggaaatctggtctagtagaacatttccagtatccaggggagagggtgatgaagaagctggtaaacttcagtaaattttcactgttctcatagcagctccacctcctgggctcaagtggtcctcctgcctcaatctcctgagtggctgggattgactacaggcatgcaccaccacgcccaactaattttttgtagaggcagggtctcacttattgtccaggctggtcttgaactcctggcctcaagcgatcctcctgcctgggcttcccaaagtgctgggttacaggcgtgagccaccgctttgctttgctttgctttgctttgctttttctttttctttttccttttcttttcttttcttttttttgaaacagtgtcttgctctgttgcctaggctggagtacagtggtgcaatcttggctcgctgcaacctccgcttcccggttgaagagattctcctgcctcaacctccccagtagctgggattataggcacgcaccaccatgcccagctagttttttgtatttttagtagagatggggcttcaccatgttggccaggctggtctttaattcctgatctcaagtgatcttcccacctcggcctcccaaagtgctgggattataggtgtgagccaccacacccagccaccaccatttcttaatttaaaattaggaaaattaataaatctctggctggatatggtggctgtactaaaaatacaaaaattagccaggtgtggtggtacacgcctataatcccagctacttgggaggctgatgcacaagaatggcttgaatctgggaggtggaggttgcagtgagccagaatcgtgctactgtactccagcctggatgacagagcgagactgtcgcaaaaacaaaaacaaaaaaaaattaagaatttttttttttttttttgagatggagtcttgctctgtagcccaggctggagtgcagtggcacgatctcggctcacttcaagctccgcctccccggttcacgctattctcctgcctcagcctcccgagtagctgggactacaggtgcccgccaccacgcccggctaattttttgtatttttagtagagacagggtttcaccrtgttagccaggatggtctccatctcctgaccttgtgatccacccacctcggcctcccaaagtgctgggattacaggtgtgcgccaccgtgcccggccaagaagtttcttaagttttttaagaagcttcttaatttttataactttttactgcagcagtattttttattgtagtaaaatataaacaaaactcaccattgtaaccatttttaagtacatttctgtggcatcaagtacatttaattgctgtgcaaccatcaccaccatcccactccagaatgttttcatcttcccaaagtgaaattctatacccattaaacaataactcccctttcccctttctcctcagctccttcacttaccattctttctgtctctatcaatttgactactttaggagcctcatataagtggactcatacaatatttgtccttttattactggcttatttcacttagcataatgtcttcaaggtttatccatgtagcatgtattagaattttcttcctttttagggctgaatcagtaatcatatttaatttttttttgagacagggtcttgctctgttgcccaggctggagtgcagtggcacgatctcggctcactgcaacctccaccccctgggttcaagggatcctcccacctcagccttccaagtagctgagattacaggcatgtgccacaatgcccagttaatttatttaattttattttttgtagagatagagtcttaatatgttgcccaggtcagtattgaactcctggcctcaagccatcctcccacctcagcctcccaaattgttggtattacaggcgtgagctactgtgcctggcagtattcatgttttaaatttgcaagcattctttcttgctctttgagtatgtctgttttgcaaagcatcatgttcttgttttatggtctcatatttctgtttgtctcagagtcagtatttgtgcaccatggactttttcctgggctcccctcccatacctggtggtccttggctactttggaggccaacctatgtgggtagggtttgggggggatgtgcagactgctggcatcatgttgagtcttacctgaacccaggatgcagaaggctttactgttgggtccaataatattggctgccctaggtcattgtacatagtttgtttagtgtctttgagaaaagctcttctatttattggcccagggcagcagcctaactgcctagtgttctaccaatgcagattaggatggggtggagccaagctcacaatttcatcagtgttccagttttcaggcctgtttaatgcttttgcaaggccctccctttccttcatggaccccctccttgtgggttctggctgctgtgtcagtctcttgtcccctggccatgctttgtctcccagaattttttggaaatctctgggggctgatggtggttgccccttctacttgttgcagtaggattacccttcatacctgtcattttagggaggcatcagcatgtagccaccacccccaactacagagtcaatgttaggaagatctctctcatggrccccaagggcccctgaactccaggctagagacagccagggagacctttccttagggtagggtaaggccgccaggagccatgagttcatggaggagatgttgactaatcccatgccacgcaggcaatgggctgctcaaggccttagctctgttctggaaaggggagctttgagtgtcttgcctggctccctgaggcctctggcatgaagccctgtaacttgaccatgggtgggtgtcccaagggtgatagtgtcactcaggagggcctcaagccagcctcaaccagtgagggaaggactactaagccctaggttctttctccttgtaggacaaacagaaagtgggaaggaaagaaagtggacccctggcagaaagggaaataggcttcaagctcatgaaggaagaagaatatagaaacagtctaagacaaggccgggcgcggtggctcatgcctgtaataccagcactttgggaggccgaggtgggcagatcacgaggtcaggagagcgagaccatcctggctaacacggtgtaaccccatctctactaaaaatacaaaaaattagctgggcgtggtggcgggcgcctgtagccccagctactcaggaggctgaggcaggagaatggcttgaacccggaaggcggagcttgcagtgagccgagatcgcaccactgcactccagcctgggtgacagagcaagattccgtctcaaaaaaaaaaaaaagaaacagtctaagagaggaagaaatgtgtccatatgatccagatgtggatatggggagtgagggaggcaccgtgagaacctcctgagtcttgagtttagtgttgtggatgaccaggaggtgcaagtgaataagcctggcttgccttgagcttgggcaccactaggcaacgccttaggggatggctgggagtagaaagtcctgccttgagccacctggagggtaaaatttacaggacccagcgagatcctgccttcctcttgagtttacctttcctaacctgagcctcaacttgctggggttggtaaatggtggcagaatatggatactgcaaaaaagttggcatgagtggtcctggctgctgtggttcccagaggaggaagcaaagcagccagcctagagttggtttgaggtgggtttgtgcagtcttcattttaacttgcaggcggggacagaggtagagcttctagggtcctggacagggaaaggaagaaatagtccaggctgcctggattgcttagccacccaaatcaatgcaggtaggcttcctccctctgatgtgtacaccccagtggaagtgggattgtggtgcagctctgaaaagttcctgaggaaggaaagagagaaggcatctttggagctacccttgccattccccagggttctccttgtatgacaggaggtggggagccctgccaggtctgggtgggctggaagaatcctgtcggctgtagttttaatagaataaaacttcactccccacccccccccccccccccccccccccgtgttataaaagtaaaaacacactcattgagaatttggaaaatagggagttatcatagaggtacttatggttgacatgtggaatatttccttctcctttttctgcatgtgggagtggtgggggggtgccaaatcatgtaattgcactatacatggagttttgtgtgctttttaaattaaattaaatttaaacttttttttttttttttttctgagacggagtcttgctctgtcgcccaggctggagtgcagtggcgcgatctcggctcaccgcaagctctgcctcccgagttcaagcaattctcctgcctcagcctcccgagtagctgggactacagacacaagccaccacacccagctaatttttgtatttttagtaggatggggtttcaccatgttagcccgggtggtcttgatctcttgaccgcttgatccacccgccttggcctcccaaagtgctgggattacaggcgtgagccactgtgcctggccgagagtagggctytcttgaggggtggccttgagtcaggagtgggctccaggtccctggagctgagttatctctgatgcttcaggagctgttgtcctgggttaccactgtggccccaagtaaccaggtcatctctgccttcagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacagtgagtgatagtcgctggcactgtccatgggctggtagggggatagctaagacagctctgcaggccctgtgctgttagctctgagtggctgatggggcagtgagggttgcctaggcttggccatggctttggttccagctacctcttgttccctcacctgagcactcaatctgtgcaaaccccttctcttktctcattattcctcaccatcacctttcaaggcaaacgtattggaatgcaagttagagagaatgcagtgatgccagaaggggtgggtctgggctggagagggtgctcccaataccttgaaggcctgcccaccagagtcctgagcgagggactctgaacttcctcttctatgtttgcctctgaggctcatgcctgagggaggatcatctcaaaccacagagcccaaggccttaccacccaagggggtgacccacaggggcaagcatgagaagctgtctggaatwccagtggggcaggtggaacctgctctggggtacrgtgggaccagaaaaagggaggctgtctccttggccaggtttgccaagtgtaattcactgtggagacaaggactatactcattcatacaggtactgttcaggtgaggctggtcaagggctgggcaggtttcctctttttcaaagactttgtacagagagaaagaagagaaagagaaagaaactgagatgctagacagtggaggtggaagggagcaagagggcaagccagctgggctgtcctacctcccaaacctcagggggcatgggcacccctgttgtagagggcgaggcctggtagcaatgagaaacaaacctaggacccrtgggctgtagtcctcagggatcctgtcagtgtctgctgtgtactctggcttcctcccattgcccytcttccgctgtaaaggttgaaggtggacacctggggtcttcaggctgccaggcctttcagagacatttccaccaccttcatggcctgtggaggtagtgaaggaggtagtgaagttctgagtccctaactcagctcgtccttcctggagccttggttgtcatgtagccttaccacaggccgttagggcaggagcagaggagtcagtcatcaggccctgatcccactcttgtccttatggcttgagaagccacagggccagccttagatcaccatcttctcacccaccagggaaaatgccaggagagggtatccagctgctgggttccccaggaattggatggaaatacagtttctggctctggggctgggattgggagaccagggcctggggccatgcgctattctgccccaggcccttcttagacacactctctagggagatggcttggccctgtgttctgagaggattttgtgggctactttactgaaaggctaacttactgaggctctcgtggaggtagtgtcccctctctgggaagacaggactaggcctgagctcattaaatttcttttgctcgtatcagggcatgactggctttcctcccgtgggtggtgagttgattgggctcttcagccccatatagagcctgggacatggtgaggtgcccgaggacttgaggagcgttggaatttggccttgagtggaagccacaggattgggacatggtccagtcatccccagtcatccctgtctctgccaccctactggctgtggctgtccagctgttaacagacctgcacttggggtgggatcactgaggtgccttgcccagaatgcaggcatggcagcagcagtgccacatggtaactccccaaggggcgtgtgctgagcctggttcacctgcccccatgtcttgcttacctaccccttgccttctctctcattcttgtagctccccaattcaggatgtccccaagaagatatgcaaaggccccaggaaggtaagagctttctagaagaagcacagtctaacctttggcaggactggacttttgggagggcacggtcttgccagagccttgtcaytcctggtccaggactgaggtacttcggagccacccttgggattctactcattatccctcctgcctcctagtgaggcatcagagatcctgatcttgttccaccaccactaccctccctcctttgctgacatccagctcatcaagtctggccctggggtcttccctgcaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtgagtgtggcttcccacagtggcaggagccagccctcttgggtagaaatgggtggccagccccccagcccattagcctggcccactcatctcttccttccaccctaggtaaggacaggcttcgatgggctcggtggccggacaaaattcatccagcctgtatccttttcctgtgatgttgagctgagctgaactgtggagcccatactatgcctcacctatacccccagcctgccagtgccaacagcctcaggtgtgcagtgctgggcctcattctgtgtatcagcgccgcccacccccggctctgagcctttcttgccctgcattgcagtcctttctcgccctgcattgcagtcctttctccatgcctcttccttgacagctcctccagactgacacagtcatgatccgcccattgcctgttaagcccaagaccaaggttaagcagagggtgagggtgaagacmgtgccttctctcttccaggccaagctggacaccttcctgtggtcgtgagaacagtgagtctgaccaatggccagacacatgcctgcaacttgtaggtcaaggactgtccaggcaggggttttgtggacagagcccyactttcgggaccagcctgaggtgtaagggcagacaaacaggtgagggtgagtgtgrcacccagagactgctcttcctgccctcaccctgccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaaaaaaaacaatctcttcttcctggttctgagagtgtaaatttgcaccaacactttagaaaactgtttggcatgactttctaaagcaggaacatcgccaagcctcagatccagcagttccttccctaggcatatgccttgctgcatggggcacaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctttttgcaacagggtctccctctgtctcccaggctggagtgcagtggcacaatcacagttcactgcagcctcaacctcccaggctcaggtgatcctcccacctcagcctcctgagtagctgggactgcaggtacatgccaccacgcctggctaatttttttatttttattttttgtagagacaaggtcctgctatgttgcccaggctggtctcaaactcctgagctcaagcgatcctcctgccttggcctcccaaagtgctggaattataggtgtgagccaccacgcgcagccaacggcactttcttctaaagtgcttcccttcttgacccccagcctgggtgaagtcccctaaatttccctctcccactattaggtaggagttcacctgtttttccaggacccagcatgggcctggcacggggagtaagakgcacagggagtgagtgagtgctgcagtggaggttgcccagctgatctctagcatatctggaggagtatggggctttgtggcaaggaggtgccattcttggttatgagttttggcccctctgcagctgacttgagccaaggaagtttagtgatgcaaagcgaagcatcaggttaagagtgtaggggctggctgctagcaccatccttaccagctgagtgatcttaggtaaattacctggcctctctgtgctcagcttcttttttttttttttgagacatagtctcagtctgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggtgaaaccccatctctccaaaaattcaaaaattagctgggcatggtggtgtgcacctgtagtcccagctacttgggaggctgagatgggaaggtcacatgaccctaggaggcaaaggttgcagtgagccgagatcattccactgcactccagcctgggcgacagagcaagactcccaaaaataaaaataaagtggggatctgtgttgcgtataggttaagaacttatggcagctaggtgaaataagccagacacaaaaagacaactattgtatgattccacgtacatgaggtgtctagaacaggcaagttcacagagacagaatagaagttagcatgggatagagggagggggcaggggaattattgcttgatggtcacagagtttctgtctagggtgatgcaaaagttttggaaatagataggtgtgatgattaccaaaaaatgaacttgtgacctgaatacatggatatcttgtgttcatggattggaagactttaaagatggcaataacccccaaagcattctacaattcaatacaatccctatcaaaattccaatggccttttttttttttgcagaaatttgaaaactgattctcaaatttatatggaattgcaagaggctctgaatagccaaaacattttttaaaattgttttaaagaaaagataaaagttgttcccaatttaaaaacttaactacaaagctatagtaatcaaaagagtgtggagcgaaggcatgcataatggtggaattggaagctctaggggttggttcctgaatcaaagcaaccattgagctgaaaagagcagtgattgtaatcaactgtttcagaacccggaaatttaacaagggggttgcttgatgaagagagtagtgtgaatcaagcagctacttctcccattcctcagccccatccggctgtggggatagcagcaccagttctgaaagcagctgactggtgccagaacaggcacgggaaccttgccctccaaaaatgctggggttgtgcgctttgacggacctggaggtactctgagatgcttgccttggtttcattcagcctcttagatgcaattcctgcattaataccccacccaaccccaccttggcaacatatcagaagatttaaaggactcgtgcctttttttgtttgttttttaagccagaaaatctttgtcagctcactcactggctgactacagagataatagaggcccggcacagtggctcacactgtgggaggctgaggcaggaggaatacttgaacctaggagtttgagaccagcttgagcaaaatagtgggaccctggctccacagaaaattttaaaaattagccaggtgtggtggtgcatgcctgcagactcccagctactagggagtctgaggtaggagaattgcttgattccaggagttggagactgcagtaagcagtgattacaccactgcagttcagccggggcaacagagtgagaccctgtctcataaataaataaaaaattaggttgctgcaaaataaaatattagattggtgcaaaagtaattgtggtttttaccattactttataagagataacaaacttcagtgaccacacacacacaagagacacacactttgcataaatagtttggaaaaaatcacagatggctccagccctcaacaagcaaaaatttaggtcaggcacagtggctcacacctgtaatctcagcactttgggagcccgaggcaggcagatcacctgaggtcaggagttctagaccgtctgagccaacatggtgaaaccccgtctctaccaaaaatacaaaaaattagccgggcgtggtggcacatgcctgtaatcccatctactcaggaggctgaggcaggagaatcacttgaacccgggaggcagaggttgtagtgagccgagatagcaccactgcactccagcctgggcaacagagttgccagtgtcaaaaaaaaaaaaaaaattaacaatccctgaggagtcggagaataagatttgccagagttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgaaacggatttcactcttgttgtccaggctggagtgcaattggtgcaatctcagctcactgcaacctctgcctcccaggttcaagcaattctcctgcctcagcctcctgagtagctgggattacaggcatgcaccaccacgcccggctaattgttgttgttgttgagacggagtctcgctctgtcgcccaggctggagtgcagtggcgcaatctcggctcactgcaacctttgcctcccgggttcaagcaattccctgcttcagcctcccaagtagctggtattacagatgcctgccaccacacctggctaatttttgtattttttttagtagagatggggtttcgccatcttggccaggctggtcttgaactcctgacctcgtcatccacctgactcagcctcccaaagtgctgggattacaagcgtgagccactgcacctggcctaattttgtatttttagtagagatggggtttctccatgttggtcaggctggtcttgaactcccaaccttaggtaatccgcctgcctcggcctcccaaagtgctggaagtgtgagccgctgcgcctggcctaattttttttgtagttttagtagatatggagtttcaccatattgcccagactgttctcaaacttctggtctcaagggatccgccagcctcagcctctcaaagtgctaggattacaggtgttagctactatgcctggccagaatattcagttctcaaaaaaatcataaagcgtatgaagaaccagggaagtatggcccactcacaggaagaatttttttttttttgagatagagttttgctcttgttgtccaggctggagtgcaatggcacgtcctctgctcaccgcaacctctgcctcctgggttcaagcaattctcctgcctcagcctcccgagtagctgggattacaggcatgcgccactatgcccggctaattttgtatttttagtagagacagggtttctccatgttggtcaggctggtcttgaactcccaacctcaggtgatccgcccgcctcggcctcccaaagtgctgggattacaggcgtgagccaccacgcctggccacaggaagaatttttttgacaaactatccctgacaaactctggagctgaaaagtaaataggttttcagtgagccaagatcgcgccactgcactccagcctgggtgacagagcaagactctgtctccaaaaaaaaaaaaagaagaagaagaagaagaagaagaaaaaagtcatcaccaaaccacggtcacctagattttcccctatgttatcttttaggagtttgataagttttgtattttacatttaggtctatgagccattttgagttaatttttgtgaaaggtctaagatatgtctagatttttattttgatttttgcatatggatggccaattgttccaggactatttgtgaaaagactactctttattggattgcctttgctcctttgtcaaagatcagttgactatatttgtgtgggtctgtttctgggctctattctgtttcattggtctatttttgctgacaccatactatcttgattttctttccttcttttttttttttttgagatgaagtctcactctgttgcccaggctggagtgcagtggcgcaatctcagctcactgcaacctccacctcccgggttcaagcaattctcctgcctaagcctcccaagtagctgggattacaggcagcatgccaccacgcccagctaatttttgtatttttagtagaaacagggtttcaccatgttggccaggctggtctcgaactcctgacctcaggtgatttgcctgcctcagccttccaaagtgctgggattacagacatgagctgccacacctggctccccctcctttttttttctttttaaatagagaccaggtctcacgtgtagacaggttggtctcaaactcctgggttcaagtgatcctcctgcctcagccccccaaagtgttgggattacaggtgtgagccaccatgtccagtccttactgtcttgattactgtagctttatagtaagtcttgaagtcaggaagtgtcactcctctaactttgctcttcttcagtattgtgttggctattcttggtcttttgcttttccatataaactttggaattagaccgggtgcagtggttcacatctgtaatcccggcacttttagaggccgaggcaggaggatcgcctgaaccaaggagtttgaaaccagcctgggcaacatggcgaaaccc

SEQ ID NO: 1689 - DNA, 66686 bp, Homo sapiens
gagcctatgcgcctacaagctgggatctcttgagtcagacagctgaggccaaagactggcatcaccctgtggagcagcgagtgtgggggagatttgggctgggtgctctgttgcctttcaggagatggctcttaccctatggtgtgatgcctgagcacggctcattcccactgaagaaaagatttgttatggttcatgaatgagtgcccactaggacaggggtgaaactaggagtgttccagggatggacaagtccctggatgaagaaagggagaccctcacctgatgtcaggcttaccaatgaccttgggaggggatggatagggaagcaaggtctgggtgaagatctagttctcatcttctaggaaatgggggtggccctcaggacagataagctcctttgcaaatgtacagacatcttgcgaggagagatacacgggggagggaaggcagagcccacctaggccaaaacatcattgtgggctttaagtttcaaactaggcttttaaaagtcgacaacagttaaggctagtgttgtggtgtacacctgtagtcccagccactggggaggctgaggtaggaggatctcttgagcccaggagttcaagccttcagtgagctatgatcatgtcactgcactccagcctgagtgacagagcaagactccgactctaaaataaaattttaaaaaattcaaccaggtaaatctatagggttaaagctaaaaaaatataaaaggcatatagaaaagtctccccacattcctctacccccatctactccacctacccccagaaaacagaaccactattatgagtagatctttgtgtagtttccgagaaatttttatgcagatataaataaatattttttgccttctttctccacaaatgctggcatactctacatgccattctgcactttgaattttcttttttctttttctttttgagacagagtctcgcactgtcacccaggctggagtgcagtagcaccatctcggctcactgcaacctccacctcccgggttcaagcaattctcctacctctgcctcccaagtagctgggattacaggtgcccaccactatgcctggctaattttctgtatttctaatagagacagggtttcactatgttggcaaggctggtcttgaactcctgacctcatgatccgcctgccttagcctcccaaagtgctgggattacaggcgtgagccactgcacccggccactttgacttttcagttgaacactgtatcccagggaccttcccacatcagtgtatgcagagtttccttgttccgttttatggctgtacactgttccacttcatgattagctggaccataattttctttaccattcccccaacagagggcactaagtgctttccaaccttttttaatgtaaacaatgccaccatgaaatgagcaagctggtatacctttcacttttcggggtgcggctctatcatcaggataaagataaatttctagaagggaaacagctggatcagagtgggtgcattggtagctctgagaggtattcataaatagttctccaaaaaggagacaccaatttacactcccttcagcaagtaggggggtgttttactttttctttttgagatggagtctcgctcctcgcccaggctggagtgccgtggctcgatctcggctcactgcagcctctgactcccgggttcaagcaattctcctgcctcagcctcccaagtagctgggattacaggcacccccaccacgcctgactcattttttgtatttttagtagagtcaaggttttaccatgttggccaggctggtcttgaactcctgacttcaggtgacccatctgtctcagcctcccaaagtgctgggattacaggtgtgagccattgcacgcagtcgtcttactcttaacatacccaaagtgttcaacttttcttccaagtctgcctctcctccttctgtcaccaccatcacccatttgctcaagtctgaaggcaggacgccacctttacacctccacccttgcaccccagcagaacgccctgacagtacttctagaagaatctgtcccttcctgccttcactctggttacatctggagttagcctcagcccctctcacctggacacctgtgcaggtcccctgcctctccactctccaccctcctcgccagcccaccccatcctccacactgcaagccaaggggctacaaatgtcgcagccgggtgggctcactctcagcccatcatagggctgagatccctctgcaggatccaggctgtttggcatatccctcaaaacccaggccctgctgtaaggcctggaccgggtggggtcctagaggtcatctccctgcacccatgtgaagcttctgagcatttgtccttggggttttgccccatggcatcccagagccacccaggcactatgttcacctcctgctgcccttcaagatgaacaagaagaagagaaacaaagggagttcgccacaggcctgagtgtggaggagacagagaaagaacagcacagaaaagagaggccaggaaggccccagatgccaggtcaggttcatttcatgtagaaatcacttcagcagattgctctgctaaagagaagaaaatacacttaacatgatgcatggcccccgcttggctcaaagctgattgcatctctaggctagcgacaagctggcagagcttattaaaaacagtgcacatgattctctgcccaagctcagagccctttccctctgagccactcagggcatttcccagtgtgggtgaggaagtgtgcaaggcctggtagaccttagactgcatggctgcagtttctgtaactattgttcatcctgagaagtgaaggtttggaaaactaaatgaagacacccaagaatgccatctgctttcttgaggcattggttcaatgtttactcagcaaatgtgcatcgtgctcctgccctgcactgggctgagctgggagcaggattagacgctaagacaaagtcatggagaagtccggtgccatgagctctgcaggaaagatggacccagggctctgtgggcagacattgggcaggaagaatgatgaggctgtaaatcctgagaatgcactccctcccgcagacattctcagagtcccagagtgttagggggcaggaggaattccagctgtggttctggaggattgttaaacctttttggtgtgtttcctactctgaggcatgtttgttttactcacaatgatgatgcaattctccaattacctagcaactatactaagactctaaagaaaaaggcaggttcttccaatacatagataagtcccaggtggaaggacaagaccccagcctggagaggtgtttgtatcgggaggagaatgagaacgtaaatccctgaagctgggagtgggtctggtgctgagcaaaccctttacagttctggtcagtgctgaaatttacttcaaggtcctttctcagttgctggggcatttgaaggggatgctcccagagatctgggctggtaatcatttccctgccgaggtgtcaccagaaatggatggccctcacattgccacacctgtctccctaggttgccctccttaatcacttcgaaacagagccgtctgccagggcagtgggcaatgggacactcctgggcagctccatcatctctagccaagaatcatttggactggccagaactgcactctggtcccagccagaggaccccagttccaaagtccttcattgtgcaaacaaagagacaaaagagatgccttgcaagttgaggcaagtcaggctcagaaggagaccatgaaattcagcagcatctgtgggaggggcagggggtgcagagaggataggggaaagggaggaatcagcagctcctgatcccctccatgtgccagactttgcaagtggctttgcttccacaaacccgccatgcctctagcaggcagcaccgattatcctgattcacagcttggaagcagggacagacagcatggataactcgcccaagatcaccccagggaaaactgggaatttgtcttagttcattcaggcttctataacaaaacagcacagacagggtggcttataaacaacagaaatgtgttgctcacagttctggaagctggaagtccaagatcaaggcactggcagattccatgcctggtgagggtctactttctggttcctgtgtcctcacatggtggaagggaggagggggccctctgtgacctaatctttcataatgacaccaatcccattcatgagggctccactcttctgacctaatcaccccttagaggccccactttctaataccattaccttgcagggtatgggttcaacatacaaattttggcggggtcgggggggtggtgcggaatacaagcaatcaggccatagcagagtaaaacccaaatatccccaactctaatgtctagacctcccctgtaaaaccatatgcaggatctactagacagaacgtgtgtcagactgagtgcacactcctgggaactgtgagcttatataaaaattcacatcatggccttttaactgtacccattaactcaagaccccttgtctccaaacctcaactttgactagttagagaatcacacagaaatcattataaagtgcttagaacatcagagttttcacgtggtgactaatacttttattgacttatttttattgatacataatatttgtacgtattgatggggtacatgtgctattttgttacatgtgcagaatgtgtgatatcgagttggggtatttaggctatctatcccctccagtatttatcatttcttttcttctttccttctctctctctcttttctttctctctctctctcttttttctttttttttttttttttttttgacagagtctctctctgtcacccaggctagagggcagtggcacgacctcagttcactgcaacctccacctcccaggttcaagggattctcctgcctcagcctcccaagtagctgggattacaagcatccgccaccacaccgggctaattttttgtatttttagtagagacagggtttcatgatgttggccagactggtcttgatctcctgacctcgggtgatcaaccctcctcggcctcccaaagtgctgggattacaggtgtgagccaccacacccagcctgtataatcatttctatgggcaaacacatttatcaaaccacctccatcctctaacatttgttttttctcagacgtgagatcctatttgtaggactataacaacaaggaactttattaatatgatgtctagagaatgaaagaggcacatgtgccctagaggaagagccgatgtcctctgtgagttctcctctatcaggggtcaggttggatgaaatctaacccccacctgcctttgtaaataaagttttattggaacacagccacacccattcatctgtgtcacatctacggctgctttgtcactacaacagcaaagttgagtagttgcagcacagactttgcgtggcccacaaagctgaaaatattcatggtctgggcctttacagaaaaggtttgctgaccccagtgctgaatcactatgggattgcctgtgcaggagctgtgccagctgtgttcacataatgcatcctgctttcattcaccaacctcccttccgactacaaaactctgccattctctgatgcaggagatgggactcaagaccacaccgtgcacttctccgtaaagccacctcctggaccagttgggtttcttgctccttttccttctgaagcaatcctctctctcccatgaggccccctgagcgcactaagcagaggtgccgcctctgagtggaatgtgccaggccccagagctgcctctgagtctgcaggagtgcagagtgggcagagggctctctctgctgttttccatcagggcgtgtcccatctcagtctaacagggaggtgcccagaaaataggtggaggtgagggccactcagcccagtggccctctgagctgttccttcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccaggggtgagtggggygagcaggggaaggagcayagatgaggccgaggytcagcagcccccgcaggaagtggaaacaggggtgctggggaggggccggctacgctcagtgcaactgagktgcatcatcccagtctaccgtggaaagctttgcagtttggaggcagaaaataatgtacaggcctgggatgctctgcggtggggaccsggggcatctggttgtacccgctccccggctccaagctgtctgactccyaccgaggctgaggacctggagtcagagtgggtcttgtcagcaggtgataggcacgaatcaaaaccttatccacaaggacaggcccccaccctgtgtgtggtaacactgagatcacgttatgcacagtgttctgtggcttctggcccagagctgagggtgctcagtgtggatggatgtttggctcagcaaggtctcagcaaccgggtgacagatggaatacaagggaagcaggaatcttctcccragaaccatgcaccccccattcccagagatcagggtgaacagtgccccacctctgacagtctggaggtgtcgtcccaagaggcaccagctggtcactgggtcccaagaggtgctagcttgtgcctgggacgccatgtcaatatttgcggtgctggattagtcagggctctacctctgacccggcgccagctgggctggcttccattccctccaggtgkgtacgggcctgggagtggctcctgtggggtccggttgcttttgggcaaggaggggcagtacaagggatgctggtcctacaagtgagatcctgagtgccygtcttatcctgacaatttgtctcatgcatatagtcatatcacttcatttccctgagcctcagtctcctcacctgtaaaatgggaacaataatggctaaygcaggccaatgtctagcacacagaaggtttccagtacattacagctattgtcacattattactattactgatactattattatcatcattacaatgattattagctctgartctcatcttacatatgagtagcaaaggactcatcataactacctcctcactatctcccaacattaaaataatgttgatgattaaaaacaattttttttaacgcacattcacaaaacttctgggctcttcaggggcagggccaaagtgaacctaagtgggtgtttccgaagtggtaagggttttattgctatttcctgcagtaggcagtgtggggtgtatgtgtgtgcacgcacttgtgtgtgtaggaatttgactgtgtatgtgcatgtgtgtgactgtgtgcacatgtgtgtggatatgcataggcgtgtatgtggggggtgggtgactgcatgcataggcacacaggtgctttgatcttcacctgccaggtaattgatcccacaaggtgccatgttcatggggaaatcacagtgagcattcagtggccctatcggagttggggtgaaagctcccaggcaccttcctcaccgaagccacgctgtgattgtttttggttctctgcatatggccaattgcagtgtgaggtcacggyactggcagatcacgtggggttgcactttacagacaggattagtaggtcatgctctgctaagtaagaaaaaggacatttccaaactaaaaaagcagaagttacaagacataaaagagtgaccctctgaggggcaccgcccacgaccattaggtctccctgggcttatttccggcctcggcgcatgaacaaatgggcgcgtgggcagctgcccaggctgcaggctgtgggtgcatttttaactgtgggcagagatttccctgcagttgatgtcaggagccctgggaaatagagttagagaaattgatttcctgggcccctggtgagcagagcccctggccagaagcagcggctctttctgtttgatccagggtttcatacagatgctcatgttctctacaggcacttgatatgaaaaggttggaagcactttttctcttccttaaaatggggacaataatgcaacttatggggtcctcatgagggtcagctgcgttaccatgagtagagcacttagcaaagagcctggtgtgtaaagaatcagtgctggtccttgttatttctactgctgtcattgtaacctaacaccatcgtctcctgactctaggagggcccccatccttgcagtctatattgacatcatctagtttaaagtgtaatctgtactctacaactcacttactttttgtcaaagttagaattctccragataaaagctggacgcacaaaccagcatggagggcatctttgtctcccccttcagaagtctyccctcctgggaccagggccaccaaggcctscccagcgactctagagtcccagatctctgctccaaggggctgtcttccttagtattatctcctctggcattgccccaaacgctgggtgaggccttcatccacaggccagggcccttgatacacacaagcccctgccaagatgcaccccgacctgccacccagcccatgcccctgtaccagccctctgtcccttcttcatcccactgtctccacctacggcagaccctttattgatcttaacccaggtctactgtgttgctgtcgttcccacagactcattttcagaatctgttctgccttttcctttgtctgcaactgaagattgtccctttggtctggtcctcattcycgtacccctatctgtttcttatttaggggagttagragctttacatcatatcttacagatttctgtaaaatcaggaacaaaagggctgaggatgagcatggagactcttyttgcagcatagagtcgcagggagccggggggtagcgggccatagggaaatcacaagcattgccaggttccctgcagacctctgtggcttgggcatcatttgcagtrggactcagcattacacggtgcacrtctcagcagcccgtgggaccgtggggctggacggccctcctcctcagcaccaccttcttgtcaaacacagctgtrcttggggagggtgggcagagcacaaagccaaggggacattggagggcagtggacagccaggcttgccctcaagggagcccagggcaaggagtgcactgagggtgactcagggaactggctgggaggggctgggaggcagagagggtgataggctcaacctggagagaaggtgagatcacccccaggtctcatgcaagggactgtggacctgagtggaagtgggtgcacagaaagaggaggagggagtatcgggtgaggtctcccagcctgatggggaacagccaccatgcagtccatccctccttgtctgcctgtacccatttatttttggccaggcaattcccccccaccaattctcagtgtaaatccaggacacctccccgaaagtgcccacacccctctagcccatgtgaacaacccctgtggcagacctgtgcacagcgtggcatgtgaccacagcctctcctgcacggtgagcttgccgttccctgtgctgctcccctgacccccaggaggggttgtcagttgttctgggacagccccaaaggccccatggcctccacagtgctgggcacatgacagggatcggcacatagctatgaacagcagcgtctggcatctccagaccttgctggaaatgtggcttttcttcactggaaggccatgtgaaagacagaatgaatgaaaaagaaagagagaaagaaagagaaaaagagagaaggagaggaagagagagagggaaagggaaggaagggaagggaggaagggaggaaggaaggaaagaaggaaggaaggagagaaagagaaagaaagatagaaaaaaagaaaggaagaagagaaagaaagaaagaagaaagaaacaaagaaagaaagaaagaaagaaagaaagaaagaaagaaagaaagaaagaaagaaagaaagagaaagaaagaagggtggcttttccctttgtgaattattcactgtgcttagtagaggaaagtgtgtcttcggctgagccccgatgatgtacaaggtaaacagaacagtccctgaaagcaaacattccagggtgcttggcccttagtgctccaggaaaaccacctggtggtagggctgtggggtgggggaggggagggggagggggaggggtctgcgtgcctccctcggggcttcaggcagcagtctaggttcacttcaggtttgtcaagacccctgcaattgagacacctctgatcgtcctatcacaggactgtagcttcaggtaaccccttcctcatggcctcccaagcaacatttcacaggaacaaatgtacatccaggatcgacacgcacatgcaggacactcacacgtagacaatgctcccaagtgcacatgcaaccagcatacatgtggagcatgcacaagcacacacgtgtaccacacctgggcacayacaacaaggcaagtcacaggcaccttgcacatgtgggcatgtgggccgtcagcatacacaccactcccaggcatctaacccaggcccaccgcctagctgccccttccacacatgcgtccgcagaaccccctgtgactggcacgtgtgcacaccaattmccagaarcactgacccacagaggagtcggtcacacatccagacacctccccaatttatacccgatggctaatttgtgtttacttggagagtttctgagttttttccttttgtatttttctcctcattgggtgcgatytggtttaaaacaaaaacaaaaacagacctctcctgaacaaaacaaccaattgcaagataggagctgggaggcggtggcagctgcaggcacagttggtacggttggcggggccaggcctgcagaaggctgggggaggggaggggcagggaggatgggaaggaggcgggcatccgggaacagccctgccccaggagctagcacagcctgctgggcagggatctgtggcttttggagtacattttatgtccacttgaggagtgagtagcattggcagtgggggcattgcttgccakggctatcccctggcaggggctgggcaatcaagacagggagggcttgggggactcctgggtttcccttcgggcaggcacattctgcarcaagcccagaatgtctaagctggtgacagatgaggatgcagccgtgagaagttaaatggcccaccctgaaccctactgctgagcsgggcaggctattcctgggactctattgaggcccactgacatggtcctggtttgcattgtccttctgggctcagctcagagccacctgcaaactcctgcgctagccaaggtggaggaggaagaagagcagtgygcttcctacagatgagaggggtccgcacaggcaagccaagccaggaccccagaactgagcagctgccccccaccttcactccctttccagccaccacggagatcagagtcatttaatgaaatggcgccaaagctacctggagctgggggtgggaatgcaaagacgtgtgagacctggcagaggacaggccagcatttgggaggtccttacttctgccgggcctggggttttggcgcatctaaaaacaccccgtgttcttcagmaattctcctggccaagctttcttgagtattttagacactaatgccacacatagctctccctgggcaggcgcccctggtgtctgtcactcctccaggttgtcacatcctggggaatgcagagagagcaccagcatttgaagcttctgctcttggtcctgataatccccttgacttcaaagaaatctctgtcctgcctttgattctttgggacacaagatgagaggagaagcagggtgctgagaagcctgaggaagacaattcaaagcagaggtctctcggggaaggcggcgcagcttgagctccccacrtggcgtccgcccagacactgctggaaccttccacctccagcccaggcccctcctcagtcctggtgcctggaaaagtgggaagaggtgggaaaaatccttcactcctctgcaggccccggcccagttaactcaccacccctgcagggtgagccagaacgkgcctcgctgccacaggwttggctgttacctctcccgrgaccggcccggcttyctccctccctccctccctccctccctttgtttaggtctgtgctcctctgcttcccccagagacgcctcccctgctgactgctgtagctasccttgccccatcccaccccttccctctccatcctcgctcttttctctcctggtttatggtttgtctcttcctcaaatgcaatttgcaaaactctcctgaacgaaacaacagcttctgggaggtggtggcagctgcaggcacagtgggcgccgtgggtgaggccagggctgaggcaggctgggggaggggcggggcaggaggctgggaaggggcggggcttccgagagcaccgccctccgcgtccagggcagctccaccagggcaggggctttccctctctctttgttgtcgtccaatgtcaggaatggagcccagcaactcaaagagtggaagaatatatgcatatcataagattgctttctacacttttttgttcatgttttataaatacccctccatattgtatatgtatatattaatatgtattaatgattacattaatacacatagtgtatgtgcttatgtgtaatatagaataatatatatatataatgcacttcggtgaaacaatatgagagatgtgtgcatatctctctttatatggtatagatacatgaaattttacctaagygcatctctgtaaaaagaaacactgagcagggtggcatgtgtctgtaacctcaataccttgggaatccaaggcgggaggatcacttgaggccaggagtttgagaccagcctgggcaacatagcgagacccccatctccacaaaaaaaaaaaaaaaaattaaaaagtggctgggcgtggtgactcacgtctgtagtcccagttacttgggaggctgaggtggraggattgcttgagcccagaaggtcaaggctgtagtgagctatgatcatgtcactgcactccagcctgggtgacacagcaagattctgtctctaaacctatatatatttggaatccactttgtgggggaaggattatataaagaaagaaatggagaagmtgggtgggtagggagtatgtttagtccaaggccccagcctgtggtacatgcattactcagctccttgaagcccacagaggtcacagagctcacagctgggatagccctggactcctagcccagtgcctgagtgagcacaggaatcctcagtgtgtggctgatgtccagctttgtggccgggtgtggcctgtgtttctggccagagattggtgctgagtgcagctcaggaggcaggacctctccccggcggaggagatttaccaaagatgagcccagccttatccagagcatagagaggtggcagccttttacatccacgtggccctcctcagggaaaagaatcaagcacagggaaagccctctgccccaagaaagcagagagaccctgagcctaccctttcatagtggcttgcagcatggcaggcctcagcctaataacactctcattcctccaggaaatcgtgaaaaacccagaattcattcttggaggggccaccaggactgatatctgccagggagagctgggtgagtgtaagtggatggagcatggcraragggaggttgagtcactgggacaggcaagcaactgcagcatggggtccctgaggacccaagaggcayggggctgggggaacaacactgcttyggcctctgcttcctcactccctctgaatggagtccagtggcctcaagcccctgcacctcygttcctctagagtcagacatgcctgtgatgtggggctcacagccccggagtttacagaggaaagtgacacccagcagcgttggtcgggctctcctacaccaccacagtagctaacacctgcacacatgaactcagtcacctgcgaggtactctccccagcacacattgcctcattccatcttcacaacccaccctcctaacgtcacagatgaggaaatggaggctgaggaaggctaagtaacttgtccaaggtcacagaggtggtagacaggcaatcaggatttgaacccagacactccagcagcagagcccttactgctaaccattatacacaccctggggagccgctccccagcaatccagtctccctcctgcaatgaacctgagtgcacctcaagtcactcaaattgggtcctgcattttaggacttaatccaactgggctgggtttacctttgttctatctatgaaagacagagaragtgagagagcgagagactttcttttaaaaaataccagtgaaatcagcctagagaacaaaccactgcaagcttgtgtggaccctgacttatttctagctgaggttgtcactgtggtctattggttaagaaaggccatgctggaacctccatgctgagcaactgagctatcctaaacacaagatccaaagtcacaaacctagactgatgttagttaattagctagacagagagacaattgagagagagagagagagagagaagcaaatggatagatagatagaaacatagataataagtaatagatgataggtagaaaacggatgcataattagatagataaataggttgataggttgattgattgactgatagaccatacaaaataaatatataataatagatagatggtagtaaataatgataggaaggtaggtgggtaaatacatggatggatgggtatagatagatgatggatgatagacggaattacagttgaccctttaacaacatgagtttgaacagtgcaggaccacttctaagtggattttttttcaaccaaacacagacagaaaataccgtgttccaggctgagcgtgatggctcacacttgtaatcccagcactttgggaggccgaggcaggagaatcgcttgagccgaggagttcaagaccagtctgggcaacatagtgagggctcgcctctactaaaaattaaaattgaaaaattagccaggcttggtggtgcatgaccatagttccagctacttggtaggctgagatgggaggattgcttgagcctgggaagttgaggctgcagtgagctgagatcatgccactgcactccagcctggacaacagagtaagacactgtctcaaacaaacaaaaaggaaaaaaaggaaggaaagaaggaagggagagagggaggaagggagggagggaggatggaaggaaggaaggaaggaaggaaggaaggaaggaaggaaggaaggaaggaaggaarggagaaaatatactattccaggatttgaaacccgcatatacagagggctgacttggtataggcagattccacagggcttactgtgggacttgagtatgcacagattttggtatacacaggggtcctggaaccaatcccccatgtatgccatattctagatacaatgtagacttttcaaaaggtttacattcaggtggtccttctccaggagatcctccctgccgctgcccacctstccccctcttcctctgcctcccttcccctcgaccccgtagtcctccattgctatccaataggaaatcattctactggctcctttgtttttcaaagttttggtttgtcacattggcataaacatatatttggagttacaaccttatattttaccttagtggatggttgattctaaagattattttgtaacacttttactacaccaaagtactgtacatggcatatatatgttataaagaataacaagaaaatgaacagccgtgatctgttgccacccacaataagaactagaacatctggtcatgtagagtgctcacacctgtaatcrcagcgctttgggagggggaggtgggaagatctcttgagcccaggagttttagactagcctgggcaacatagcaagaccacatctctatcaaaaaaaaaaaaaaaactagaacacacttggaacagcatcaaggcatgctgttatctgcagggggtgggggtaggggtggagctgggtgagtgtgaggggatggagcatggcgagagggaggttggattgctggatcaagagcgactgcagtatggggtccctgagaacccaagaggcacagcgttccccctgcagtgagccgagatggtgccacttcactccagcctgctcctcccatagtgccctctgctctgcaccacccagatagccgagcaacacgctgacccacagagggcacttcttccaggcacagctgggtggccagccccatccatctgcccaggcccaagagagagaaaagcaatcttgttttggcttctcaatctccccgccaaaagctcagagcatttctggctgaaaacacgtgaggtgttgagttctcaggccggaaaacactcattttcctcaactgggcaaagttgaaacttggaggagagctgggaaaggtcagcccacagcagaggtcactctattagactcctgttggcctggccgccctgaagctgaaagcagacaccaagtctctccttatctttgcatcttctgcgtggcacaaggtctgccaccctagaggcacttggtaaagtttgctgaacaaacgatcctgcaggttccagccatgtcacttcctagtagcatctcccaaagctgacctgaggctcccaaagaccagcagatgcattagaaaccaatccttctgtgctccagctaaggctgggggtggcttgtactctgctggtgacacctctcagaaagccagaaccagggcgattcggaattagctttcccgatgttcrgccctggcgagtctctcttgcctgtgtcaaacagccagaaarggccatattacaatgtcccaagcccagtgacatacggtgctttccagaaatgtgaactcagaaactgccaagctgagtgtgatgggctyttakgttctgatgacgttgatgttgtctactgaaaacaagtgaatctggataaaggtgattcggataaatggatcctcccagatatctgcttacacaggcggcatctgagacactgtgaggcacacaccagacacagcccacactcagtgtgggcaaaggaatgcctccaggagtctggaacagcacagatagcacagataaaatcatgtttgatgtttgacttcactttttagttttcctccagatgtgtgttaacatgaagacacagctgggaagttcagtaggtcagtcaataaatcttgaaaatgcaagataatttaaagcaaatggagccaccacggagataccattatctgtaattaagctgwgtctyggttggggctgcagggagatttctaaccaccctcccaagtactgccgaaccacttgggtggcagctatgaaatgtctgctcgcccagcccrtgctgacactgatgtatgcagwcttggwcctctggaaagggagttgctggaattyacagagctgatgcatcaggcagccatatgtctgaaacccaagtaagcatgtcctataacagtgccaagaaggcaacagctgtttatgatagacgggcagagaagagcaggcaagggaggcagaaggggaggagagagttatttgttggtgtcctgtctgtttttaaacaggtagaaaagatgtggccacatctgaaactccccacatccccttctgacacagagttttcctatttgctgtgaaatagcaatgaaaattgtgatttatggcttccattttgcaggagactgctggctattagccgycatcgcctcccttacgcttaatcaaaaagcactggccagagtcatcccccaggaccaaagmtttggccctggttatgccgggatattccatttccaggtaagagggagccctgrgccagtgggtttacctctctggggcccrgcatgagggcaggtgcatttccacactgcctggtaaccctagaaaaaaatgtcatcagatctgtgtgacatatggtcctaaaccatgctaaagccacattttatcatggaataacagctaaatgcctcagaagaacattaacggcattgcacggtgaatccttatggagcatacatttaaaactataagtgatgttttggcaaatctggaggtccatctgttaagggttttattatttggaatttcttgtgctttaagcacaaattgactaaaccaattatacctccaggaaactggttgatttctcataaacagagaggttctctttatggaagaattgtaaatttggagatcttgagggattttaaaaaataaaaactgagaaaaatacagacaacatctgctggagtcccgtgtgacccgcagaccctcagccgaggtgcacatcaggagaggcttgcccccaggagatggtttcctgctgcttcacctcactttctatccctccagtctctcctccacccctgtccttatatagggttcgaccagatactgaaacttgccccttgttcttacttaggtgggtgacctcagacaattttcttagtgacattaaacctttctacactcgtctgaaaaaaggagagactgacagttccctgcaggcttccygtagagctaaatggcatcacacacaggagcyggcacagagccaggcaccgagtaggcattccttgaccttccaccccagacagtgtcaccttctcctgactcacaggccaccactcagggccagcccgtttcttctgtccctgargcctgcaatctgataagcagaggtactctcaagccctgtcaccaatagcacagaagtgtttcaaaggcaaagagagtgagcaggtcacatgtagctcagggagcatgcaattcccaggggtcaggcctcctgcgccggctggggacagagccactttgggtcccagggaaactctacccctgctctctcacagacctgccaccacctggctgtctcccttcccatcctgtgacttctgctgagaccacagtcttggtttgatggcgcccccaggagccggtctttccccagtcctcttaaacacaccagggtggcagtgttgggggtggttaagctcagaaaatccagcagaactactgcctctaaaccagaaccagaaccagcagaactactgcctctaaaccagaaccagaaccaccacctcttgggctcccaaaaggaacagtgttcttgtcccttgaatgtcacagctgggaggagccttggcaatcccctgacccagtcctctcattaactcccgaggacactgagtcccagggagtggaagtggttgatccagggtcacaaaacaataagtagccaagccagacctagaactcaggagttctggatccagcatccttttgtgctgccagggatcatgtgggggtggggagtgaccctgttgatgcctgtcagtcccgcaataacaatactccgcccgctcccctccttggccttctaggaagcagagctttggaaataaatccacctccttcacactcctcttccactcctcagccacagtgcaggtgtgcgtgctaggaagttagcagagctctctgggctggcagataatctctcctgactcacaggccccctgagccagcccctctgcaaggaaagccagccctgaggctcctccccactgctcccctgctcaggaaccccaaggcccaggcccgaactttaaacacctaacccaactgtgcctcagtcccacctgaagctgtggatagccccaaaagcgggaagccctggaggggaggtccagctggagcaggtgacaagaatcttccttaaaacacacacacacacacagacaccctcagccacatcgtggccaactcttctgattgggattgaatcactgatgcagcaagatgctcaggatgacacagcaaagctgtaaataaatggctcccaaaaccactgtgcctaccctcctctttcaacccttttcttyttactcttagaggttaccttaggatcgctctcaggccaactgaaccagaaggaacgggtaggaggtgggtcactgcaggatacacagagaaactaccatggtccttgactcgttccaacctcccttcctgttcccagcagaccacacacaagctcatacacatgcatacatgtgctcaaacacacacgtgtgtagaagcacttgcaaacacatgcrtgcacacatacatgcacacacatgcacacatgtgagcaaacacaygctttcacacatgcaatgtataaataaaccacaaacagtgcacatacctgtcatgcctgcctgtatgcacatgtatacacatgtgtgcgcacatgcattcacacacacccacactccactcatgtctcctcactggcacgcagggattactgagtccacctgcctcctatgtgaatggccaacaaatcagtcttaggggctccacttatgggcgaggagggagcaaggttaaggaaaattggagctagaccctgaaactggatgggagagaataacagagaactgggctacaaaacagcaaacccaaaccccacgttaccattctccctcccccacaaaaacaactttcttgtgaagaagaaaaactaattcagagcaccgtagagtgtctacttgtgagtcctgtcctgccccctgcatcgcctgcggctttgatgggttgaccctgagtctttcagctgatgtcaatggttagtgctgggtggaatactcagcttgtaacttggwggacaaagcccaggtgccctaccttggaacccgtgtgtgattttcaaagctgtctatgggtagcttggtcagaggggaaaaaagcaacaggatcaacatttacaaacagggcctggagctcccatgtagctgactcrcatcatttctgtctttttcctgggcaacagttctggcagcacagtgagtggctggacgtggtgatcgatgaccgcctgcccaccttcagggaccgcttggttttcctccactctgccgaccacaaygagttctggagcgccttgctggaaaaagcctacgccaagtgagtgacagcttccccagctcargcagcctcccgacaggagtctctayactagtctttgtagtgagcatctaagggctgggaaaaaatcagggctctgggtttgcaggtgaggctcggcaggacccaaccctctcagggctcaagcggggttggaggtggttttcctgtcgtagcctagatgtgcccatctttgggagcagtsgctacattcatgaccctttttctccctgggccatgaatctggcctttggaagagctgggaaggcaagcggaggggaattctggctgtgccgacagcacttagtgcttcacacttccctcggacactggcatggctcaaacatctgggctattacgcacgtkgatatagagacatcaattgtccgtcctacgggatgcttcttttttatttttaaaaartcgtatatgacatatcgataaataatcgtatatgataaaatgtatatgacataaattttaccatttttaagtgtkcagttgagtagcattaagtacatccatgttgttgtgcagctatcaccacgatctatctccagcactttttcatcttgcaaaactgaaattctgtccctattaacaaataacttcctattcctcccttcccccagcccctggcaacaccactctactttctgtttttatgatttatctagtctaggaacctcatataagtggaaccaagaaattcatttttaatcaccagccaaatggcctcagtttcctcaggctctcaatttccagcccactagctcgttagtgaaaggccacaacagcctgaatttgatccacagatgatggcagagctcctgggagccactttcaggttcagcctggatcttcaagccatgagaatactatccccagagacagaagcaaggatggtcttgcttctacctccaagtgggacataaaagtggcaaaatagaggggagkcatactgtggttaaattaatcctgaaatcagcaggacagaattaaagccatcaaataagaaccaaagatgcccacgcttgccctctgtcccacccaggtctgtgcaaacaccatcagtgccaccagacaggcttaaggggacaaagggcactgtttccaagtccagtgggtgggacccaagcccacctctgccccttggtgagtgccccccacatcaggatgcaagcaaggcaacagmaactgtgtgccatctagtttctaaacataaaaaagatttattggggtcayttaaaaaggccaaaaatggttggcagaacagctcaccaaaaaaaaactgtatagatggtgttatggttagttttatgtgtcaacttgattgggccaagggatgcccagatagctggtgaagcattatttctgggtgtgtctgtgagagtgtttctggagaaaatagcttttgaatcagtagactgagtaaagaggattgctgccaccaatgtggacgagcattattcagtttgctaaagatccaaataaaagaaaaygacaaaggaagggtgaattccctttccctacttgaactgggacatccatattcccctgctcttggacattggagctcctcgttctcaaacctttggactcaaacttggacttacatcatcaaccccccaattctcaggcctttggactcaaactgaatgataccaccagctttcctggttctccagtttgcaaatggcagattgtgagatttcttggcgtccgtaactatgagagccaatttcaaacgtatgaaataacctcattgaaggggttggagagaaaggtgctgacctaagtaactttggaaatcagtggagtctgtaagattaaaggcaaaagaaactgtacgtgagtgctatgctctagttgctaaaattgtttcttgtaggagtacaaatgaaaaattgatctaattatacatgtatattgagctgaacaatcgagtgaacggatggtggatggcgggagccgagtttctcactgttggattgagaggttacagataggcaaggggaggaggccagaatgatccatgcagattagagttggagattccagaatgaacttagatttagcttaacagagatggttatgtagagatacatggatctgtacatgggttatcatacacatatatattgatctatacttgggttatcatacacatatgtatttccttgctttgtcagtgagaggaactagaagcaatgacaatcctgtagcaacaagcacacctatgtctcaagtcttggtttctaagatcattcttcaatcaaaggaactggggcttcttggagataaggctgattctaggactggggcatacacacatacatacatatatatacacatacatatatacatacatacataaaatgaacctagatcatcttatagtgccagaaaatgagaacacatgcaagacacacacacacacacacacacacacacacacacacacacacacacaaatgaggttatgccaaaagggcacaagagcatactgaaggagctccaaacagccaaagctagaagaattcaaccaacgaaatagacaaagcagtactggattatgaacccaagtagaagctgggtgcagtgactcacacctgtaatcccagcactttgggaggccgaagtaggtggatcacctgaggtcaggagttcgagaccagcctggccaacatgatgaaactcagtctctactaaaaatacacaaattagccaggcatggtggtgcatgcttgtaatcccaactactcgggaggctaaggcagcagaaccacttgaacccaggaggtagaggttgcagtaagccgagatcatgccactgcactccagcctgggcaacagagcaagactccatctcaaaaacaaaaacaaaacaaaacaaaaaaacacaaaataaacccaagtagaaaataaatatcaatgggttcatactaatttgaataaatgattgtataaataaatgtggaagaaggaacatatatcctgtgtagaataattccaaataaattatgtttatattccatccttgaggaggtggagtataactccctgattttttcatgcggccttcacataatgattccttccaaagagttcagcatggaaaggggagagaaggagcaactttccagtggagacacctgactaacactaccttagccaggtgatcaaggccagcatcagctgtggtaaggcatgtggacggcaggtactcttgatatsatgagatgagagggsagctttacctctccggtcttccttccactaaccaatagccccactcttttttttattattatttacttttttttggagacagggtcttgctctctcacccagactagagtgcagtggcaccgtaatagctcactgcagcctgcaactcctgggctcaagtgattctcctgcctcagcctcccgaaatgctgggattacaggcaccaaccaccacacccagctatttttttaatttttaaaaaatgtttcattttttatttttatggatgcataatagtgcataatagtatacatattgatggggcacatttgatattctgattacaagcgcacaatgtgcgatgatcaaatcagggtaattgagatacttatcacctcaagcatttatcatttctttaatagccctagtcttaccaggagaaaaaacattagacaaattctaatcctgcagtatgcctgcccaggactcctcaaaaccgtcaaggtcatcaaaaacaaggacagtcttataaactgtcacagccacaaaaagcctaaggatatgtgaggactcagtgcagtgtggggtcctgggtgggattctggaacagaaaaaggacattaggtaaaaactaaagaagcccaaataagctattgtattaagtctgttttcacactgctgataaaaacataccctagactgggcaatttacaaaagaaagacattcaattggactcacagttccacgtggctgggaaggattcacaataatggcagaagacaaggaggagcaagtcacatcttacatggatggtggcaggcaaagagggcttgggcagggaaattcccatttttaaaaccatcagatctgatgagactcattcactatcacaagaacagtgcaggaaagacccgcctccataattcagtcacctcccaccagattctaaaattctaaattgaaaagcttatttaaaaatcaagcagagcacatatatgtaaaatgcatatgaataaaagagatgactatgacaaaaatggttaggagtatgtgagaccagagaagaagggaaagggcctctctctatccacatagccaggccccgttccatgggaggttagagagtgagacacacgatttgaacctcacagcagtcctagaagggagagcacaactctctcccccattttgcatataagaaaatgaaggcactagcgacttggtcattcagatggtaagtcgtagaaccaggatttgaacctgcggccactcaggcaccagagctgctgctctataccaccacaccacactgcctcccttgcaggaaggtcaggatctttggcttcctcgaagctccaaacaaaccctgataacttgcttcccgtcttccttccacaccacccagccagggcaagccctgggagatgcttcaggcttagttagaaaagctctgaaagcagggtgcccyrgtggcctccctaggtccctgactctctcctctctctcttgccacccttgcaggctaaatgggagctatgaagctctgaagggaggcagcgccatcgaggccatggaagacttcacygggggtgtggcagagaccttccaaactaaagaggcccccgagaacttctatgagattctagagaaggctttgaagagaggctccctgctgggctgcttcaytgatgtaagttgctcatgggctcccattccaggcactatgctgrggctgcatagtgcattccaggcactatgctggggctgtaccaggtaccccagccacacccaaggaggggcataactcttgggggcagtgtttattcctgctaattaaaacacaagttttggggggaggtgggagggatagcattaggagatatacctagtgctaaatgactagttaatgggtgcagcacaccaacatggcacaggtatacatatgtaacaaacctgcacgttgtgcacatgtaccctaaaacttaaagwataataaataaataaataaataaataaataaataaataaataaataaaaaataaaataaaataaaataaaaataaataaataaaacacaagttttaaccaagcatggtggtgtgtgtctggagtctgaggcaggaggatcccttgagcccaggagtttgaggccgcagtgaactatgatcgtgtcactgctctccaggctgggtgacagatcaagaccctgtctctaataaataaataacaaataaaacacaagtttttatttaatagtcgtcaaataacaaaggtaagatgtacttgctgtatcagatggaacaatcttgaggcccatacaggcgcatttttacctccctcccacccgtttctcagctgcctctgttctccagctccaccctgggactgggatcacctggcctgtatccttcccagctctctatctgctcgtacaaacaggcacacacttccacacacaaacatcaaggtcagttggtttgattttactgaaaygggatcttyctatctagttttctgaaatttgttttttttttttcatttcatgtactatgaaaaaaatagcagatagaagtctaatgatattttttaaaattttctctatgcatacaaacacacacacttataattttatctcatctttttaaaactttttgttgttttttatggactgctatgacactatgtattttttttaatcaattctagttttctgtttcctcttagattagccttggggtctgttttttgctaatgaattagccagttcctctgcactttcaggtttgtgacgcagagctgtgtgtcctgttgttatattcttcttttcgtctctgggatgtatgtgattgtgtcttctctctcacactatactacatgaaggtgacaagttgttctgtttggggacaaaatagtgaactgttctttggagtccacactggaagcgagcgcctccccatcctgggaagagactggaacttgcttcatgtcactgctaaacatcctaggggagccccgtgcatagcccacgcacatggcctgcacctggggcagcagaaggggctggaggttgtgacygggccaggcatgtagctgggtctgatccagcaggggaggcttgacttagacggtgggtgtgackctgctyttyccatgttttagaccagaagtrctgcagaatctgaggcccggacgccgtttggtcttattaagggtcatgcctacagtgtaacgggaattgaccaggtaggcgacttgaactccaactgcaggctatggggagacatgtgacaatgctaatcccttaggcatttattcagtgcattgcagtttaaatgtctgcctttcaggcatttcagagattatgtcacctaaagaggcaggctggaattcaaaacggcaagccaggaaagagagaaaccatgtgattccaccgcagcacaaaactcgtttagcagctgtaagcgcctggtctttgtttatttttaatttcctttctttcccaattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaacttatatggggattttcttccatctctaccacccctgagacagcaagaccaactcctcctcctccttctcagcctactcaacrtgaagataataaggatgaagacctttacaatkacccagttccacttaataaatagtaaatgtatttcctcttccctatgattttcttgataacatttcttttctctggcttatttattgtaagaatacagtatataatataaataattataaaacatgttaattggttctttaygttatcgataagacttctggtcaatggtaggctattcggagttcagctttagggaatacaagattttttgacaatgcaggagggttggcaccccaacccctgacattgttccaggatcacctgtaatacgatttattgtaaggcattggctcatgcaattgtgaagagtaagaagtcccacgatctgctctctgcaaactggaggcccaagaaagccagtggtgtagttctggtctgagtctgaaaggaaggcctagccaccaggaacaccaatggtaaaagtcccagtctgagggcaggagagacggatgtcccagctcaggcacccaggaagagagagtgaattcccccttcctctgcctttttgttcwggtcaggtcttcacagatgagatgaggcccacctacactggggagggcaatctgttttactcaatcaacttaaatttcatgtcacccagaagcacccttgcagacacaaccagaataaccttaaagcaaatatctgggcaccccatggcccagtcaagttgacacataaaattaatcaccacgagtcccattcttgtagctgtagcccagggtggaactgatcctgggggacacccagactccacacagcaccaccctgacttcaagggagctgttggttaggaggagagatccttgaggggcacaaggggaagagwaagaaagaattgaatgaaagaggaggacaagaagccaaaggtatcactctgccagactcaagctcagcaaagcccagcagcctgccttgcccactccatgcctccctggaccagtctcaagcccagtacttagaaggtgcagatgcacctggtcttctgtagccacccaccttttgagtgacatcctctgaatgcgtggggagtaaagaacactgaagggagacyctgcccttcctcctcactggagccaaggtgtgagacgccrttggactctttgggattctttagaatgttagctatttgtgttggctcctttgtcctccttcaccatccatagatgacttgcagattgctcactcaagcrggcatgtgatgtttctaggttagatcttctacgtattccacgtaacaacagaaacctctcatcatcttggtttgcttgattttgcttcctctcccccctacaaggaactcacctgccctgaacctttcaaattaaatgagcccctttaatggtgagccacaagccacatcttggactcygaagagttgatgttacttgaatttttacacatccaaaatataatttatgccaaatgcatgaggataaaacattctgactgctacagtttctggttagtygataactagaagtcttttactttcacyctctctcctctaaaacccttctcaaatgcattggcccttgtccctgctcccaggcagagcctgagggcacacaggctcaagggtgattgaggtgaacagcaggaatcctcacagacacctgaaataaggagaatattgggtctagaagacrtaaaagctgtttttgtttattgttgtgtttaaatccccaacatgtgcttattttcttatcattcatctgtgcatgggatgctaggatgaagaaagttcagtaatagttccatgagcacctttgaggactactctttaccattcaytctgctagatgctgaagatgcctaagacttggctcctgcctctagggagatccaagtctagagagaaacccatttttagattcatatggactaatttcttgttaattgcaattctactttacttcccagatgtggcataagcattttggtgcttaatataatatcattggcaatagtagcaattattcaataggaattagaaggttccaagggctggttaagaactggcgaacttctacataccttcagcagcattttaggcaagagactttcaacagaaccagttctggatggagctggtccacctggagctcatagatgaatgtggccaaacctccaccatatttatcatttcacacttccctcatgcttttcccttctaggtaagcttccgaggccagagaatcgagctcatccgaatccggaacccttggggccaggttgagtggaacgggtcrtggagcgacaggtcagtcaccctatcctgcctctctggctggttcccggggcgtgtggggccaragctggcttgtgcagacatgtgaaggagtggcctgtctactatcctcccgggctctgactcaggatcctgtccygattctgaggtgccccttcttcctcccctttcagccctcaggcccaccttgcatcaaggttgattctcaagaaagacttttacaacagcactctaactttcacgaattgtatttatgtcaatacataaatgtgttacctcccatggtgatgtttataacccagtgatatggtgaaaagctttatctgtagttgtgagtaactccagtaagcagtgtgcatatgcataartgcgtgtgtgtttgtgtgtgtgtgtgtatttggagtgtcggaatccctgaaatattacctagcatgtaactataggattctctctgatggtcactgaccatggcagaggcccaatagcccagcagagaaatagaagtgaggctgagcatggtggctcatgcctataattccaacacgtcagcaagccgaggtgggaggatcacttgagtatgagagattgaggctgcagggagctatgattgcaccactgcattccagcctgggcaacagagcatgttgaccccatctctttttttttttttttttaaaggaaaaaaaatagaggacatggaattggaattttatctattacagagctgttaaccagagttttggcccccagttatcaagaaaggtctgccttttctgtgtgtgtccccacagctcctccagctctggtcccttgggaagtggaccaggtgactaagaaccagggatgtttgtgtgggtgcgtggcagggcctgcctgargctgttgctcgtccgctgcttgttgggctcctgaagccctttcctgccacatccatggcccctgagcttctggggaaatctgaagctagtctagaacttggttaaaactgagccagtgtttgtcttcagtccagacacagctaccaggtcrccagacatggtgcagccgctgctgtattagccagaccccagcgtgagggcagggcacacaggcctgtgctttccaggctgtcatkgtccccatggaggctctcgtcccaccatcctctgctctggccttggctgccgccttctgagaaccaagaagcattggcagagatgagctgagatgggttgaggaggaaagagattggcctccctctcctggcagaaatggaaagcacagagaactactgaaaccaaaattagtgagactgcgtcacgttgtaagatgtgcagtgcccctcaactttgagatcgtagcctataaagggaaaatgggccattgtctcccattttctgggactcacagaggtagaaatcaagaaagkgactgagagccaaggctggaataaaatttgtcttccactcatgcagcctccatgggtgatgggaggggcaggcgccrtcccgaytccctgacttygctgtgctgctggtgacatgtgagtagggttgaaggcaccgcatggccagcctgtcaggccaattatctgggtgtgagccacttaggataatggctccaaaagaaaataatggctgccagttccactcttctgaccctggcccgagcacctggagacaggtcccggctgatcctccccttggatcacctgagcactcccctgaggttgagttgagatcacaggatgagagggagctgccacgttggctgtagcaccgcaacagtggtgacctactttgaactatttggaggcggctgtgggagtcacagaaaatgcaatgaacttggagtcacaaatcctgagtttggagagtgacaggcagccattcctacccctactcttccctgagagtgtttccatgggcctacctgagccctcttatctgcaggacgggcacacctagctcacagaaccccacctggcttgccagcgaggtcacatacaaaaggtgccgggtacagacaacatcaagcatgggcaggtgtaaggcattatcacctttccaagtgtcagcttgtccattaaggaagggccaagtactgctccaggtcacatggcaagttggaggccaagcacgaaagtcagcagacttgtggcttccagccgggctcttctgctaccccacgggcatgcaatgccttgtgactatcccaagataatcttccatgtcggtggttcagatcatcctcaggggtattttatccatcagcaacacttggagatgtactttctgaccagccctcttatttgggggccagtggctcacctgccgctacatccctgggtgcatttttgggacccagtgagtagttactaagcaggtcttatttcctccataaccgcacactgtgggttccacatcaaggccattgttgctcttcatcatgacctctgcctgaacaccaattttgtttactcctagttctccggagtggcgttctgttggtccagctgagcagaarcgtctgtgtcacactgctctggatgatggggaattctggtaccgtgcttgttcctgtgttaactgcagatacgagcaagtcccatggccctggggcgtaaggagcactgtgcttctctctcgctttcctttttctttctttctttctttttttttttttttttttgagacggagttttgttcttattgcccaggctggagtgcagtggtgcgatctcgtctcactgcaacctctgcctcccaggttcaagtgatactcctgcytcagcctcccaagcagctgagagtacaggcatgcgccaccacgcccgactcattttgtatctktagtagagatggggtttcaccgtgttggccaggctagtctcgaacccctgacctcagagaaaccacccaccttggcctcccaaagtgctggaattacaggtatgagcyaccacgcccagccttctctctccatttttggcaaatcaaattcatctgtctcagactcctcatatacacccagattagagggaaatttaatctccctcctgtcttggtgggggctcaccccagctctcggtttgttgaagagtcttcagggggttcctgcaatccaatagaggaagagcctctggtctctagcctgacacacctccttggcactctttgtcatccaggtttacacagtgaatttgaagacaggcagccctactgctcacaggatccattccctccacacccatcttgatgagaggtacctttgaaggcagctgccctgagagcatctaaagatatcgacctacgtaggaagtaaacatttctactctggactttcccttggcctgaatctctttgtttaattgaacatttgtattgggccttcatctctagaatctttttcagtcttatttcttcctgtttgggttctagaagttggcccttctaaccctgtgagaccacaaatttctggtttctggctctattccctttcatgtgctccaaccaatcaagtcttgcctgagctcatctctttcttgtaacagcttttaaaatacaacagcagggcacggtggctcacgcctgtaatcccagcactttgggaggccaaggcgggtggatcacgaggtcaggagattgaaaccatcctggctaacacagtgaaaccccacccctgctaaaaatacaaaaaattagccaggggtggtggtgagtgcctatagtcccagctacttgggaggctgaggcaggagaatggcgtgaacccaggaggtggagcttgcagtgagccgagattgcatcactgcactctagcctggacaacagagtgatactccatctcaaaaaaaaaaaaaaaaaatactacaacccaaaaccatgactattccagcctttttcattcttttcccatagaacacagcctcagtagtgatttgttctgccttctgtatttttatagttgtcttagtctatttgggtggctataaaaaaataccatagactgagtggcttacaaagaacaggaatttatttctcacagttctagataccaggaagtccaagaagatgacacaggcagtacctgtatctgtggagggccctgtttctgatttatagatggatccttctcactctgtcctcacatggtagaaagagggcaaggcagctctctggggcctcttttataatggcactaaccccatccatgagggctccaccctcacaacctagtcacctcccaaaggccccacctcctgacactactacttcgagggttaggattcaacatatgaatttaggggagaccacaaacattcagtccataacaacatgcaacagatttacccaatgttttgccactgcataacatagataaccattttccagctcgaacagttccatgatccctcttgctcaactgctaacatattttagaatttcgttgtggcagttctgtaattcaaggcaccaatgactcaaggtaacactagctgcagtagtgaatagaccccaaatatataaaggctcaaacacagtaaagttttttcctcactcattatgacagtccagggaggatgttcatattctgtgggtggctctgttcatacagtgattcaggaacccaaacgccttctattgtgtggctctgccatcttctarggtcacgtcatcatctgcacatagccagcagaagagaagaataaaataaaacattgaaaaagacactctcactttctaaaaatcttgactcagaagtaaatgcgtcacggctcacattctactcccaaatggaaggagtggggtgcagtcttggtcctgtgctgatgactgccagccatctctgcctcgggaaccatgagggtttaggttccccagatttgtggaacacatgcagggtgcttgagagattcccaagctgtcaaattagaaattacagataaactttgaattttgaagtacaggggactttgagttagggggttacaagagaggagcaaaaactgcaggaagaaagctgagttctggaattagtamcatcacagtaattgctgcatatgagcaggaggtagaaaccagagtttgagaggctacctgaggtcaggctagtggaaagaaggtctgrtgcagacggtgggagaagccgggcagaggaaactcggaaattcacagcaggargctccacaaagaagagcgtccatgtgagtgatccattgccctgcccctcttgaaggagcagccccaacaccwgggctgagcctgcccaaggtgatgggtggtgttaaatcatgcactctgtgcgtggagcccttcctcctggaatcctgactctgaagccctgtgtagcctctttccattcttcaccrgctctaggatgtacctcctgcaactctcttctctccccttacgtatgaattccccccttcttctgaatcattccccttagcactccaacactatcatttctcctacctgcaaagaaaaaaaaagcctctcttgacccactcaagtgaccaacccagctctctcctgtcctctacagcaagcccgccagttcctcttctcccttactctctcgactccactcagctatgagtgtgccccaccaccccactmaccctgatcttgccagggacgccaccgactctcactttgctcgatcagattatcttgatccatcaggagcccttgacgtgctggattgcgggggaccacacgccctggtggtcctcctcctacctgagctccttctcaacatcctgtcctggccccctctcatctccctaacctgttagcactgaggtgtcccaggaccccatccatggtccccctcctggctgtctattcccactctttaggcgtctcgtctggtctcttgactttaaaaactatctttacactaattctcaggtttctatcttcagctcctttccccaggattccagagtcacatattcaatggtctactttaacatctctccttgaatgtataatagacatctcacattcacgtgcccaaacctgacctcctgagcttctctctcaaactgccccaccacagccttccccatctccatccttccagtcactcaaatcaaacatcctgattcctttcattcgctccttccccacatccagtccattagcaaatcctataaaatttacctttggaatgtgtctcaaatctggccactgttcatcacctcccataccatcagcctggaccaagccacccttgtctctcacttggacaccggcactaacttcctagctgcctctctgcttccacttgtgtccccaaagtctgttctcaacacagcagccatggagcatgtgactcctctgtttactgccttctaaaagctctccatcttctcagagtcaaagccaaaatccctatacctatttgacgtactatgatctcttgatcttattccttacagacacctcgtgccttcctggtgttctgtgagcacctcaagcacctctctgcctcggggccttgctgtccatctgcctagacccccagagagctgccctgcccaggacctggtagttcaggtctccactcagaatgtgccccatcagtaagggcttctcttacctccctgtttaaaatagcatcccacccctacgctcccatccttcagcccaatttggtttttctctgtagcacttaacatctacaatcaatctatatttttagcctggtttttacctttttaacctttattttacttttaaaaaattttccatctccccacactttgcagtccccccactccttgcggacaggaacaagatgatttaatgaataagtgaatgatttaatgaatgagtgaatggatgatgccctcactcttgccctcctgtgcatcgtgtctctcmgctttgctgcaggatggcatttmaggacttcaaggcccamtttgataaagtggagatctgcaacctcactcccgatgccctgraggaagacgcgatccacaaatgggaggtgacggtccatcagggaagctgggttcgcggctccacggctgggggctgccgcaatttcctgggtaggtaggctgcctgtcactctctctgccactcccaagtgtcccttccaactcaggacaccaaaggataagggccgggtcctcagagaaagcctgaaacatagtaaggtttcaaaagtgactggggaaaaaaggctgcaaagatttagttggataagaattgtttggggaaacctcctttgttttaccacttaggttattttccattacaagtaatggaaagcatgactcatgccagtttagcaatagaaaggatttgttatctcacataattgaagagctcagaggaaaagtagggtgggcttcaggcacagttctatcagggccctggttccatttgcttgtaattcactgttctgccctcttttatgtgttgacttctttctctgtctggctttctttataatcacaggagggctggcagcagtatccagggcttcctgagccctcattcacacgaacagcaagagctcctgggggtatcaaaaaaaagccctcaacttccctctaattggaaattccttgaactaatattgtccagtgaatgctatgcattgattggctttgtccaatcctcggtggcaaaaaggactggcacagaccaatcagaattcatgctggagcagtgctcgaggtcaatcctactcaaacggcccaccatcaagtagatgccagggggacaaccagaagtccactgcactctcctttgaaatactaagtggaaaaaaaactgatagaacaagctttagcagactagacccagaagaatgtccttaagaaactgcataggaaatggttgaagagaaggtggaaatgaaagagaggatattttgcattcccgttggggattatcaaaagtagggtaggaggacttattgaacagggagagaaggtattactttctcatgtttggtaggacatataatgagggcagataggtgtatgtgcgtgtgtgtgtgtgtgtgtgtgtgtgtgtgtgtgtggtctttgtgggttgttttttaaaaggggaaaataatctacctctcccaaatgacagataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgaggtaggtgggaaccacactgcatttcagagttctccatctgagttctaaattcgcggctcctcctcggtctcacacccgagactcaaccaagagtccatgaattgtgtccgaaaagccaagaggaacttccctaggaaacccctccctttcttgcccattgcagtgccctgacaaagaygaacacctgaacaaagacttcttcagataccacgcttctcgggccagaagcaagacgttcatcaacctgagagaagtctccgaccggttcaagctgccccctggggagtacatcckgattcccagcacttttgagccccaccaggaagctgatttctgtctgagaatcttttcagagaaaaaagccattacccggtgagtcagaggaacagcttccagaatcccacttcttttagtggtttattcacacagaagtcacctgggaactgctggagccaagactccattcttccctttcccatgtgtacctgagaaacaaggcaggatggtttctttcttttcttttatttattattaatttttttttttgaaatgaagtttcactcttgttgcccaggctggagtgcaatggtgccatctcagctcactgcaacctccacctcccaggttcaagcaattctcctggctcatcctcccgagtagcaaggattacaggcacccaccaccacacccggctaattttttttgtatttttagtagagacggggtttcaccatgttagccaggctggtctcgaactcctgaccttaggtgatccacccgcctcagcctcccaaagtgctgggattacaggagtgagccaccacgccaggctgcaggacactttcttagcttatctgcaaggcaaggcacatatcccttctagctctgctcctcgctccctcaagcaaaccattgaaaagttgctgttttctactggtcccagagtcatgctcacaagacattcttgggtggagaccttcatttttcagaccctattaccaagaagcttcttggataagagccacatgcagggatgctagacatttctgggcatgatgaagggggtggctattgcaaatttcaagaatgacatgttctttcagctccaatttaaataaatgttggcaaatctgcctctcattttacatacccaatattccaccacattttcctcacagtgtcttagcgaaattactttatatcagttacttctatggaaaatgtttcccattactgcccattcaccattggttgctctgtggcacagggggaaaaatggttcaagacagaggaatccatttcttttcccgatgacaatattctaaagattaaggagaacgctaaaatctgctaattctgtatttaagctagataagtctccaacaaaagatcaatctgcacagagttaacaagagagacagctgtgaatacatgactcactctagtttcatctttcgtttagtgagagagaattagattggtggcatgcattgaaaagactctcaattatgaagtctagtggggtttcccaagctgattacaaaaggcatggttctttctcttggctaaatagatgcagaaaagtctttaatttttaaacactctaccagagaatttttctccagccttctcccagatactagtacaagatggggatgaatatcctagtatctgttcacacaaaagtaccctgtatgagatccatgcagattgacatctcttatgggtggcaagaacaagagagacccaagttatgccaatgccatgcctcttgttctctatcttattagtggggtgagctcagagtcactgacatgcataaggtgacttgtacatggcaaaaaactccatactcaatcttgctctgaacaagattctttaatctgctatgatattgagtataagaatcagctctgtagcttggtaacaaaaattcacactgagctgtgttygcattggtttagctctcagacagactcctgattaaacaaacagaagttctgaaagggttatgttatggatgcccaggggatgaggaggaaagggaggactacccccaattgatgttaatgtttatttgtattccctttgactttgtatcagtttttctttgagagcccttcaagttttagtctatgagactgtattcttccaaatgtttttagcatcatcaaaagctgaagcctgctcctcctcttaatattactactatccaaatattacaagtccccctaaatatgtgaatagcaaaaaaacatgattgcatcatttttcctctttttccctaacataagcacagagacacccatccctccccaaccccaccagtggaatcaggaatttacatctgtgatgagaggcaggagttagggatgcagcttcaaaaggtgrtctttaggccaggcacggtggctcatgcctgtaatcccagcactttgggaggccgaggcaggaggatcacctgaagtcaggagtttgagaccagcctggccaacacagagaaaccctatctctactaaaaatacaaaattagctgggcatggtggcacgtgcctgtaatcccagctaattgggaggctgaggcaggagaatcacttaaaacccaggaggcagaggttgcagtgagccgagatcatgccattgcactccagcctgtgccacagagtgagactccgtctaaaaaaaawggtggtttttttggttctgattcaactttgtaatcttttaaaatgcaccccctccccagtgcctaccactcaataggctgaatggtctccaacagatatgtatctcctttgaagatgcaaagttcatggagagtgaatgtgtaatgcaactgcactgtttatgcgtctttggaggtgctgctattctacaaaacactttatcagttgcccttgttaaagtacattaaagaaataaggagtgactgctggcttaacttcttttagtttcataaatccagaattcacaagttcttggtgatggctgatttagtttgaatatgtgtccccatcaaatctgaagttgaattgtaatccccaatgttggaggtggagcctggtgggagatgtttgggtcatgggtgtggatccctcatggcttggtgctatcctcgtgatactgagtgaattcttgtgagatgtggttaatagtatgtggcacctgccccacccctgctcctgcttttgccatgtgacatgactcttcccccttctgccatgattgtagtttcctaggtctccctagaagtcaaggagttaagttaacttctagggaatacaccatgcttctttgtaaagccaattgaacctcttttctttgtaaattagtsttaggtatttctttatagcagtacaagaacagcctaatacagaaaattggtacagaagagtggggcattgttataaagataactgaaaatgtggaagtgactttggaagtagataacaggcagaggttggaagagtttgaaggcctcagaagaagacaggaagatgaggaaaagtttataacttcttagaggctggttaaatagttatggcctaactgttgacagtgatatgaacagtgaagttcaggctgccgaggtctcagatggaaaggaggaactcattgggaactgaagcaaaggttatgtgtgttatgccctagcaaagaacttggctgaattgtgtccatgccctagggatctgtggaagtttgaacgtcatagtgatgatttagggtatctggaagaagaaatgtctaagcagcaaagcattcaggatgtgacctggctgcttctaacaacctatactcagatatgggagcaaagatatgasttaaagctggaatatatacatttaaaagggaagcagggcataaaaatttggaaaatttgcagcctggctatatagcagagaaagaaaaagctttttcgagagaggaattcaagcaggctatggagcaaccacttgctagagatatttacataactaaaaagagccaagtgctataaccaagacaatggggaaaaggcctcaaaggcattttagagacctttgcagcagcacctcctcccatcacaggccgagaggcctaagaggaaaaaaatggcttcatgggccaggcctagggccccactgctctatgcagcctcaggacactgttacctgcatcccagctgctccagctccagtctctgctcaaaggcaccagatacagtttgggctactgcttcagagggtgcaagagtgcaagccataagccttgacagcttccatatggtgttaagcctgcaggcacacagagtgcaagactgaatgaggcttggcagcctccacctagatttcagaggatgtatggaaaagcctgcatgcctaggcaaaagcytgctgcagggacagagccctcacagagaacttctactagggctatgcagatggggaaatgtgaggttcaaggtctcgcacagagtccccactggggtactgcctagtggaactgtgggaaggcggycatcatcctccagacccaagaatggtggatccactggcagcttgcaccttgagcctggaaaagccacaggtactcaacaacccatgacagcagccaaagtcacagggacagagcttcccaaggccttgggatcccaccctttgtaccagtgttccctggatgtaggacatggagtcaaaggagatcactttggagctttaagatttaatgactgccctgctgggtttcaaacttgcatggggcctgtagcccctttcttttggccttttggaatgggaatgtttacccaatgcctatactcccattgtattttggaagtataaaatggaatttgtatatcttggaacttgattttgatttgacaggctcataggtgatgggacttgccttatctcagrtgagactttggactttggaattttgagttaatgctggaatgacttaagactttgggggttattgggaaggcataattatattttgcagtgtgagaaggacatgagatttgagggcccatagcagaatgatagagtttgaatatgtgtccccaccaaatctgatgttgaattgtaatccccagtgttaggggtggggcttgatgggaggtgtttgggtcatgggggcggatctctcatggcttggtgctgtcttcacgatagtgagtttgcacgagatctggttgtttaagggtatttggcaactcccccataccaccctgctcctgctttttccatgtgacttgcctgctcccccttcaccttctgcaataattgtaagtttcctgaggcctccttagaagcagaacggatgccagcactgtgctcctgtaaagcctgtagaaccatgagccaatcaaatctcttttctttataaattacctagtctctgttatttctctatagccatgcaagaatggtctaacacaatggctgtccctcttatttacattctgagcaaggtctgagtgactaagggtgggggtgtcaatgcatggggtctgcaaactctgtgaaatgtaaacagcactgaacaataagggattcaaagggacagaaccttcccaggctctgggctcttcagctctgcagatcccaatgggaagttaatccacaattgaggcagtgtgtttttctgcccctacagggatatggatggaaatgtagacattgaccttcctgaggtgagtcttctgatgttgctatggagtatgggattcaggtgatggttctggaaaccttccttctaatcacagcatcatgtaaaactctgcagttcagggatggttacatgcaatcaagtaagcatctatgattctaacctcctggagaccaagatgtgtgtgttctagtctgtgctcttctagtccacaaggacctggcatgggagtgaggtgggtgcttggtataaagttctgttcsatgtcatcttcctctgtgctactgtcaactgaaataacaaacacagagacactctctaaaagaaaagctatttatttagggataaagcactgcaatgggaaggtgcatgccatagtaaactatgcacctatttggggaggtaaaggaggacaaaggtttttaaagaaaaaatgagaaggattacataattgttttgaaataattatccttggctacaaagatcaataacaaaagtgaagccagtctgatgttggacaggcagttgctaggcagaggtagaagtatttttgtgtatggttgcgagggcctctgtgaaaggttgtgggttttgcagccttttgtgatatttttgttatcaggcaaataagcatgagaaccttctggccttcccgagctctatttgtcagggttttcttaacattagtgacttcattttgactcaataactttcacactaccaactccacctgagagaaggctgccgcttctgaagtgggtagacttttaattgtattttaagaaatctaatcaatgaaaagaaaaccagagaggcagggagatgttttttactgtggactcaggggaacayattacatctcccctatgttatgtggtgtggaaggggtgacatgggggtggctttaccctcgtccaagggctggaggactcgcaagaggccctgagatactatagctggaaatagtctgacacgtccagggacagcagagatctgcttttaggagggaatttgctgttccatgctggggcacagcttattaatggtgctaaaaaaccaaagaaaccaaaaatcacccaaaacatttactgagctctttctatataccaagcccagagcttagtggtagaaacagactcttgccttcaacgattttaccagctatcaaaacagatgatgaagtaagtcattccagtccagggtggtaagaagtaagccagaggaagggcaggaagcatgaaaatccaatggccaggacctaacttaggcacgggtcaaggtcctttggcctcctcgtctgtaaggcagaagggctccacaggtccagctaataaagtccttctagtctcaccttctaaaagagccttcatgagaaaatgttcctcacgctacaggacgcagcttgtgcacacygcctcaggagggtgacatggggctgggcacacaggstcctggcttctttcctgctatttttgtcatgtttcttttttgtggatcattttgtgcaagtttctttggctgttttttagcctccaaagccaactccacctgaccaggagacagaggaggagcagyggtttcgggctctgtttgaacaagtcgctggtgaggtaggacatgccccacttccatctccccaccagsctgagggcctggacctgcttcctagcaaagggttgcagtcgtggggttggtcagcaacgtcatcctgaggcatgatggagcttgttgcaaagtaagaccagcactgatcattcaaggcccaaagaccaccctgtttacaacatttacttacacagtctgcggctgtggatggggccagtgagcccaaagaagcttggaataggcccagacgctttgttttttagttctgttttgctttagacagagtctcactcttttaccctggctggagtgcagtggyataagcctagctcactgcagcctcaaactcatgggctcaagagatcctatcacctcagcttcctgagtagccgggactataggcacatgccatcatgcttagctaattaaaaaaataaataataaagagtcttgctatgttgcccaggctggtctcaaactcctaggctcaagcaatcctctggcctcagcctcccaaagtgctgggattacagtcatgagctaccacgcctggccccaggtgctttctttgggaggctagagcaagccttgaagaggtgactcctttgaactctgcctgaaaatcactgccattagaatactctgtttgctgtagtaaaggggatcatgttcaaggaggtccctattcaattgcaacttcctgtcccccaccctatcctagctctttccactgctcagcttcctttttagggacactggatggagcctcacacagatccaggctcttcctccacctgctggggtcaggggagggaagtctttctagaaactgccccagaggtgctctcttggagccataaatacaatgagctgatgaactaattcatgtcaaggtgctaatgactctattagcttcatgtgtttccccaaactggggttcctgaattatgaaaggggtcacctggaggggtgatatctaaacctaggggctgtctgatggtagtatattaggcactgcaataaacaggcaagrcagggagattaggggaccacaggatcggatggagaaaatgggggctcatgtgactgcttaaagcacagcaggaaggtggctgagcgyagccctgggcgggacagagcatggtgaggggggaaggcagtggtgacctccctgctccaggtgctatctggagcatgctgggtcagacccagcaagacaggctcagaggagttaaagaggttcatgcgggtgcgcagaagttgtcagatggagatccagagtttggaagggaagcggtgaatgttgcaggagtttcagtcgacctttattaacaaccaaaaagtacctctagagttcagccctccttgactcatgtcctgcttttcttccaagtagttggatgacttgggcacatggctccatttctctttcctcctctttcagtgggggcctggctggggcagtgctttcttaccaacaccaaacatcccaaacccccattccccaggcccagaggcttcaggacggacatgtgttagaagcactccacagcataacacacggctagcgcaaaaccctgactaaaatgaggtctatgtcagtgctactcaaacacacatgtgcataaagtcacctgggcatcctgggaaaaaaaacacagattcctcatcaataggtcaagagcatcctgggcaacatagggagagcccatctctgcaaaaataatcagcccagcatggtggtgcatgcctatagtcccagctacttgggaggctgaggtaggaggattgcttgagcatgggaaattgaggctgcagtcagctgtggtcacaccactaatactccaatctggatgacagagcaagaccctgtatcaaaaaaaaaaaaaaaaaaaaaaaaaaagcctgagtctcagggcaaggtctgagactctccatttctaaccagcttctggggtgggggctgctgagatttcctggagtgccttagatccatgattctgaaattcacccttattcttaattctaaatcaactcctaggtcttaaaaataggaccatattctcaggtcctctgatttcaagattccctggggtaagccccagatgcgggactattttaaagctctgcaggtggttctactgtacagaggaagactcagtctggttttcccaaactgcctccaacataggaatcatctgaggagcttaggacaattccaggagttggttctgaccctcagggaagctgggaaaccactgccttgccctgcccagcttttcatgcgctttcctgggttgggatgtctctcaagttaggctctctcctagttgggctggcatgyccctaaaacatgtgacatatgagacacatagctgcagctacacaggagataggtacatctgcccacagcagggtcctgaaggctggtctgtcactggagccaaatgaagctcagaactgatttaaaacaaaaataaactataaaagaaggtgccaagggctataamaaacaattgtctccacttcaacaggacatggaggtgacagcagaggaacttgagtatgttttaaatgctgtgctgcaaaagagtaagtgccaaccccatcrgggtcctggggcacctatggagggacaagcgaccacactgcctgggtcccctccctgctcctccgagccgcagatctgcttcccagggctgatttgtaggtagactttaaaaatagctttcattgtttgttttcctgattccaaaaacgatgcaggtttatagtagaaaattcttaaaaatgcagaaaagcctaatgacaaagatagtcacaaatgatctcaccaccataaataaccactcttaacatatgtgtatctgcatgtatgtacatgtgtgtcatatgcgtagacatataatgttagaatgtttcatcactccaacaagaaaccctttacccattaacagtgttaaccctgtacccatttcccccagccccaggcaaccactcatctaytttctctatagattctatttacatattctgaatattttatataaaaggaatcataggccgggtgyggtggctcacgcctgtaatcccagcactttgggaggccgagacaggcggatcacctaggtcaggagttcaagaccagcctggtcaacatggtgaaaccccatctctactaaaaataaacacacacacacacaatcagccaggtgtggttgtgggcacctgtaatcccagctgctcgggaagctgtggcaggagaattgcttaaacctgggaggtggagtttgcagtgaaccaagatcacaccgttgcactccaggctgggcaacagagcaatactccgtttcagggggaaaaaaaggaatcatacaatatgtggtcctttctgactggcttttctcacatggtgtgatgttttccaggtccatccatgctgtagcatgtatcaatgtctcattccttcttacagccagacaacattccatcgtatggatgggccctgttctgtttattcattcatctattggtggccacgtgggttgttaccggtttttggtcattatgaataatgcaactgtaaacactcctatacaagttttttgggtgggcatgtgtttttacttctcctgggtatatagttatgaggatggttccatcacaatgcaacagtctatggttacatggtggcataaccatcctcttaattatatgtttagttaagaggattgcttaactctatgtttaatgtttttaaaaactatccaactgttttctaaagtgactatttcacattttcaccagcagcagtatgggagtacaaatttctccaacaaatttaaatcctgccattaaatatgctgcaaaaacatgattcctaagggtcgtataatacttcattatatagacatagcctaaggtattgaccatgcctctctattggtcattatttcacttccaaatttttgccactataaataatatgatgacaaaaatcttcatatgtwattctttgctcggggttcttagaactagaataaatggatgaaggcgtattcccacttttattgcttttttcacatttagccaattttccttctgaaaggtcatgttaacttctactcctaccagcatcataagagagtagccacatcacagcccccaacagccctggatttagccacattattgggctttcagcagatgggtacataggtttatcttatcgggtcaactgaattcagctttcatgtgcaatttcagaaaaggacatcaaattcaagaagctaagcctgatctcctgtaaaaacatcatttccctgatggacgtatccttccaaatatttgagcagaaatagacatggatcctgggctttaagcacagtagagtaatcttcaatagtgcagactctccaagaacatgacatccttagccagcagaatagtcttcttcacagaaaataacccaaagctgggggacccccatgctgaaattggatcagaatcaagatgcacaagactgccyagtggtgggggtggggagcttttgaagggacttgggggtcttcttgccactttgggatcccatccaagggaacagagttctgtttttgtgaactttccrggaccacccccattccacttctgccgtttcccctcttcagagatttgtggtttaatcattaaaaccacttccccagggccccaaacctgtgcacccaggccagcccatcggccctccccctctgcagtcccagagctgaggtcccacgaggagcctcaggttgaaacactgctcatgtctcccttaacccacatggcacagaccagcggcaatgggaagctggagtttgatgaattcaaagtgttctgggacaagctgaagcagtggattgtatgtaacctggagcagggcttggcctctgggggacccagtgaacctagagcagaggggatttaaaatggtgcagcaggctgcaggctataggctagaggaattgtattyggacaggggagaagggaaaacagcatcatgctattccgatrcttacgggagtaccaccgtgcttccacccaagacgaaaaggaagacaaaagggagaccgacttcttttggaaggcccagtccaactgtggcctctgcggcccctagagggtagctcccccgggctggctgtcayccatttactgccaycagcgatgcctttcaggcacgctccttctcaaggcttctgctctccaccctttagaaccttttccttcggtttgatgctgacaagtccggcaccatrtctacctatgaactacggactgcactgaaagctgcaggtaaagaaaagactggagtacaggtggctgactgcatgccaggtactgcctgtgggcaacctgagcagatggcaggtcttctctctgctgcccaggaggtgggcctctgagcccagttggtgattcttaaggtcayggcccttggagtggtggcaccagggttcagacccaggactcacttcctgacaccagggccctcattttaaaccactgtgaacattggtagaaactttttaaatgtatctgctaaaaatgaacttggcctgccctctggaggcctcatagcctctgaccatgttttctggcccagtacttaacacatggctctttggtggcaagctgcagtgattccaaacttctcatttctgctctcagatggttgttatcgtggatgagacagagcatgcagcacccatggtttggggtccgcacgtccctctgccacctgtggccctgtcccgggttttatcagcatcagactctgaatccaaaatggatgactgcatcatagtttataccctgctcccttacccaaaggctgggctccaggtggcatttcccactcttgtccggtgctggatggctgtcggcatctctgtggtcccatgtcctgcacacacaaccgtagtttccacragcgctctgcagacctcccgcctgccgggctgcctgcgcttctcaccaagcacacctcacagataggggcctcctgaaccttttaaagtggttcyctcccagggaaagcaaaatctggaaacatgtccaggctcaggcctgataaaaggatgaagtatacacagccaggaccatctcgggtcctatgtgagggagaagaaaatcagatgatttataaatgagcaaagtgccaggctgagaaggggcgcctgattttcttaggggatgatgactctgtttccatggtaggaggaggaactgagcaggggacaaagggagcactcagagaggaggggcatggctgtgtctttcctaccctgacgtggtgtggggagaatcgcccctcatccccctcctctagccccaaacatcaggattctggccaaggctggcagccagcactgccgtgcaggctccagrgactctgtgctctgtgtctgacctgcctgctcctctgctggaattaggaagaagcagaaagaccctgggtggatttctgaacaatcctgtgaacacctcctagaaagtgaacatgtagacaaaaatgaaagggggaaagaaatcacttctaagggcactaattagaaatcaaagcactggccaggtgtggtggctcacacctgtaatgctagcactttgggaggcctaggtgggtggatcatgaggtcaggagtttgagatcagcctggccaacatgatgaaaccccgcctctactaaaaatacaaaattaaccagttgtggtggcaggtgcctgtagtcccagctactcaggaggctgcagcagaagaatcacttgaaatcagaaggcagaagttgcactgagccgagattgcaccactgcactccagcctgggcaacaagagtgaaactccatctcaaaaaaaaaaatctaaatatcaaatccagaaggaagttcactttgtctaaactcctcatttgacaatgaggaaaccaaagcccagagaactgaacccatatgccacggctggagcagtgccagggctcagatccaagcctcctggctatagcctgtcattcttcccccatcgtggatgtgtaggaatgggccctggcagagtatcattctccgtgggcagcagcatcccctccaagaaactttctagggccacagctggaagtgacctgagacatagaacrcgaggggaggctggtgtaggaatgaacttggggctcagacaccacccagtgttaagttcccccaaacaaagcttcctgtaaagtcagcgagactctatgggtgatgttagcatcaaaattaagatcacaaactcgctaaactcagaagccattaaacacagaaagcacgcctgagagtcccccgcacactcgcccctgcaccacagattcacactctcacgctgcattcacaccaagggcagcagtcccactgggtctggggaccccmgctttgaggagtgaaacagtggcttcctcttctgagccctctcctcagctgcctgggagctccctcaaaggtgcagactcacctcggggctcggatacagcgagtcctgggtctcctcctttgtccccacaggctttcagctgagcagccacctcctgcagctgattgtgctcaggtatgcggatgaggagctccagctggacttcgatgacttcctcaactgcctggtccggctggagaatgcgagccgtaagtgtccagcgaggctgagggtgcacctcggggtggcatcttcagtcaccctccatgagcgcatgagaaacagcctggttaaagtaatggcaaagatagaccacagagagccatggtctgatgtgtgtggacccatgggcctgtgcggttagctaaggagcagaatgtgccagcctcccctgcagcaygtttcttagcatcgcctttctttatacattcacagtgcctctgtgggaggatgatgggctggggcaggtttgtgccttgtgtttgaggaaaggttcaattgcaggtcaaatcccatcatagcatatagaaacaggagagtctcagtcccccttcctccccccttccccgccctgtaagccctagacattgacccagttatctcaaataagatttgttacaccacaaatagagagggattatgtgcccgtgcgcttcagtgtttgcagtttattgtcatagccatcctgcccctcaaaggtggttttgaaggtgaggctgagtgaagcatgtccagggcctgtaactcagtactggagtggctatgaggacatgccctgtgtgcaggtgccaaaggacccgtgccctcaagggtgcctcgtgcttggtttaatgttctggcgtttccatcttgaaagtcttcacaacttaggagcagggggccccgcatttccattttgtcctgcttggtattttctaatctgtgttccataggccacttcgaggtatgaatacttgattaaaaaaaaaaaaaaggcagggggctgggcacagtggctcacgcctgtaatcccagcactttgggaggttgaggcagttggatcgtgaggtcaggagctcgagaccagctcatagcgaaactttgtctctackaaaaatacaaaaaattagtcaaatgtggtggtatgcacctgtaatcccagctactcgggaggctgaggcaggagaaccccttgaacctgggaggtggaggttgcagtgagctgagatttgccactgcactccagcctgggcaacagtgggagactccatctcaaaaatataaataaataaataaataaataaataaataaataaataaataataaaattaaattaaattaaaataaaaaggtgagggctgtgacccttggttatcagcatgatagctccctctgcttctttggtaatagaacactaattacttgcctgaagcacagcccctctagactctaagctccaggagagccgtaatttctggacaatcaatgagtatgtgttgattaaggaatgatgagagaaaatcagagacagaccagcaggccccaaagggtctagtatatcaagccaggaagccggctttccctaaggggttactggtagctagtgagaggtgcattctagaaagacccctcctgaaacagaatcygttattagacttacagggtggtcagagctgaccctagaaataatgagatttgctagtttctcttctctccattgctctttccctttctaaaccacccaggtgtaatccttcccagaacggggggtgggagtgcctcagcttttcttatagtagaggaatattagggtgaagaccctttaggcttaacaccatccactctggcatcctcacattagatttgcctggagaacttttagaattaccaaggatggagctttgctgcagtattattttaactttttattgtaagaatgtcaaccctccagttagatataaagaatcataataggttcccatgcactccacatcagcacttctcaaacttcgctgtacattacaatctccaggggtgcctaaagaaatgctgatgaccaggctgcacagttgaccaattctgttagaatctcaggggtggcacacagcattgggagttacgcaaattcgccaggtgtttccagacctttacacccaacctcaacaattaccatcttgctaacttttcccttgtgctcccgcaacacatacattttccccctaaataatttaatagcagatctcagaaactctgtccattcatctgagtatctccagctgatagacttgtttttagcatcatcttcataccatttgcacacctaacgaaattctcagcaaaccctcaacattctctagtgcccggttcatgcccaagtcttccaggccacctttttacagttgcttggttgactcaggatccacacaagacccagtcaccatgtttggttgttgggtctcttccatttcttgtgtccagtgatggtcccccaccccgctttgggttgtattattaaagctacccgagagattctcaagtgaagccagggctgattggctcgacctcgtcttctgaaggtgaggaggctgaggccccaagagggcagtgacttgctcaggtgcactcaggtcactacaccatgcggtagacccagcccccagctcagtgctggcacgctctcctgtgccactctgtcctctgacagcacccacggcaccttcctacaagggcgagactaacaactttcagattcatgcaaaactttacgtgcgtgtgctttttttctggggcctatggatttcaagggccctgtaccccccagaaggttaagataggggcgttgctttggctccaggagctgctggccggctgactggcttaggtgaccactggcttgctacaggactggatgcctccatccgttcagagaagttcaccttcagcccgcccttgatgagagtcccatcgccgcccttgatgaaagtccttgtttaccaccagatggagcagcttccccacaggctccactggaaggccctttggtcgctgggaaacaaacttggtaaaggaattgtctttaaaaggatgcctttcccccttctytcctatcaggggtgttccaggctctcagtacaaagaacaaggagttcattcatctcaatataaatgaggtatggccaatccagaccctctgctcagggacccagctggggcccagcagagtccacgctgcatagatgtttgccgaatgcttgatttcatgcaagggctgacatctagctgtgggagtgattataacaaaatagctaatatttttgagatactatttatcaagtaatcaattaagccattacaataattctgtgagctaagtaccaatagtatccccattttgcagggtggaaactgaggcatagagagattaatcaccttgacttgagtgagtgagcagactctgccttcttgtccttctcttccttctgtcatttgggtaacttagcctgcctgccttccagctgccagtttgctcactctcccttgctcatgttgtcccgtggttcccatgacactcccccagactccaataagtacaaaactggccagttaccggggccaytgtagcaatgacgggggtgggagaccatgggtctgagtgtcagaggtatgggagaaggattcyagggggtttcaatcaccctctccccagaggatcccagtggacccatctgctcacagggaggtccatgggccagcagcagcataggcatcacttaggagagagcgttggaaatgcagagtgccaggccctgccccagacctgctgaatggaagtcgtctttcacaggaccccactgattcctgtgcacatgaagcttgggaacgctcttgagacattctcctgcccaaaggcagaggggaaactgtggagcagtttccttcaatggttctgtaatttttatctcccttttccttctttccctccctgtatctttctttccaggtctgctttctcttctacctaacaactctgaagccaggcagcctgtggctcctccccagtctctggagtttctcctctccaccaatttccatactcacagtcacagccagctcatttccaaattcattagtaactttgggtttggataacatttaattgaatatttcaagatgaagaggttgatgacagtatgtgttttagaggattgtacctcctcccctcttttgtgctctgatttcgattaagcaggctgctcggtgcctcagtttaaccatttacagaaagagacataggccttaatattacacccaaagctttgctttataataatatcatataatttggcaattatgttgactcaccactaattttctcaagtgtgtatctcagatccctggacgcattattatttcattgagccaattacgtattattacggtgagccaaatggggatactattggtacttagctcacagaattattgtaatggcttaattgattacttcataaatagtakctcaaaaatattagctattttgttataatcactcccacagaaactaggcatttttcttctctagttttgtctttcaacttcagcatgtargacacatgtaataactatacctcctttgatcaatccaagattccaaagaaagatgtgcacacacaaattattcttttatgaaaataagaggaagctgggcatggtggtgtgcacctgcagtcccagctatttgggaggcctaggcgggaggattgcttgaggccaggggtttgagcatgcagtgagctatgatctcgccactgcactccagcctggaagagagtgatagcaagaccctgtctcttaaaaaagaaaggaatttgtaatcccagcactctgggaggctgaggcgggtgaatcacgaggtcaggagatcgagaccatcctggctaacacggtgaaaccccatctctactaaaaatacaaaaaattagcctggcatggtggcgggcgcctgtagtcccagctactcgggaggctgaggcaggagaatggcatgaacccgggaggtggagcttacagtgagccaagattgtgccactgcactccagcctgggcgacagagtgagactccatcaaaagaaagaaggaaagaaggaaaagaaagaaaagaaagaaaaatragaaagaaagaaraaagaaagaaagaaagaaagaaagaaagaaagaaagaaagaaagaaagaaagaaagaaagwaagaaagaaaggaaaaacaagagagacccctaggtccacctttatttatcatttactttaaggtaaatgataagtaatgtcactaaaaaacatgaggaagtgtgatggctgcccctggtccatggtggaaggagacagtgggaaggtttgttactcagcggccccctggctagtcaaaggctccagagcaccagcagtgtggaggaagtattccagtgctgcagcttcaaggtagaagtgtggacacctctaacgcaagtgtccacaggtgtaggggctggaataggctcctgccctgccccatatcatcaccctgcagtacaacagtgaaaaccattgcattctctccctctaaacctaccatctttacatctggctgcatgttagcatcacctggggagatttaaaaatcctgataccccagccactccctagatcaattaaatctgaatctctggaggtgaggcccaagcattgtttttctttaatccccttggtgagtccagtgtgcagccaggtctgaagtatccatgttttaaagtccctctccttttcccctgacccatcctaggaagcaacaggagattttcctggctgagttggcctcacctgcaatcactttcctaaaaaggcctgtgcacctttcattacagtagctctcatactatatacactgtgcccaggarggaggacagagaagggagaaaaaaaccatctcatataatcacrttgccccaagtcaccatgctgtaataaacaagctgttgggaaggaggaggcagggtggactcgggagagaaaatgaggaggaattccatgctacttctccttcagctcacttgtaacaccccccagctatggaacctgcttccacttcctgcagcccctccagggtggagggccacctctctcccaaaggtgagaggacccctcatcaacaaggaaaagtcacttaatactgccctgcccaagatgcttcagcgaggctgtcctcttaacagggagaaagcacattttcccgtctctgtcttaccaactgtgcttgatatgagctcacttggaaaggactcaggtcctccagaaaatgtcaagtgctgagaattcatttattttctttaaatggtttcctgctgagacagacatccaagttggcaggcaaaatgatcaaatagcagatctcctgtgatatcagcaaactggggccactcctgaggctgaggctggaagggacatggaaggacaacgacccctcatctctctctctctcttcccagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctgattttgtgctactcctttgtaaagtcactgccttaagggggctgatggcgccacctgtgccttacatccaggttcaggcatcactagctttcccacactctactttccttatttccttccattaagaattactcagagttctaacgcacagaatcctgacttccatgtagctccagtcattgtgatcagacatcctttataaaacatgtttttataaatgtgtatgtggaataagatgaggaggaaaaggagtgaggtcataatttagcatttctgcatcataagtgtgcttccttatcagggaagacatcaggtagttccgataattggacaagagtggatctccgataagagtggatcaaggtgacaatctctacctcctcctacgagaggtggtaactaaaacagtcactatccagtccagacattctttgtgtctgaagactttgggtcagaaaagctgaatgatattatttcttctcaaggagtccagattctggtgaggtttgatcttactcatccccaacatgatgggggataacagacccgagaatcctcattatagctcactagtgctgaacaggagtatccactgaactagaataatgggaggtaacatgagaagatactggctcaatacatgccaagccccacattcttactggtacacttgtggcagatgaggtggaggatgggagcgggagataccgagagggaaagagggagaatggctgggatgaagatcaagttagaagtggaggctgagcatggtggcttacacctgtaatcccagcactttgtgaggccaaggtgggaggatcacctgaggtcaggagttcaagaccagcctggccaacatggcaaaacccaatctctactaaaaatacaaaaattagctgggcgtggtggcgggtgcctgtaatcccagctactcaggatgccgaggcaggagaatcacttgaacccaggaggcagaggttgcagcctggcgacaagagcgagactcagtctcaaaaaaaaaagaagtggagcttcatcagaaccctgtccctgatcgtggccaaggtaccatgatcttctcctttaccttccagcccttccctgggttcacgcagcagtggatgcaggacaagagccctctctcaggagcaggcttaggaccaaggctctgtgctggggcacgccagtacaaccccagacatgccatctcctgtgctcggcctgtgcccactctcatcgatgcacactgctgccatattgtttgttagatgtcgtgaacactagccctgctcacaggtaaaacttggaaggggactcaccatatgagcttctttgtctagtgtcactcccacagggtgcctttaggcctttatgtccaggagcacataactgtctctcactgatttttcctctgcttgaaaggtacccaggaaatgaagtttatgaactgggcgtcctgttttctttccatccatatgtccctgggaaagttattaaactctctgagacttagtttcctccactcacaaggatggtaatttctgcctcactgagatcttatgatgaataaatgaaattgtaagtagaaggtgccaggcacagtacttgacacataacaggccctcagtgcaactaaggcccactgttgtgaaccagtgttttcttaaatgtctaaaagagttacatactatcacatgctttcggtttacctctgttcttcattgcaagaatccaagaattatagaaccagtcttgaaggagagttcaatagagctctacagactattatatgatcatgagttgagaacaaaaaaaagtgtatgaatttagcttctatttgtttctgaattacatggtctgatactgacacccagaaacaaaggaagatgtttcacatgcatgagtttgattaactataattaaagtgattttgtagcttataattcaaaccaacagcttttgagtgtgaaaggaataatattagttattacaccaggacaatagatgtaaactggagctgtcctaggaaaattgcgatttatggccattcacattatgtctatcaccacctgcataatatatgctttaggtcttggcaccaaaatattcgtgccctactacctttaaattaaacagtggctgggcatggtggctcgcgcctgtaatcccagcactttcagaggtcaaggcgagcagatcacgaggtcaggagttcgtgaccagcctggtcaatgtggtgaaaccccatctctgctaaaaatacaaaaatcagctgggtgtagtggtgcgtgcctgtagtcccagctactcaggaggctgaggcagaagaatcgcttgaacccaggaggtggaggttgcagtgagccaagatcgtgccactgctctccagcctgagggacagagcaagactccatctcaaaaaaataaaaaatacaaaaaaaaaaagagagagagaaaacaaaataactgggtgtggtggtgcatgcctgtaatcacagctactagggaggctgaagcaggataattgcttgaacccaggaggcggaggttgcagtgagccgagatcgtgccactgcactccagcctgggtgacagaacgagactttctcaaaaataaaaataaaaattaattaattaaacaatagtatacacgagctatctaacgctactgcttcacaccaaaatcacatgaaatacaaagagatacacacctagacacatcaaagtcaaactgttgggaaaaaaagagaaaatctgaaaagcagcttgagaaaaatgactcatcatgaacagggaacaatgcaattagcaactgacttctcatcagaaatgacagacgacagaaggcagtagaatgacattccaagtgccaaaggaaaaatctttcaatcaagaattctgtttttccactagaactgcaaaaatgaaagcacaataaagatattcccagttaaacaaagactgagagaattcattattagctgacctgccactggaaaaatattaaaggatgtatttcagggtgaaaggaaataaaactagatgagactgtggatctgtagaaagaaatgaagagcactcaaaaggatatctgtgggtaaatgtaaaagactatataaacgtgttatcttccattctaattttgtttgaagacattagattatataaagcattaattattgtactatgttgttggatttataacaatagagagatatattataaaggagagaggaagaaacaaagtattgtagcaatatttctatattttcttagaattaagtcagtattacctcaggtaatgatattagatattagatggttataaattaagatgcagattgtaatctacagagcaaccactaagaaaataactcaaaaatacagtaagatagcagaggaatcaaagcagaatacttaaaaaaaatgtttagcacaaaagccgtaagggaagaacagattttaaaaataagacatagaaacaaaatggcataccttaatccagccatgctgataataatattaaatatgaataaaaactacaatcaaaaggcagtgattgtcaaaatggataaaaaagcaagattcaattgtacactatctacaagagatacttcatacaaaaagacaaaagttggaagtaaaaggatgaaaaagagagtaccatgcaaatactggcaataagagagcttgagtgcctacatcaatatctgagaaaataaaatttaagacaagaaatattattagagagaagaaatgatattacagtatcataaagggtcaatacattaggaatatataataattacaagtgtgatggtacctaatagtagagtctcaaaattatgaagcaaaaattgatataattgaaagaagaaacagattattcagacttaacaattatagttagagagttcaataacccatttttaataactgataggacaactattcagaaaattaacaaggaaatagaagacatgaacaacactatcaaccaacttgactaactgacatttatagaatactttaccctcaagtaatgaatacacattttttcaaaagcacatggaactttctccaggttagaccatatactagaccataaaactaatttttaatatatttaaaagaatttaaatcactcagagtatgttctccagccacaaaggaattaaattagaaacaaaaataagtttgggaaatcctcaaattttagaaattaacacatttctaaataactatgagttgaagagaaaaattacaatggaaattagaaagattttgaactgaatgaaacaaaaataaactatgtatttacacatgtctatacacatccacattaaccggattaagctaaagcaggacctagaaaagtagagtgttctcaaaacaataatttaagcttccatcttaagaaattagagagagaggcaaattaaaccttaaaaggaaagaaataaagactaaagcagaaatcaattgactagcaaagagaaaaataatagagaacatcaaagaaacaaaaaggtgattcttaaaaaagattgcaaaattgataaacttttagctaaactgaccaagaaaaaagacagaaaacacaaattaacaatcaagaatctaagagcagccgtcattgctgacccatcagaaattaaaagaatgataagtgaatattttaaacaactttatgtcaacaaatcagacaacttagatggaatggaaaaaatcctagaaaaagataaattaccaaaactaccttcagagaatactgaaaatctgaatagacctatgcattagtccactgtcacagtctaataaagacatgcctgagactgggtaattgataaaggaaagagatttagttgacttacagttcagtatggctggggaggcctcaggaaacatataatcatggcggaaggtgaaggggaagcaagataccctcttcacaaagcggcaggaaggagaagtgccagcaggggaaatacaagacacttataaaaccatcagatctcatgagactcactcattttcatgacaacagcatgggggagactgcccccaagattcaattaacctccacttggtcctgcccttgacatatgaggagtataaggattaaattcaaagtgagatttgggtggggacacagagccaaaccatatcaacctacaacatgaaacatatcataccatatcaacctataatattttggtcctgagaccaaatcctttggacagtgcctggagagagcctcaggccacagtcatgtttatctgaaatacagggcctacctccaggctcctctccaccctgtcctgtgcagagctacgcagtgcgctgaggggccagggcttcagaaagcccagagcatgtgacctggttggcagaggtaccagggtcattggtgccagcccaattcagtgtactggatcattagtagaaacaaagcaccattctactgagagccaagaccgcctgccaagtaccagtgcgaaggctgcctcgtcaccacagctgtgaatcaagagtaggctgtgcttgctactgatgccagcctggggcattttcccagccccacagtgcctttctgaagtgggagaaggagaagcagagggttagactctccttggtgcctgaacagtgcctctgatggaagaacgtagctcagtgatattcccaaggaggtttattggttcattatcagtaggactctccaaggaaagggaacagctgaaccatatggagcaactgcaggctcatgtaatagaagcagcattgaacttagagtttgagtcctgtattctagtctagaacttacctccagctagctgtgtggacttaaccatatcactttacctctctgggctgccttgcaccttgaaattatgtgattccttctctcactctgggaactagaaggccaggtcagtgtggctcagtcctggtctaattggatggatggagagaaggtagcagaggtgggcccagcaagcctgagaattcatcttactccctgacagagctcagagttctgagaagaatgtggtcacgcagaagactctctgtaggccacatcaggaccaggcttcttggaaagctgtactcctcctgcctttcaacatcttaacacactcagctcctccattatacacacttacctgaacccagcttgtctgtatgggtttagcattctctcttgtccttcccagtctaccctctacattctaaaaagagagtctcccacccagacgatctccttgcagtcacttttcaatgcaccagaacagcttccttagttggaacagtgaacagtgtgttttcaaacaaaagggg

SEQ ID NO: 1690 - DNA, 17804 bp, Homo sapiens
tcctgcctcagcctcctgagtagctgggattacaggcgtctgtcaccatgcccagataattttttgtatttttagtagagacagggttttaccatgttggccaggctggtcttgaactcctgacctcaggtgatctacctgccttggcctcccaaagtgctgggatgacaggcgtgagccactgtgcctggccagcatacatctaactttataagaagttgatggccaggcacagtggctcacacctatcatcccagcactttaggaggccaaagtgggagaatcggttaagcccaggagtttgagaccagtctgggtaacatagtgagaccctcatctctactaaaaatttgaaaaattagccggacatggtggtgtgcacctgtagtgcaagaggaataagtttaagagatttactgtattaatacaacatggtaactctagttaataacaatgtaccatagacagcagtccctccttatttgaggtttcccgttctgcagtgcaggtacctgtggtcaaccgcagtcccacaataggtgggtacaattcagtacaataagatattttgagagagggagaccacataacacataattttattacagtgcatggttataattgttttattgtattattattcattattgtggttcatctcttactacgcctaatttataaattaaattttacgataggtactctccatgatcttggaacatattttccctggataagcggggactacaggactcaaaaattgctaagagagtagattttaagtgttctcaccacatgcacacaaaataagaatgtgaaggatgaatgttaattagctcaacttagtcattccacaatgtatatgtatttcagaacatcatgtaccagcccagtgaggtggctcacatctgtaatcctagcactctaggaggccaaggttggaggatcaaggattgcttgagctcaggagttcaagaccagcctggacaacatagtgggacctcctctctactaaaaataaaaatagaaataattggctgggcatggtagtgtgcatctgtggtcccgactacttgagaggctgaggcaagaggattgcttgagctcagatcaaggctgcagtgagctataattgcaccactgcaccccagcctgagcgacaaagcaagaccctgtgtcaaaaacaaaacaaaatatcacatatccattaaggcccccatacccagtattactttccatagaatcagcaactggcaaatacgttaccgtcgttggatttggctgatatgctctgttccaaggctatttcaacagcctctcagctgcagctagccttcaccgtggaaaggatacaatacgcctgacccagctgctcctggggaaccttgaatcctggccactactgcaggtgcagtagtgaaaaggtgcaatacctttttttttttgagatggagtcttgctcagtcgcccaggctggagtgcagtggcgcagtctccattcactgcaacatctgcctcctgggttcaagcaattcccctgcctcagcctcccgagtagctgggattacatgtgcacaccaccacgcccaggtaatttttgtatgtttaatagagacggggtttcaccatgttagccaggctggtctcaaactcctgacctcaggtgatctgcctgcctcggcctcctgaagtgctgggattacagacatgagtcaccgtgcttggcccgcaatacctttttcttatgcatttcaaagtccatggccagcacccctataacaaaagacaggttaatgagataaaagcgtaacaagtggatttaacagttttatgtgacatgaaagccttcagaaatgaagacccaaaaactcagggaaaattgtgtcattttgaggttcaatgaagaaggcgttggcatgtagacatgtgatgtgaaaaaccaggtacgatcttgggaggccgaggtgggaggatcatgaggtcaggtgttcgagaccagcctggccaatatggtaaagccccatctctactaaaaatacaaaaattagctgggtgtggtggcaggtgcctgtaattccagctactcagtaggctgaggcagaagaattgcttgaacccaggaggcggaggttgcagtgagccgagattgtgccaccgcacttcagcctgggccacagagcgagactccatctcaaaaaaacccaaccaactcaacaaacaaacaaaaaccaaaaaacaggtatgatctcttggtcataaattgaggggggatcccagcaggtcccatttgttcagattcttctgggcctttctgtgttgcatttcttcctctgcaggacacctgtcacatgagggtcttcaggggaaaaggaattctagtgtctgtgactgcttcaaaggagaagtaaggggagaggagaggaaagcaggaggaggttggagagaacctcttgttcctgaggtcttccaatctccttcagctcaaagcactcagcatgctgaagttccagactctgggctatcacgttctgacatgcaacacaggcaacaccccagctccatccacgtttctccaaaagcacaggcatgacgtcatatggtgacaaacacccttgtccaaaggaagcccataggatacgctaattctagattcacaaatactctagaggaactcacacaatgggatgggccagtgccccacacagagtatgaggcctcccaccttggttgaatatctttttcttttttttctttttttttttttttgagacggagtctcactctgtcacccaggctggagtgcagtggctcgatctcggctcactgcaacctctgcctcccaggttcaagtgattctcctgcctcagcctctggagtagctggaattacaggtgcccaccaccacaactggctaatttttgtatttttagtagagacgagggtccaccatgttgaccaggcttgtctcgaactcctggtctcaagtgatctgcccacctcggcctagtgctgggattacagacgtgagtcaccacgcccggccccaccttggttaaatttctgaaaatcatttggtaaagtgaggacccctccagctgagacactgccaggaaacagctattgagtctcttagcacccacagcattaaaacaaacccaaaacattttaggcctcgttgagttctggaggcaaaatattcctcatctacaaatttattttattttattttttaataaaagttattattatttttttttatagagagacagggtcttgctctgtgacccagactagagtgcagtggtgtgaccatggttcactgcagcctccacctcctgggctcaagcgatcctcccacctcagcctgccaagtagctgggaccacaggtatgcccctcccccaggctaacttttttttactttttgtggagatgaggtctcactatgttgcccatgctggtcttttttttttttttttttttttttgagacgggagtgcaggctggagtgcccaggctggagtgcagtggcacaatcataactcactgcagcctcaaactcctggggtcaagtgatcctcccacctcagcctcccacataactaggactacaggcctgtgtcaccataatgcctggttaatttttttagtttttgtttgtagaaacagggtctcactatgttacccaggctggcctctaactcctggcctcaatccatcctcccatctcaacctcccaaagtgctaggattatagccacgagccaccatgcccggccccatacttatatttacttgtagtgagaacacttaaaccctactcggtcagtaattttcaagtacacaatacattgttactaactatatacatggtatttttaatttgcatgaatgctccttaaaatcagcgagcccgccttattttttgtattcaattttattggatataaattccacatcagtaaacctgattctcttaaaaatctacacagaaaaaaaaaaagagagagaggttgagttgggtagttgttggtatttttgtttttgtttctttgcttattcagttgaggtttattgtaaaacttgacaccagaaaaaggaagaagtggcgtttttgtgctgtgagcgtgtgacgtgtgtcctttccagagaaaggacagtcatggtgcttttttatcctctctgcccaaagaaggaaagctcttaacagccagcaggaggctttgtagggaccagcgttatcaacgccagtcgcgctgaccaatgatgagttaaagcagttaggtcgtttctaagagcaaatcaaaagctaaggttctgtgattctgaaaatgagacacggacagagactggagacccagagagaaagtgaaggactaaaagacagtcatagggtgggagtttgctctcctctgttttgttctgggtttttttgtttgtttgtgcgctctgtctgaccgcttttcttttttttctttttctttcttttttttttttttttttttgagatggagtcttgctctgccgcccaggctggagtgcggtggcacaatctcggctcactgcaagctccgcctcccacgttcaagggattctcctgcctcagcctcccgagcagctgggattacaggcatgcaccaccacactcagctaatttttgtatttttagtagagatggggtttcaccatattgaccaggctggtcttgaactcctggcgtcaagtgacttgcccgcctcggcctcccaaagtgttgggattacaggcgtgagccaccgcgcctggccctgactgcttttctccttggtttgtttctcaatcccccttcctctgagccgaattccctttttgttctcattttctctctctgtcccctctctctctccttctttctctccttccattcctcctagatgaagcaaaaactcagataaaccagcacagaggccaggtatggtggctcacacctgtaatcccggcactttgggaagccaaggcaggcaggttgcttgaggccaggagttcaagaccagcctggcccacatggtgaaaccccgtctctactaaaaatacaaaaattagccggacatggtggcacgtgcctgtaatcccaggtactcaagaggtggaggttgcagtgagcggagatcacagccctgcactccagcctgggtgacagagcgagactccatctcaaaacgaaaaacaaaaaacagcacaaagttcccttgtcctgtgactcattctctctctctctttctaccatttctccttccctgtgtcttttttttttctctctgtgggttttatttaagcaatagaagttcttagcaaagaaaaactttatggaattagattgatccacttcatatgtacatatatgaactcagttcagaaactctcttctacccctgcctgatcacctatttggaagtctgttccttcaactcttcttctctttctgggactctttctagcttgggcttcctgcccctcccgtccactctcctgctttcacagcctctccttccccctgcccctcccctgcactgcatggggatgggccccaggtgtccaaggtctccccaccctcctttgtcactggagtcaggattagaacccagctccctagtcaccttgagtcatcagtcctggggctgctgacgggcttgcagaggagagagggagtggggctgggtcttcccaccctgggtcctttcctccttccccactccgtttagctgtaaagctcaattaagtgtgattagctgagaagagtttctgcagaattagagcacgccccacccctgtcttcgtggtccccttcccttaacccggaaactggatgggccaggacaaagagagttaagagctttgtcagtggtctgtctggagcgacagatggaaggaaagggaccggttgagcaacatgacaggtggctgaggagccaggtgcagagtggtagagttggctggcggagtggccagcacatgagaagacaggcaggtaggtggacggagagatagcagcgacgmggacaggccaaacagtgacagccacgtagaggatctggcagacaaagagacaaggtgagaaggaggtaggcgactgccaatgagggagtgacacacaggggagcaggtagagagaggacaagcaggtcatccccttggtgaccttcaaagagaagcagagagggcagaggtggggggcacagggaaagggtgacctctgagattccccttttcccccagactttggaagtgacccaccatggggctcagcatctttttgctcctgtgtgttcttggtgagttctcccggagcagggagagggcaggactgcgactggatcccttcacccccatgaggaggccccaccaccctccccatctcagctctggcccccagcctggtggtgaggaggagaggggctttctctgtgcctccatttacctgcagctctcakggtactgctcacctcggtctcccctattttttgatccctcttcccttctgtccctctctgaatctctgtctctccatttccctcctatgtgtaagcatctttctccctgggtgtctttgatgtttcatggtctttttctatcactgggtctctctctctttctctctctttctcgtctctctttctcctctctctctcctgcctgtttctctctctcactctgtgtgtctctccatctctgtatcttttcttcctctctctgacccatgcccctgtctgtctccagggctcagccaggcagccacaccgaagattttcaatggyactgagtgtgggcgtaactcacagcygtggcaggtggggctgtttgagggcaccagcctgcgctgcgggggtgtccttattgaccacaggtgggtcctcacagcggctcactgcagcggcaggtaagtcccttcctggggtgggcgaagggaggactatgggaaggcaagcgctgggggtaggatcacaagggagggtggtgcccactgggaagaagctgatcctgcaacaagagagtctgaggttagaccaggagtggaacttccttagcagtgggcctggggtggtgctgggcagggtgaggtatgttgggtggagggccggggagggtcctggaacctgccctcctgcctctcccattcctgcatgtaccctttctttcctatatgacatctgccactcaccccagccattccttgacccagtctgggcccggggcccaggtctcacccaagctctttttctttttcttttttttatttttttgagacagggtctcgctctgtcgcccaggctgctgtgcaatggcgtgatcacagctcactgctgtctctgcctcccaggttcaagtgattctcctgccccagcctcctgagtagctgggattacaggcacccgccaccatgcccagctaatttttgtattttttgtagagacagggttttgccatgttggccaggctggtctcgaactcctggcctcaaatgacctgcccrtcttggcctcccaaagtgctgggattacaggtgtgagccactgcacccggccaacatgacccaaactctttgtgcaacttcagaatctatgcctggcacctctctgggcctcagtagactgatgttctggaatttttttctttttctttctttttttttttttttggagacagagtcttgctctttctgtcatccaagctggagtgcagtgatgctatcttggctcactacagcctcaaccacctgggctcaagtgatcctcacacctcagcctcccaaggagctaagactacaggcctgcgccaccacacctggctaatttttaaattttttttgtagagacagggttttgctatgttacccaggctggtctcaaactcctcagctcaagcaatcttcctgccttgacctcccaaagtgctgggattacaggcatgagccactgtgcctggcctggaactttttttgtgaaaggggagatcagatgcaaagaaacagagactcagggagagagagggccagcagcaggatgcagagaggccattcatcaacccactcgttcaatcatgaacccactcgtccacgcatgagcatggagggcacatgctccgtgccaggcggtgggaataaggcagtgaacaaggtccactgatgtccctgccttcatgggcttcaccagccgagagaatcagaaagagaggcctggcgcggtggctcacacctgtaatcccagcactttgggaggccgaggcgggcggatcacttgaggtcaggagtttgagaccagcctgacacacatggtgaaaccttatctctactaaaaatacaaaaattagctgggcatggtggcatgcttctgtaatcccagctacttgggaggctgaggcaggtgaattgcttgaacctgggaggtggaggttgtagtgagccaagatggtgccactgcactccagcctgggcgacagagcgagactcggtcttgaaaaaaaaaaaaaaaaaaaaaaggagagagagagacacagatgcagggacatggtaggagaaacagggaacacccaagatggaaagagggtgatggaggttgggaataagagcctgtaagagagactcggagaatgagagttgcgggtgagaggacagacagtgaggggcagaacagtggggagcggcaggagcgcctgagtgtccgtggaggggtgcaaggtgggggactgcrtgcctgccacccgctcagccgtcgccaccggcagcaggtactgggtgcgcctgggggaacacagcctcagccagctcgactggaccgagcagatcyggcacagcggcttctctgtgacccatcccggctacctgggagcctcracgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggagyaaggggcccagggccaggggtcaggggtcaggatgggtacaagtctgggatgcagggcgagaggtcgaatcatgacacctcagaggaaggatgggtaaagggtcagggtgtgggatgggacatcaggatcatggtttggggtcagagattatggtggattggggtcttgggagccaaaggggttaaaggactgggtatgaagtcagggatcagaggtcagaggtcagagtgtgtcagaggtcatcacactggagcaaaaggcatatatatatatatatgtatgtadaggatatgggcattgtgggtcatgggtctggggttagaggtcaccgtagaattaaggtcatgggatccagaggttgtacaatctggtcaaaatctgaggatggaaattgggattctatccaaaatcacatatctgagattggaggtcatagcgtttggggtgtggggcccgaagtttggggtcatggaggctggggcccaataaactaggatcaggggacactggcrttggaagcagtgaggtttggaagatgcagagctgaggttggaggttaaggtaaagacagggacatggggtcaggagacagaagatatgagatcaagctgggatcataaggtaataagacagaaggtcaaagatcacagtagctggcattgaagagggtcaggtctggattcgttgtctctgacgctggagagacaagaaagttcttgagttatgccactcaaagtcaaatgtcaaagatcaaagagaccgtcaatcatctggggtcatgattcatatgaaattaagtcataaatatgtaacttggaggtttcgggattgtagtacaggtcggtgaggggcaggggtattgacatggatgggccacatccagggaagagggacgtggcctcaaagtggggagatttaggggaccctgcagcacgcatgttctctctccagacccattcccggatctgctccagtgcctcaacctctccatcgtctcccatgccacctgccatggtgtgtatcccgggagaatcacgagcaacatggtgtgtgcaggcggcgtcccggggcaggatgcctgccaggtgagccagtgcaggcagcgtgcgtggtcaccaggacaggaagtgaaggggaggggctggaagcaggaggggaactgatggaggatgaatcagggaaaggggatgctgcagagagacggggtcaaaaaggaagggagaggctggttacggaggctcacacctgtaatcccagcactttgggaggccgaggcgggcggatcacttgaggtcaggagttcaagacaagcctggccaacacggtgagactctgaatctactaaaaataccagaattagccgggggtggtggtgcaagcctgtggccccagctacttggaaggctgaggcaggagaatcgcttgatcccgggaggcggaggttgcagtgagctgagatcacgccactgcactccagcctgggcgacagagccagactctgtctcaaaacaaaataattaataataataataataataataataataataatggaggagaggcccaggataagggagggagagagacagggagtaaaagggaggaccggggaatggaggagggggaggggcagggagagagagggaggaagggaacagagaaggaaagatggggcaggggttacagagagagacagcaaaacagacggagasgactgggagcccagacagggaaccagctgtttctggggctctaagtctttcccataccatcctccagttggtgctgtcccagactgagagagatttgaggatggcggtctctcccctcattggtcagggccccagccattgtccttgagagaactctgtgcttttgatggagtcctgcccaccttccctgggattggtcatttttgatggcactctctcccctcattggtcagaaccccaggcattgtccttgagagaacctctatcctttatggagtcccaccctcctcccctgggattggtcattgataatagtgttctctctcctcattggtcagggccccagccattgtccttgagagaatgctcgactctttatgttgtcttgacagcctcccctgagattggtcattaatgactgtgctctctctcctcattggtcagggccccagccattgtccttgagagaacctctgtcctttatggagttccacccttcttccctgggattggcccctagagacagtggttcttctcttttggttagccattgccattgtcctccgggaaagtgattatactcttttgtctaatgaccagacttggagccctccccaaggcccaggactgggttgaagggttggggaggaaaacagaaataagatgtctcccttgttcagacagtacttctcttcccttccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggccatgtctgtccatttgaagtcctcatgctggttgagactggaagaaggactcagcagtttccctatctcataggagtagaaacagagctcaaataaggccaggcacagtggctcacacctgtaatcccatcactttgggaagctgaggcaggtggatcacctgaggtcaggaactcgggaccagcctggtcaacatagtgaaaccccaactctactaaaaatgcaaaaattagccaggcatggtggcgcatgcctgtaatcccagctactcaggaggctgagacaggagaatagcatgaacccgtgaggcagaggctgcagcgagccgagattgaaccattacactccagcctgggcgacagagcgagactccatctcaaaaacaagcaaacaaaaaacccagtgctcaaataggatgagggtcttccctgagtagttactcagaaatggagtagaaaaagttacttttaataatataggctgggtgcagtggcccacgcctgtaatcccagcactttgggaggccgaggtgggaggatggcttgagctcagatttcgagatcagcctggcaacatggtgaaatcttgtcactacaaaaacacaaaaaattagctgggtgtggtggtgcgtgcctgtagtcccagctacttgggaagctgaggtgggaggatcacccgagccggggaggtggaggctgcaaagagccgagatcatgccactgcactccagcctgggcaataaagtgagaccttgtctcaaaaacaaaaacccagcaatataaataagacacatgtttcttcatctggcataatagaaatagtgcccagagcttataagcttttcaagagtccacaaaagacccgaaaaagaaaaagaaaattgttagctccaaaataccagatgaaagctgcaaagtcaacatttatgaccatttaatccaatgtccataaaacgtagcattctttccactagccaactgcagtttactttcttgtaatgaagcatacattgtatctttaatgtgggacgtggctttgttctaataagacgaagggtggagtgcaggcttggaaagcaggagagctcagcctacgtctttaatcctcctgcccaccccttggattctgtctccactgggactcaagaggtgaggagagaccatctccccaaatgcactgaagggaaactggaggagggagggagtgaggggtgatcataccagcggaggcacatttgctgagcccccctgcagtctgctctttccaagtggaccctcctggaagcctgatcccaacctcccctgcaagcaggtctgtcacccccatctctcagatgaagaaactgagccttgcaggggtggagtcccttgtccccacgtcataagggtagtcatagtagtaggaagaggaagcacctaggtttgaggccagggctggctgctgtcagaacctaggccctcccctgccttgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccagtaagtgaacagctggacttgggctgcctgggcggcagggagaagcgggcaggggaagggtcagcagaggagcgaggccccagaggagccctggggtggagcacagccaagggctctgttccctttcctggactcggcttccacaggccctgacctgcctcccccaccctccggtcctgcccctgtgcctggcagcagccccacctgtgtgacatcccagcacaccccccctctccttgcaaaggagaagggagcggcctaggggaggccaggggcccacctgggctggggctgtggagagggagtggctgggacgggaggaaaaagagagacggagattagatggaagaagagggatttcaagacaaattgccagagatgcagtcagagagactgactgagagacacaaagatagaaggaattagagaaagggccacacagagccagacagagagagaagagtggagatggagacagggacgaggacagagaaaggcagacagacacatagggacagaaagagaaaaatcacacaaagtcagaattactgaatgacagggaatgacacatagaacgagacacagattcagagactcagggcagggaaaggaaggctgcagacagacagacagacagagggaggctgagacacagggagaagaggggcttggagaggtggcacaggcaggcagccagtgcctcagaggcctccggggagggccctcacacacaccccgccccggggcattaaggcagggcttggaggccagtcatcctgggcccgcccagggccgcccccctgccagcccgcctgcctggtgcctggcacctggcgctccaacccagcctacctgctgtagctgccgccactgccgtctccgccgccactgggcccccagagccccagccccagagcctgtgagtccaggaggaaagggaagctgcccctccccgtccaggtgtcagccctccccaaggacacctgtcccactcgggcacccatttctccctctgctctgtccttctctgcttgggtgggggttcctggcctctctctacacctctcacctccgatggctgtccgcagcctcagttacctctaatctccatggcttcagctgctgagctggccctctgctcccacccccgctggccagggcagcggagggcactggccctcccctcgaccagccccgcccagctttgcttggctgtccttcaaaagggcaggggtttggcggacagggcttcagcaagccgggtgatgggggtcccagacattgtctggggctgagccccctactcccctccagcagacctcaaaggctccatatcgctctgctgcgaagacaatgaaaaaggggtggctacggaacggtgtctggttccccttgtccttccaccccaagctgctggggcctggccagctctcaaggcaagaaggaaaacatcctctgacatgtgccggggaggtcccatggctgacttgaacagggccgaaccatggcttgacagctcaaagcccctcccaacgacttccacatggttcttggtatctcggaagcttctagctgtgaccaggccctctccaaggccaccctagacacctaagatatattttaagtgtttggagatctgagtgctgtgagaaacaggggatttccccaaccttgtttctcccaagtggggagcgggagcaggtgagggagagaggagagggcatgagccagcccccccctcccgatttccccgtaaagtgatgcggccccatgtccctccttgttcccagaggaacctggggcccgctcctcccccctccaggccatgaggattctgcagttaatcctgcttgctctggcaacaggtacgcaggggatgggggcagggcaggatcctccctcttgaatctctgggatcccctaaccctctgtgtctggacagtgacagggctgattccaaattacagaacaacccataaggcacctgaactggagcagtggtcatgagggcctggatgcccttctagataatccctttaaatgccaaaggaggagaggtcaagggggtcgtaaagggtcccgtggaggggctgaggaagctggagttgggggagcagtcactcaaagcgcccaggacaggggctactgaccaaccagtatggaagtatttccttttttttttttcccagagacaaagtcttgctctattgtccaggctggagtgccgtggtgccaacacggctcactgcagtcttgacttcccgggcttaagtgatccttaagccatctcagcttccccggtagctgggaccacaggcacctgccaccaagccaggctaattgtttaattgtttgtagagatgggggaggaggtctcactatgtttgcctaggctgatctagaactcctgggctcaagtaatcctcccaccttagcctctcaaagtgctgggattacaggcatgagccactgcatttgaccttatggaagtattttcatcctttaatacccgaccccagcatccagggcaacccagagggacaccagaccagggcccagaccacccactctctttctctcctccccacccccatttctgggagtcctcctggtctaccacctctccttcctgagccccttcttttgctctcaccccctccagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccgtgggtgcgggggctggggcggtgccggggtggggggctgggaatggggagatggatggagagaagctcagggataggggtgctggtaaggggattagagatggggatgggtagtgtcagcaaggttgatgggctcgagttggtattgaaggtggggggatgaatggggttgggatggggctatggctgggaagggggcttcggtgggagacgtggaagaggttggaagcagagcgatgtttcttcatcctcaaaggtgtcactcacctctcccacccatgtctcccccgacctttcctcctccaactactgtctctcccacctcagccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagtgtaggagcaccagaggggaacctggcagggggtggtgaggagggagtggtcaggattgtggaagggttcagggcatcagagatgcggttcacagtgacgatgtgggataagttgagaggatgtgtggaaaacgtcaggataggggggtggggacaaaagttggggccttggagtcagacggacgggatatgcaatcatacatccataacctcctggttgtaagaccttaggcaagcagcttcacctctctgaatcttgattttcttctctataaaatgagaatgattatacccacctgtcaggattggattagagataatgtatatcaagcaactgacataaatcatttattggatagcaggctgggcaccgtggctcacgcctgtaatcccagcactttgggaggccgaggtgggaagatcacctgaggtcaggactttgataccagcctggccaacgtggtgaaatcccatctctactaaaaatgtgaaaattagttgggcgtggttgtgtgcgcctgtaatcccagctactcgggaggttgaggcaggagaatcgcttaaacttgggagacggaggttgcagtgagccaagatcacgccactgcactccagcctgggcaacagagcaagactctgtctcgaaaaaaaaaaaaaaaaagctggatagcattgctgttgctattgttacaagaagagaggtgagttggctgcgtctaaggacagggattcccccaggggcgggatcacagcaagcactgcattaggggaggtggcagggggctcattcccacagcccctcacgctgtttccacagtacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccaggt

SEQ ID NO: 1691 - DNA, 18428 bp, Homo sapiens
attgtctggggctgagccccctactcccctccagcagacctcaaaggctccatatcgctctgctgcgaagacaatgaaaaaggggtggctacggaacggtgtctggttccccttgtccttccaccccaagctgctggggcctggccagctctcaaggcaagaaggaaaacatcctctgacatgtgccggggaggtcccatggctgacttgaacagggccgaaccatggcttgacagctcaaagcccctcccaacgacttccacatggttcttggtatctcggaagcttctagctgtgaccaggccctctccaaggccaccctagacacctaagatatattttaagtgtttggagatctgagtgctgtgagaaacaggggatttccccaaccttgtttctcccaagtggggagcgggagcaggtgagggagagaggagagggcatgagccagcccccccctcccgatttccccgtaaagtgatgcggccccatgtccctccttgttcccagaggaacctggggcccgctcctcccccctccaggccatgaggattctgcagttaatcctgcttgctctggcaacaggtacgcaggggatgggggcagggcaggatcctccctcttgaatctctgggatcccctaaccctctgtgtctggacagtgacagggctgattccaaattacagaacaacccataaggcacctgaactggagcagtggtcatgagggcctggatgcccttctagataatccctttaaatgccaaaggaggagaggtcaagggggtcgtaaagggtcccgtggaggggctgaggaagctggagttgggggagcagtcactcaaagcgcccaggacaggggctactgaccaaccagtatggaagtatttccttttttttttttcccagagacaaagtcttgctctattgtccaggctggagtgccgtggtgccaacacggctcactgcagtcttgacttcccgggcttaagtgatccttaagccatctcagcttccccggtagctgggaccacaggcacctgccaccaagccaggctaattgtttaattgtttgtagagatgggggaggaggtctcactatgtttgcctaggctgatctagaactcctgggctcaagtaatcctcccaccttagcctctcaaagtgctgggattacaggcatgagccactgcatttgaccttatggaagtattttcatcctttaatacccgaccccagcatccagggcaacccagagggacaccagaccagggcccagaccacccactctctttctctcctccccacccccatttctgggagtcctcctggtctaccacctctccttcctgagccccttcttttgctctcaccccctccagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccgtgggtgcgggggctggggcggtgccggggtggggggctgggaatggggagatggatggagagaagctcagggataggggtgctggtaaggggattagagatggggatgggtagtgtcagcaaggttgatgggctcgagttggtattgaaggtggggggatgaatggggttgggatggggctatggctgggaagggggcttcggtgggagacgtggaagaggttggaagcagagcgatgtttcttcatcctcaaaggtgtcactcacctctcccacccatgtctcccccgacctttcctcctccaactactgtctctcccacctcagccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagtgtaggagcaccagaggggaacctggcagggggtggtgaggagggagtggtcaggattgtggaagggttcagggcatcagagatgcggttcacagtgacgatgtgggataagttgagaggatgtgtggaaaacgtcaggataggggggtggggacaaaagttggggccttggagtcagacggacgggatatgcaatcatacatccataacctcctggttgtaagaccttaggcaagcagcttcacctctctgaatcttgattttcttctctataaaatgagaatgattatacccacctgtcaggattggattagagataatgtatatcaagcaactgacataaatcatttattggatagcaggctgggcaccgtggctcacgcctgtaatcccagcactttgggaggccgaggtgggaagatcacctgaggtcaggactttgataccagcctggccaacgtggtgaaatcccatctctactaaaaatgtgaaaattagttgggcgtggttgtgtgcgcctgtaatcccagctactcgggaggttgaggcaggagaatcgcttaaacttgggagacggaggttgcagtgagccaagatcacgccactgcactccagcctgggcaacagagcaagactctgtctcgaaaaaaaaaaaaaaaaagctggatagcattgctgttgctattgttacaagaagagaggtgagttggctgcgtctaaggacagggattcccccaggggcgggatcacagcaagcactgcattaggggaggtggcagggggctcattcccacagcccctcacgctgtttccacagtacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccaggtcagtgtggtctccaaccacagccccatccccatccccagcttcaatgacatctttaccgacatccacaatttcatccccaacctcaacccgccgacccctgcaactcccaatccatctcttcccctgttcccgtttctgacctcagcacaaacttcagctccatccccgtttccacaccatttccagctccaaccatccccaaactcgtttttgagcctaaccccatcctttatcccacccataatcccagctttatcgctaaacctatcacctttcccagtgcctacccatcctgtctcggccccactcctaagcaccgtccccacctcctccctggctaacaccatgctcaacgctttctctgaccgacattctctctccccgtgcccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaatctactgagtgcttactatgtgctagaccctgatccaatggcttttattttattttattttttgacagagtctcgctctgtcacccaggctggagtacagtggtgctatctctgctcactgcaacctccacctcctgggttcaagcaattctcctgcctcagcctcctgaatagctgggattacaggtgcctaccaccacatccggctaatttttgtattttttagtagagatggggcttcaccatgttggccaggctggtctcgaactcctgacctcagatgatctgccctccttggcctcccaaactcctgggattacagacgtgagccaccgcgcccgcccggctttcatttattaattaaaagaaattaaattaattaatctatttaggagacagtcttgctctgttgcccaggctggagtgcagtaacaatcacagctcacggcaatctcaatttcctggggtcaagtgattgtcctccctcagcctccagagtagctgggactacaggcacatgccacgaagcccagctaatttttgtatttttcgtagagacagaggtctcagtatgttgccccggctagtctcaaactcctgggctcaagcagtctgtcctcctcagcctccaaaagtggtgagattacaggcatgagtcgctgtgcctggcctccaagcactttcaaatgtatcaacttaatcctcacaaaaccctgtgaggtcggtactgttttcatacctattttatagttgaagaaacagacacagagaagcaaagtcacttgctcacagtcacgtggctaggagagcaaggatctgaagcaaggcgatctcttaattaccaagtgatgttcctggagtaaggctctgtttgtttcctttcctgtaaaatgctgcatgcaaaagtataacacagtaagtaaagaagtcagttagcctgcacatactaagacctaaccaaaggagcttattgtttttctccaacttccatgataggtaattagatagtggagacctctgctggccaatatggtagccactaaccgcagctggctcttccaattaaaattacataaagccagaaatgtaactcctctgtctcacttgttatatctccaaggctggatagccacatgtgactggtggtggctggattagctagtgcatataaaacatcactgcagaaagttcagctgagcagcactgagttagatggcctctgaagaggatgtcccacggagagaatccagaactcaggatctttttttttttttttctttgcgacagagtcttgctctgtcacccaggctggagtgcagtggcgtgatctcggctcactgcaacttctgcctcccaggttcaagcaattctcctgcctcagcctccctagtagctgggactacaggcctgtgccaacatccccagctaatttttgtgtctttttagtagagatggggtttcactatgttggccaggctggtctcgaactcctgacctcgtgatccgcccccccttggcctcccaaagtgctgggattacaggcgtgagccaccgcgcccggccagctcaggatcttttgggatggtctgttcacctcgcagaagtggctggcatgagcaataggagcccagagtggaaccagggccttctggttgtcaagtggacttgctgtgtgacctcctgtgagtctctgccctctctgagcctctcactcctcacctgagatgagggagttggctgaggtgatgccgatgcccctcacagctttgacctcctatgattcaggggcctgtgtgtcacctggtggcacacagatggcagggagggtgtgagatggccacacatgggtatgaggcagagccacagccccccccaacacgcacatgggctagtcactgggacacacacagagctcactcacggccacagagtgggcgtgggtttccctttttccttgtttctgtttctcttagcctcggcgcctccctccctccctctctctctctctctctctctctctctctctctctctggctcttttagccttggtttgttacaatctcccttttcaagccagcctctgtccctcctactcaacctgctttatctctaggccttcctccttcctcttccacagtctggcttctcacattgtcactctaggtatgcacttcccattgatttcctcttgctcagtggcctctcatccygccacccctagccttgctggggacgtgaaccctctccccgcgcctgggaagccttcttggcaccgggacccggrgaatccccacggaagccagttccaaaagggatgaaaagggggcgtttcgggcactgggagaagcctgtattccagggcccctcccagagcaggaatctgggacccaggagtgccagcctcacccacggtacaattagacagagggaaagggagggagcccgggggtgggggtaggggagggtggagaagcttccggactccttggggttaaaagggaaggtcccgccaggggtccctgggcagaggataccagcggcagaccacaggcagggcagaggcacgtctgggtcccctccctccttcctatcggcgactcccaggtgaagctacctgcaccccacccgggttggggtggattgcgagaggatgggtggggacccccgggccacaggcaggagccggcttagagcctcggtttctccacctgcgggacgcggaagtccccccgctgtgaggttgagaaagaggctcccactggctccgagcctcggatccccaccccgcgcgtgaaggagggggaaacctcgggcgcggcgtggctgcagccagggtagctggggcgcggagagcgctccactcgggcacagggaggacgggaagatgccgcgaggggcgtcattagggtaattgtgcccattaccgctgttccagcccgaatctcccgtctgccagcccctggggttatcggctgcaggtcaaaagggtgcttgcgggctggggtggcccaggctgggcggatgagcgcggcgaggtgggggtctctaacggagcatctgttttaacccgcccctgcacacaccccagcagatcctggccatgagagctccgcacctccacctctccgccgcctctggcgcccgggctctggcgaagctgctgccgctgctgatggcgcaactctggggtaaggtsggggrcagggggcggggagaggcgccggtgggaggcacgggcgggaggagaatgtgttcccgtcaccaagccccgcgcacctctcctcccccgagaccccagcacccacccagcgctccggagcacggcccgcccccaagtcagctgggcccttcttctggctcggcccctgggtgacccgccccactcaggccctgtccgatttctgccacccggatcctcgctcttccgtggactcttcgccgcgttctttctcctcctcttacgccgccccatcccggccccgctccattttacactaccgtgttttgttttgtttgtttgtttgtttgagacggagtctcgctctgtcgcccaggctggagtgcagtgrcgcgatctcggctcactgcaagctccgcctcccgggttcacaccattctcctgcctcagcctcccgagtagctgggactacaggcgcccgccaccaagcccggctagttttttgtatttttagtagagatgggatttcaccgtggtctcgatctcctggcctcgtgatccgcctgcctcggcctcccaaagtgctgggattacaagcgtgagccaccgctcccggccacaccacmgtgttttatcctgagtcttgccttaccgctttttgccctctcccctcactttttttcttcctctttccctttctctctcttttttctttttctttctttcttttctttctttcgttcttcttttccttccttcctttccttccttcctttcgtttgtttcttctttcttgttttactttctctcttattttttcttctttctttcttgtttttttctttctctctctttttctttccttcttttttttttttttttttttttgagacagggcagtgctctgtctccgtggctggagtacagtggcccaatcagagctcactgcagcctcgacctcctgggctcaagcgatactcagcctccagagtagctggtaccacaggcatgcaccaccacatccggctttttttttttttttttttttttttttttgagacagggtctcactctgtcgcccagactggagtgcagtggcccaatctcggctcattgcaacctccacctcctgggctcaagcgatcctcccacctcagcctcccaggtagctgtgactacaggcgcatgcctccgcgactacttttttgttgttgttgttgttgtttgtttgtttttgtagagactgggtcttgctgtgttgcccgggctggtcttgaattcccgagctcaagcggtccaaccgcctcggcttcccaaagtgctgggattacaggcgtaaaccactgcgccccacccctctcctggttttcaatcccgttttgttattcacaccccttcctctccccgatccccgagttctatccccgcacccttacctccccgccgcgttcaatccccgcccctctatcgaccagcgacgttctagccagctctccaggcgcgctgcgttcagtccctgccctccagacccaccctattctgtctcattactccacgctaccctatcccagcttccttccactttcacgcgcttcttctcctcccattcccttcggtgcacgcgaaacccccaatatttccctaccaccctcgcgttctggctgcgtcccccgtccccgaacgyagtccagtgccacagcccagctccaaccccaaacccagaccctgccctccgtgctttgattccgtcccctttctttctccagccgcagaggcggcgctgctcccccaaaacgacacgcgcttggaccccgaagcctatggckccccgtgcgcgcgcggctcgcagccctggcaggtctcgctcttcaacggcctctcgttccactgcgcgggtgtcctggtggaccagagttgggtgctgacggccgcgcactgcggaaacaagtaggagragatccatccccgaggacgccacggggggctgtggaggcggcctccagggaggagcgggcagggcggggtctctcggaactcccacagctggaggtgcggtccccggtgtccttccagcaggaggagagaccggssttgcgctgtggccgccaggggrcggtgtggtccttttccgcatttctgggcccgtcactcctctcccgctgattctccttgagctctaggaggaggtggttgcctgcaacggatagaagccagggtccggtgtggtcaggaatttagaactaaaggaaaaggttcacttcgtgagtccccgttgaaggaggaagggttgggtattaccacagagaaaatgtggagttgggctgggctcggtggctcacgcctgtaatcccagcactttgggaggccaaggcgggtggatcacctgaggtcaggagttcaagaccagcctggccaacatggtgaaaccacttctcaactaaaaataaaataaaataaaaaataaaaaattttaaaaaaattaaaaaaaaaaaaaggctgggtgtggtggtgggtgcctgtaatcccagctactcaggaaggaggctgaggcaggagaactgcttgaacctgggaggtggaggttgcagtgagccgagattgcgccattgcattctagcctgggtgacaagagcgaaactctgtttcaacaaagaaaagaaaaagagaaaagaaaatgtggaaggcttacctaggtgtccaggcccccagccctcctcaattcctgcagatcctcagagctcaaacaactgattcctcctccccatgtccactgaggtccccttctcccacaaggccctcttccctcagactcttcctatctccaggccctgcttcactgcccacctgctttcccagtccctrtgaagggtttgccttcacatgcctcttccttcccccaggccactgtgggctcgagtaggggatgaccacctgctgcttcttcagggmgagcagctccgccggacsactcgctctgttgtccatcccaagtaccaccagggctcaggccccatcctgccaaggcgaacggatgagcacgatctcatgttgctraagctggccakgcccgtagtgcyggggccccgcgtccgggccctgcagcttccctaccgctgtgctcagcccggagaccagtgccaggttgctggctggggcaccacggccgcccggagaggcaagagctggggctctgaggccrgaacctcaggaggagggggctgagggcctgaacccctgggtctgaggaaggatgggctggggactggattcctggatctgagggaggacgggctggggtcctagatgcctgggtctgtgagtctgaggggaggaggggctgggggcctggactcctgggtctaagtggggaggggctggggccaggattcttgagtctgaaggaggaggggctggggcttaggatagaaacggtcttgtatctggactcctggctccccaaggattgggggctggacccagggattactggcatattctcccttcagtgaagtacaacaagggcctgacctgctccagcatcactatcctgagccctaaagagtgtgaggtcttctaccctggcgtggtcaccaacaacatgatatgtgctggactggaccggggccaggacccttgccaggtagggtctgaacagggagagtctctgactcctgggagggaggacagggaggttatgggaaaagagcagaccctgtgcccgatccccarctccattcccaaacccatccttgaccccaactcttacccagacctaaccccctcctcatccctatcctcaatcccatttccatccyaaccccaccccattcccrtctccaagcccattttcatcccctcaccttccatgaactacaatcccaaccccagtctcactgtgccttcattctcatcccccagcccaacctcccataacctgaagtccacctccattcctaccttccagctcatacctaattccaaccccatcccatcctcgtctttatcccaacccaacyccttccttccccaccactgccccagatcccaaagtgacagctctcacgttggcacatttatttgatctctccttyctgccacccccagagtgactctggaggccccctggtctgtgacgagaccctccaaggcatcctctcgtggggtgtttacccctgtgtgctctgcccagcatccagctgtctacacccagatctgcaaatacatgtcctggatcaataaagtcatacgctccaactgatccagatrctacgctccagctgatccagatgttatgctcctgctgatccagatgcccagaggctccatcgtccatcctcttcctccccagtcggctgaactctccccttgtctgcactgttcaaacmtctgccgccctccacacctctaaacatctcccctctcacctcattcccccacctatccccattctctgcctgtactgaagctgaaatgcaggaagtggtggcaaaggtttattccagagaagccaggaagycggtcatcacccagcctctgagagcagttactggggtcacccaacctgacttcctctgccactcccygctgtgtgactttgggcaagccaagtgccctctctgaacctcagtttcctcatctgcaaaatgggaacaatgacgtgcctacctcttagacatgttgtgaggagactatgatataacatgtgtatgtaaatcttcakgtgattgtcatgtaaggcttaacacagtgggtggtgagttctgactaaaggttacctgttgtcgtgatctgaccacgtcccggtgaaagcgtgtgtccagggaagaagtgcacagggtagcccccaatcccaaccttccatccccaacccttagggatgatggaagaatcattttcctcaccctagttccaagtcccaggaaacaccttttaaccacttccttctcatctcccactgtttcccacttctggttccacccaacaccagttcctcctgccttggcacgagctaggctggccctgagtcattagcaccttytctgccttcatgaggccactgaactcaagggacctcaccttgcttccatcccagcctctaagaccagagggccgagggggtagtgaagattgggaaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagcctggccaaaatggtgaaatcccatctctactgaaaatacaaaaactagccaggcgtggtggcaggcacctataatcccatctacttgggaggctgaggcagaagaatcacttgaacccggggggcagaggttgcagtgagccaagattgcaccattgcactccatccagcctggacgaaagagcaaaactccatctcaaaaaaagaagaagtttgagtgtctcagcttatcctgaactttgaagaagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaatgtctgagcacacagctcccttccgtggcctctttcccattctgcccccattagcacacgcaggaaatgtcagtcaggcgtatcagctgggtttgtcatccgaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgttttttttttaatagcacctgttatacctgaaattatctcatttgtgtttacttgataatggtctatgtcacccttccccacaaattccgtgagggcagtgattcagatatttgttcactgtgattttctaagctcctgtattgtgcccggcacacagaagtcacccccgttgctgtgtgaacacataacacaaatagatcagtgctgtaacagaagggggtatggggtgcaccacaccaagtccacaggctgtgcctgaaggagtcaggaaaggcttctcaatgaggggacatttgtgcaggagtttaaaggataagtaggagttcaccaggtagagaaggaaatgcatttcaatcactttgctgtatgactttgagcaaattacttgaatgctgtctcttcctcagttttcactctgtgaaatggagacacctgcttaattagactcccgtgagagttaaatgagataggctgggcgcagtggctcactcctataatcccagaactttaggaggctgagatgggtggaatgcttgagctcaggagtttaagatcagcctgagcaacatagtgaaacctcgtctctactaaaaaaaaaaaaaaaaaaaaaaaaaaaattagccttgcatggtggtgcacaccttgtagtcctagctactcaggaggctgaggcaggaggaatacttgagtccaggaggttgaggctgcaatgaactatgatcatgccgctgcactccagccttggcaacagagaccctgtgtcaaaaaacaaaaaacaacaacaacaaaaggataattaaatgagataatatacatgcaaagttcacctaacaccaggcactgagaacacagtcaataaaggtagctattaaaatgctcattttttttttatttttcttttgagagtcttgctctgttgcccaggctggagtgcagtggcacgatctaggctcactgcaacctctgcctcccgggttcaagcaattctcctgcctcagcctcccgagtagctgggattacaggccgcccgccaccatgcctggctaatttttgtgtttttaatagagtcagagtttcaccatgttggccaggctggtcttgaactcctgacctcaagtgatccacccacctcggtcccccaaagtgctgagattacaggcgtgagccaccgcgcttggtctaaaatgctcttaatagcagttaaggtggcacttagcacatagtggatacccagtccctgatctcaaggacttccctgtctggaaagggagtgagacaactgcaggcaagggtgaaatgagctatgataaaggcaccacaggtttctgcaggggatgaagagacattgaacatttaccatgtgtcagacactgttgtgcttcatgtgtgtaaatttgcttaatccccccaacgaccctcgttattactgctacttaacagatggagcaggccaggtgcggtggctcacgcctgtaatcccagcactttgggaggctgaggcaggcggatcacgaagtcaagagttggagaccagactggccaacatggtgaaaccccgtctctactaaaagtacagaaattagccaggtgtcttggcgcacgcctttagtcccagctacttgggaggtcgaggcaggagaattgcttgaacccaggaggcagaggttgcagtgagctgagatcgcgccactgtacttcagcctgggtgtcagagcaatactccgttttggaaaacaaacaaacaaacaaacaaacaaaaaacagatggagcaactgagagaggtcttgtgacttgcccaaagtcacacacctcatcactaatcacacctaatcattgagatttggacacacatggttcagttccagagtccatgctccaaaccatgacgacacagtgagagaacattcaaggggagcccagacccagcttcataaccaggcctgtgagcaggagaaagtggaagggatcgtaagtgcccaggggaggcaaagatggactctgcctgaggatctcagagatttcctggaggagggagaattgaggttgggtgttgaaggatgagtgggagttcaccaggaaaagaaggatatggagaaagacattcactcattcaatgaacatctcctgaggacttctgcaagccctgttccgcctggaacggggtgatgctgggacacagagatgagtcagacctgggcccagccctccagaagctgtccacctggtgagaaggaatgatgaggagagaggcagggaggatggggtgatggaagggacaatggggtggggggcagggagatggatgaaaaaaatatatagcaaatgttctcaggatttggcaaagatcaggatgtattaagagagagcacagggcacttgctacctggaaggttgggcacctgggtccttgggtggtggagccgtggggaagggggcaggttatgacaagagtgggttaatccagatggaaccagatttctcaacattctaggagagggccttgtccttgtgggaagaggcccaaatccccagggcagggaaggttctgcaaggtgtgtaaacctgtgcagctgcctgtggtctctgcctcactccacctggatttccctcaatctttctcgtgttctgtctcctcctcccactcctcctctcatcttgggtccttctgtgcctgtacctccctctctttgtatcttttgctcttgtgtctgagtcctgactctgtcttccacccctcgcctcctttctgggtggtccccctgcacatccctccagcctgccgtgggaggttggtctctgcacaccactgctttatccaaaataaacctgctgcaccccaggaccttaggcttcaaggatctccctccttttccaggacacaaaagattctgtatcttgtagcctaaggtgatgaggaatgaggtctcccactctgaagaccccagaggaggtgcccacaacctctccacacccccagcactcctcctccattcagtcaagctctggcccagcaagccgccagttcatcccaaaaggggggtccccctgcacttacctcctctcccaaggcccctgtcacagccccagggcttccccctcccccaggtacatttcccaaccccgattaatcacaggggcggccccatggaggaggaaggagatggcatggcttaccataaagaagcactggacgccgggtgcacgttccaggatccaggtgcccaggggtcatgaagctgggactcctctgtgctctgctctctctgctggcaggtgaggctcccaggctggctgccccttcacggctgtactaaggtcaccttgctcttccctcccatcccaggcttctgcctcctgccctctaggcttctcagcatcctctccctgccctcccagcctgctcttcgctgacccctttgtccctcatccccaccccagggcatggctgggcagacacccgtgccatcggggccgaggaatgtcgccccaactcccagccttggcaggccggcctcttccaccttactcggctcttctgtggggcgaccctcatcagtgaccgctggctgctcacagctgcccactgccgcaagccgtgagtgacccaggctggccatgctggggagggacagaggctgggggtcaggagagggtgaggggtgctttaggccagaagtgcggagcctccacttctgataccacaagttcaactcttagaagtaggaagggtagcctcccaaatcctaaaattctagagaccagcaatatctcatttgagaagtctaagattcgaaacttaggctcttcgaatccgagactgacccagagaaatccagaatcgtagaatcctaaaatcttgaatttatgaaattctgcaatagcctcagcaaattttagaatcatagattcgcagactattagaatcttagcagtctgggtcagcactgcccagaggaattatgatgccagccacatgtgtaagtttaaatttctggtggacacatttaaaaaataaggaatgagtaaaattaattctaatagatttaacttgacatacccaaaaacttattttgacatgtaatcaatttttaaatacgtatgaatgatacagtttacttttgttttggtactaagcctttgaaatctgttctgtattttacacatatagcctgttacaaaatggactagccacatttcaagtgttcaatagccataatggctagtgtgatcctagaatcttaaattcagagctttctagattcattgaatattgaaactcacagtactagaatctttgattcacagtatcctagaatattgagattcagataattctgtagtcttaaactatttgaatcccagactcttaaatttctaaggttatagatttatagaatgatgacattctagtctttctttttttttttttttttttttttgagacagagtctccctctatctcccaggctggagtgcagtggcacaatctcagctcactgcaacctctgcctctcgggttcaagcaattctcctgcctcagcctcctgagtagctgggattacaggtatgcaccaccatgccaggctattttttttttttttttttttttagtagagacgggggtttcaccatattggccaggctggtcttgaactcctgaccttgtgatctgcccgcctcggcctcccaaagtgctgggattacaggcgtgagccaccgcgcccagccaaaattctagtctttttgtcctagaacattaaaattctatgttcaaatcttagatttaattcagataatgttagaatcctggagtttttttgatccaggggaatctggaatgttagaatcttggattcataaaactctaaaccttgagcctctagattctagaatcatggataatagtgtgtcggaatctgagaattctagaatcttaggttctgggcattctaatagtatcctggaatccacctgatgcaggaatcctctctccattgcctctgaaaagtgaccat

SEQ ID NO: 1692 - DNA, 12977 bp, Homo sapiens
ctatggggtgggaattgatgttccattccacagctgactccactgaagcccatgaggaagaaattggcccaaatcacagtcccctctgattacagaacagaaaaagtcagctaaaatctcaggatcacttttttcaggtgatgggaggatttcagaagttctgtggacacctgaaattgggcacaaaatcaggtgtttcatgccagtgggcattttccaggtagagggatcatatttctctcgagagtctaaaagtgtgttgaacaagcccactctttacagatggggagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaaggtacaggggagtgttggtggccatctgggtcaatgtagggagggcgagggtggtctgggcttggtggcaccgactgacactccttcctcatagagtcatgcaagggccgctgcactgagggcttcaacgtggacaagaagtgccagtgtgacgagctctgctcttactaccagagctgctgcacagactatacggctgagtgcaagccccaaggtgtgttcagagcccaggtgggtgggctggggtgccccctgctgctggagactcactaccatccactctctgcagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgaggtgaatccagggcaggtactggggatgcgggtctgccccaggagcgtccctgctctcacaccatctcctccactctagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaaggtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacctggacctgggaacggctgccttagggcaagggactctgcctctgtgcccagccagcggcctccataccccttttcactttccccacctcttagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacacttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctggtatggagagagggcaagtcttgcttctccctcaaaagggctgaaaccccttggtattggtagagccaggccggctggagggggctgtggttgtggagctatcgatcaaagtctgtttgctcaggccagactttgcttctgttgaccttttggggaaagctcagctctacctggaccccacaccttggactttgcctagcacagctgagagcacagccagcagagggaggggctgtggctgaggagtttagggggcctgggggggtggggtcgagacaccagtgatatggtggagggaaagcacagggggaagggaattggactgagagtcaaaggcctggctctgccattcgctgctgtgtgtctttgggcaaggtgcagcagatgaactctaatggccccgctggaaggggcaagattcggacccccaagacctctcattcaccccttccctgccacagctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggaggtaggagccgctgccacccctgaagctggtctagcttgggttttccttgctgtccctggtgcacaagggctgaacgcagcctgcaagtagtgaccacagaaagccaggccagaagtccttagctgcatcatggatgttcactttcccttctgggagagaccctagacttctcaagggaagagtgggcagggccaggctgggcctcacgcatcctctgctttcctctcttccagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagtttaaaattattgttctgactggggtagacacatccctgtctgggtaaaggagaggaagctggactgtcagaatgggttggtgagggggacagagaagggacagagaagggcctcgccgtgtccaacccatgttgggctcaggacctctctgtgctcaggacctctctgtgaaccggtttggggctggggaaggcctcctgagagctacccttcctcttgagctaagcagcccccagcaacccaccagcagctaagcagacacttgaactcctctgatgatgacaaagttaccaggccagcctccgtgggtgaggcttgctttgccccttggagttgactagggtcttggaggagagagaaggggcaagagttggtggggttctggctcagcttttttgtccatcctgatctgaaatcctagtagctctgactcctgagcacttggggaaccagtcactgtgcttccccaaacccacccctagggtgagcctttcttgaggtctctgtctagggtctaggatggggagcagcaagaccaggagagatagtgaagggcagaaactgaaaggaaattcaaaagcacacacttcttgtggaaaagtggcccaggagcccaggagtttgaagctgcagtgagctattattgtaccactgcactccaacctggggaatagagtgagactctatctctaaaaacagaacaaaataaaaaagggggggaatttttgtctgggcatggtggctcatgcctgtaattccagcactttgggaagccaaggtgggaggattgctggaatcccgaagtttgagaccagcctaggcaatatagcaagacaccatctctacaaaaataaataagttagctgggcaacttatgggtggtgtgtgcctgtagtcccagctatttaggaggctgaggtgggaggattgcttgagcttgggaggttgaggctgcagtgagcagaaatcacaccactgtactccagcctgggcaacagagtgagaaaaagaaaatttaggccaggcacggtggttcatgcctgtagtcccagcactttgggaaaccaaggcgcgtggatcatgaggttaggagttcgagaccagcctggccaacatggtgaaaccccgtctctactaaaaatacaaaaaattagccgggtgtggtggcaggcgcctgtaaccccagctactccggaggaagaggcaggaggtggagttgcttgaactcgggaggtggaggttgcagtgagccaagatcacgccactgcactccagcctgggtgacaaagcaagactccatcttgaaaaaaaaagaaaaaagaaaaaaattttcaaaatttaagaaaaagtggctcagaatatatccaaggaagagaatactgtacacataaacatctttatcatctttcttagaacccctcaactgcacctgtggaacctcctctggttccaggttccgaaccccaggaagtccatctggctcttgaggggccagagagagaaagggttagatgaggcaaagctctaaagcagacctgagggcaatctggtggtgacatctgttccccagtcctgctgacagcggctggctcccattcatcccgttgacaccctaccatccttctcatcctgtcccacttcaccagcccagtccccagttgtgggagaggactccactccctctcccctgaaggtagccaggttcagagcactaagggctccagaaggggcagccagtgcctgggagcactggagagatggttttctttggctgcctggaaggacccctgggaggattttcatgaagtataggatttcaggcacagactgccagtttgaggtttgagaagggatgctgggtccagcttcctttgcgaggccttggaggggcagggggtatacaatttgccccacccataccctcataagcccaacccggcctccagcctcccttcttccccaccgagacttctctgccttgcttgagctggactctaaacctctccactcctgaaggcggggccagccaccctgagcatgataaaacccaaatgggggggtctggtgtgggcacagccctggcatggccctctggcacggccctctggcaccttaccctttgccagctccatgcccagccctgtggatgcatcctcagcaggtgatctgatgggggaagtgtgggcagggtgagaacgcaggccatggtaggatgaggacggttggagaggggtgggagtagggacttcggggttgattgagggctttgaggctgggtggaggctcttgcagggagtcccagcttgacccccaccatggcctgcagacggtggcagcgggttgggttcccaccggagaaagcggaccaccttcagcaaagggcagctrctggagctggagagggcgtttgcagcatggccctaccccaacatcagcacccatgagcacctggcctgggtcacttgccttcctgaggccaaggtacaggtgagctgtgaccccttctcacacagccaacatctaggcttggcccacagccccttsgctgggtagcctgccttcaggttgtttcccctgtccctgggtggaggggatgctggggccagaacagaccccttcttctttcctagcaggtgtggttccagaagcgctgggccaaaataatcaagaacaggaagtcaggaattctaagccctgggtctgagtgcccccagagctcctgttctcttccagacaccctccagcagccctgggatccccaaatgccaggccaacctccaccctccagcggcacacctcagcgcacctcagtgtgtcgacatagctcctgtccagctcctggcttgagtccacggcagggctgggaaggggctaaagctgtagccccatggggatcagctggggcttcagaggtccacccttctttagagcgagctactccccagacttcactaggcagcctgtctgacctcatctatgcctyggccattgtcgtcaatgtggaccactcctagtctttgtccagaacttgcaaggcccctcctctgactcctgtggcccaccctgcccctcctgggattgaacacatcagaagtggattccctggccccactttttatgcaaagggattccctacgggaaaggagtttagctcaggcatccctcccttccactggcctccaggccagcctagatgcaggtcctaagcagactggggcctggctcctgccaccccacaccctgacccctttggggcatatgctcattgttgtggcaggtggtaccttcagaaggatgagatgagggtcatgttttcctccactcttgccaggcctggtccccagttctcaccagctgatggcctcctccttctgaaggggcaggctcctgtctcctgaggtctctccaggccattaccttgctaactgctaagtgaggtaggagaggagagtgctgctcctcatctagactgctggagagccaacttctttatgggtcagggccccctctcttgaccatcgaccacctggacaaattaatcagaactacggatgtgaagagggagtggcattaaagtaatgaagcaaagataggaagctggggcttatgttgatttaattttcacaaagatcagattggatgccctctgatgtggggctgtggagacaacctgacagatctgggatggaggcaggtatagcagcattgggttttggtatcaccatcacctgtaataccaactaatctccaaataaaacccaaactctgtaccttaatctggattgttgtgctctgcaaacgaacggggacgagggccgtttgccatggaaatttatctccatcacctaatccctaaatagggccaggttccacacagatacctcttggtgggaggtattacccaggcttcagctgggattagagggatagttaattgaagggtttaggactctgactgacaagaccctggggagatgagagcctctgctagcacccccagctcctggtcccactgaatctaggacattccagtcacctccacctctggagctgctctgctttggagagaaaaccatggtgtttgcggtctgcactggattcaaatcctgactttgcgatgtaactgtggcaactctggaactctatgtgactaaaaaatggggatacttatttgctctctgtttggggtataagaaataatgtaggtaaagggctttacatggtgtgtaacacatcgtaaaaactcagtaaacgctagttccctctccagacaggccctaagaaactgggaaggccctaaacttcttgttcttcccacctcctgccaagcagtccctggacccagagtgcattacagaaagcatggcacagtgaggcaggagtggctagcagatgagagagctcccttctatatgctgagaactggaggatagggcatttggttctcccctcccagtgccccctgctttttcattgagacaaggtctcactctgtcatccaggctagagtgcaatagcatgatcttggcttactcagcttactgcaacctctgcctcccaggctcaagtgatcctcccaccttagcctcctgagtagctgggactacaggcgtgcgctaccatgtcagctaatttctgcgtttttttgtagagatgggctttcgccatgttgcccaggctggtctcaaactcctgaactcaagcatcctcccaccttggtctcccaaagtgctgggattacaggcatgtaccaccacgcctggctaatttttttgtatttttagtaaagatggggtttcgctatattggccatgctggtcttaaactcccaacctcaagtgatccgcctgcctcagcctcccaaaatgctacgattacaggtgtgagccacctcacctggcccagtgtagctttttaacacaaattttatatagctcaggttactggaaacactgtaaaatgccacctactttttcttttcacagctgacacttctcccaactaacagaaactggcaaacattgtagaggaagtgtccactgagtgaatgagtatataatttatgaaaacagaaaagtgctttggaaaaaaaaaaaaagacaacaggagtacatacagtgaaccaaaaagagtgtaccaggaggagcagaccctgaacagttagaactatggaaatcgctatgctttgtgttgtcacaggagttaaaataggaataccctgcatacaataaatatttattggataaataactaagcctgatacccttttcaatgcgttatacagactctatcatcacaccactaatctaagttctcagaagttaaacattacaagacttcagaacaacataggcgtctttggctccatttaacagaagaaggaccatagtgatcatttaatctctatgagtctgtcttatcttctggaaaaggggcctaacaccatttccttttgcaaaaaggtagctgccttgcttccagttctaccatcctctagcaacccatctttctcttatttgatgtctctgatcagctcctcttccagcacaaactggagaaaggggatcctttctgttttcttggaggcttctgaactcaattacaggtctgcattaaaaatgtatggagaaagctggtgattagtttgtacatatggacaagttcaaggcagtatggtctacttctgggaaggcctggattccatttgctcctgatggaaaaaccctagtcccagcagtgtttagaatgaactggagaaggcagatgggtaccagattcaggaagaggtactgatagaccaagaccagttctttctgttttaaagatgtgttatctcaatctcctccaatgctccctttggaaattcacagaagattagggctccccacagaaacagcagctggcctgggctggtcttctgactaactggagctgaatacaaaaagtctgatgggttgactgagtcggtgactgccaattggagcctgaagcccccaaagtcttctctagacttgatgatgaagcaccagttacagttctcccagctcgccttccattgcccgcaccatgacatacagctcggccagacccaccacagaggcgacgatcaatgcagctagcacccgctggagatggggagaaccaggcttaagggatgcaggccaacaaccagctctgtaccccagcaactttaatgaggatggagagccccccaaccaccctctaagttgggggaggggaagaaaagagaatgtggcttctcctggggttattacctaacctcccgtgactgctggaaagctctaatgctccccttattaatggcataaatatctgttcaatacctaacctgtgcaaggcactttcacatacgtcctcccttacccactaacacccccaccaggggcaccctgccctgcccagtgcctactcaccgaggccatttctgtgaagatatattggcttccaaggtaagtgcagacgaaggcagcaaccaccgtgacaatgaaattgaagatggtgatgaccagagccttcaatgatctcactttggggaggagccagagagggcacctttagttcaacattctctaggaggtgctcttatctcatggctcccccaccaactgggtttcagtcaaacaacaagcctgagtgtcatgacccatctcaggaaaaggttttagaagcctgatctcctagtacctcaccttgctttcccaggtcgctgagagtcccaccatgtcttgtatcctgggaaaaagaaaaagaagatgattcagaatagaagcagctcagagagcatccattgacagtctgggctcagccctctctattccccaacatattaactctgccctccccatggattcttttgtctggaaccattttgactcttttctggactacagagcaggcatttcggagagaggacataggctgccagtacccatctactctcctgttccagggtaggagcatgccatagagtagtagggagccctgtcagaagaaatgctcgaatggctgggcacagtggctcaccttgtaatcccagcactttgggaggccgaggcaggaggatcaccttgaggctgggagttcaagaccagcctggccaacgtggtctctactaaaaatacaaaaaattagcctggcgtggtggtgcatgcctgtaatcccagctacttgggaggctgaggcataagaatcacttaaacctggaaggcggaggccgcagtgagcagagatcctgccactgccctccagcctgggtgacagagtgagactccatctcaaaaaaaaaaaagaagaagaaaaaaagcctccaagattcattcccacttatttatttatttatttatttattttgagatggagtcttgctcttgttgctcaggctggagtgcaatggtgcagtgttggctcacagcagcctctgcctccgcctcctgggttcaagtgattctcctgcctcagcctctcgagtagctgggattacaggtgcccgccaccacgccaggctaagttttgtattttttgtaaagacggggtttcaccatgttggccaggctggtcacgaactcccgacctcaagtgatccacctacctcagcctcccaaagtgctaggattacaggcatgagccgccgtgcccggctaactcccacttctatgacgtttaaaacttggtcaccatctcagcccagagtctcagtgaatgagatgggaactgtgttgtttgtatgcagacttcctatggtccctgaacagtatagaaaccaagtttccatgttttttctaaactctgtatcttcttccactgcagggccctactctgaggggctacctagaccacgtactgaagagcatgtccttacctgacaagtgacgttgcgggtgatccgtttatattcctcattggccagctgtatcttaatcttctccagccgggcaactagttctgggttctgaagcagaaaaatcaaatgagaagaatgatattcccagcttgttagaaagcacatcacaatcattggttccaggggtaaagcactgctaaaggtatcaggagacccacatactagtcgtaactccagtgctttgaaactgttttttttttttttgatctcaattttccaaacagctgatggggaggacaatatctggctcccccagatcccaaagatttcaaaaacaatttttcaagcctaaaagttgatttataagttcagtgtatcatggataagcccaactcagtcaataaccactctcacaaacatatcccttacatacccgtggaggcttcacaacctctgggagatagatttcactgccttctaggagctcatggaggtatagtttggaatctgagaagaaaaggtttcacaaacacaatgatccacgagctgaggttgaagggttaagatcaagaggggtgtagcccttctttctaccaaaataaaacagggccatctctacattaatccatttccaggatcattttcaattgaaaagaattttggataattccatgtaggtatctcccagtgctgcgcaggtgactttagctgtcagctctcaattatcctgccagtgttataactaacaagtaagccatttacttgtgcctttgggttagatcagttctgtggccacaacagctcttccctaaataagtttaggtcatagtgatgctaaatgctcagaggacactaatactaggcaatctctttctaaggtcctttctagttctaataattgagcagtctaccctttgcacttctggctggtctatgttacttctggcaaaataccttatgtgctagtttgtcctgttccttccctttacacataagggaactgaggcccagcgaggagaaatgactccttcaaaggattagtgacagagctaggactggaactcacatgctactctcaggccagatctttcaacacagcttttgccatcctatattaaaaaaacaaacaaacaaaacaaagtatcagatttc

SEQ ID NO: 1693 - DNA, 18235 bp, Homo sapiens
tgcaagcctcagcctgattttatgattcgcacacctgctccatgggtatgacctcatccaacccctgtgaggtccctcccatttccaccccaccgcaacggaagaccccttcgcagatgagcacctgacacccagagagctgatgcttctcacaaggggcaccaggaccccgagaaccattctcttgattccacttctgcagcctgggtgaccttcaccagtgacccccgcactcccgtctgctcatgtgttaaatgaatgaatcgtcataatttactatatgctctgagctcctaacacaaactaagtcgttactcctcgaaaaactctacgaggggatcctctgattttaaggataagaaactgagacacagagaagaaaaaactcttaccagggtctcccaaaatagtaagtagtggaacagagatctgcacccatgctgtctggatccagacccagcgccctgaaacagcagcttgtctggttccagaaggaacggaggccgtggtgagactaagttagaagagggccagcacctcatggggaggcccttcgggcaccacgagtccagtcccgctccggaggtgggcagtctgcaggccccctgagaagggggtttgaggggaggctttttcctgctggggaatctcaaagggcttaaaactgcagaccgagaagccgggaccttgcccaggggtgatggggagctgcaagggaaggctgtgagcaggggaggggcggggtgatctccaagtgcagagagaccctctagggccacgtggtgaccgacaggaggctgtcctcccggacaggaggagcgagggtccagagagagaggaggacgtctgagctggagccaggccaaggggacagagaggaggggacggggcagagagaggcaggggccgaagggacaaggctggggaccgatgggctgtaggggataaggggagagatggggcaaggtcagtgccaagggcgtctggccgaataactgggtggtcggtgacgctgcccctgagatgaagaacgtggaagaacagggaaggagggtttggggaaatagagcaatgagttgggactcggtaagtgagaggggcctagggacagtggtgcagggggcgcccaggagcaggtggctgcccaagccggagttcagggtcagatggaggagacctgcgtggttggtggatgaaccacgggagttgatgaaaaactcccagggaacgttctcaggaggaggagccgggcaaaagtgagactcaggccgcggtgggcgggacccaggccgcggtggaggtgaaggacgtccgcggacacgtccaggaggacatcgatcgcgcgagcctgagccagacacagtgggcggggacggggcgccgacgtcaccgcgtgggggcggggctgcgggagccgctggctgcgcgccctccagggagccgagcgcagaccgggtgcgcgcctgggttcggcgcggcgggagcgccctcagtgtccccgtctgtatcaggggtgcttcatcagtacctgcctaggctggttaggaggaggagcacgtgcgatcgtgacgggaagcgctcagcacagacctggcaccgaggaagtcccaggggctcggctcctttccctcgtcaccaccgcgccccaacagagggaggcggctgcaggggtggcggcgaaagggcccaccgggcgttccggagtcggaacactgattcctctcccgcgtggcctctcgcttctgcaggaaccttgcttgtgctgcctcctgtctgggcctcagtttcctccgtattcagcaggaagccataaggttattaatataaacacctcacagggctgccgggagccggagtgagatcctacaaagagagcacttggcacggaggagtggcctgcagccgcattccataaacagggctgctcagctgaagcggtggcccagggtgaggcccgcagactttgagcatcaatttgtggggagggaggcaaagggacataggagttctagaatagcttccaacctggggatctattatgtctgccggtctgggcttgtagaatgtctggagacccgacgttctagaatgcatgaggtttctggggactccagagtgcccgatgttcgaaggttctagagtgtttggagctctgtggttctaggctattctaaaatcttaccttccagagtgtcctccactgccagaatgtcttagggcctgtgcttttagaatctgaaagtctgatattctagaaattccaggggcctgtagttctagaatggctgaatccttcccataaagatgatgactttccacacatggggagagaccacgcttacaacaggtcccatccttcactgggtgacctgagtgaggtcagtccctcctgtctcgggacctcctcattaattaagccaaaatagactctagataattgcttggggccctctggggttctgagacattggaagccagcctcaaatacccaaagccttgggtcatctcagtgatcatctccagcctctgggatgcagaatccagatttcaagctctagaacccagaaataagactacaggaccagaatagagaccctgggttcccagactctaaattcagactctagagtcaagattctagcaatctcagaatcgtgaaagccaggtccctgtctctcaattcagccttttaaaaatttatttacttatttatttatttatttagatttttcatagagatgaggtattgctgtgttgcccaggctggtctcaaacccttcagttccagcaatcctcctacctcagcctcccaaaggcatgagtcactgggcccagccacagtccaggttttcaatgcaaaaacagatttgaaactccagactgtatgttccaaagtctactcctgaaagctcagaggctagatccaccctgtagaatccagaccccaagcctggcatggtggctcacgcctgtaatcccagcactttaggaggctgagtcaggtggatcacttgagatgaggagttcgacaccagcctggccaacatggtgaaaccctgtctctactaaaaatataaaaattagctgggcgtggtggtggtcgcctgtaatcccagctactcaggaggctgaggcaggagaatctattgagcccaggaagtggaggttgcagtgatctgagatcgcgctattgcactccagcctgggtgacaagagcgaaacttcatctcagaaaaaaaaaaaaaaaaagaatccagaccccacaattcaaaatcccaaatctaccatttgtagtctaggccccaggcttctcatagcaggtgcaaaggtttccagcctcgattgccagattccaaacaccagattccaggctcctattgtgggttctagattcgaatgccccgggatccagaatcaaggttcacgatctgtcactcaaaggcccgactccaggatccagattccagacccccagcccaagaactcagactttgaaatccatattccagactgcaggtcattaatctccaactcaagatcctcaaatccagaatccaagacccagatccagaaccagatccggatccagaacccgggatccagaactctgccccaagcccaagaacagggactttaggatccagtttccacactccagaccccaaattccagactctgtcttttgatctcctcctaatttctgtttttgtcctcctgtcccctcccccttgaggaactgctcctggtggagaattcctctttgtggactcagacaacagcttcaacctaataaatgctcattaggccaagtctcccaccccaccagcaaccaaggcgtctctgcctgtaaacctgactctcagccacctcccaccccaccctacaccaccacacccccagacccagctgggactgggagcttataaattcaggcatcctggtacctgctcccttctggcacccaagctgccctagatgctgctggaggatctggaggaggtgagagctttgagacaagactgagggaggggcaaaggggagattcactgtgccctggtttcaaggggaaacgttgaccacgcttggagaactgagtgtcaagggcatgggtagatccacgtgtcctttaccaatgccccaaattgaacctgaaccaagaaaatgtcctggaatggccagaaggagctgcagtggtggggagggagggggatggagtggatcaggaggacgtccctgaagtacttgtatcagagccaagaacgtggtcaggagtgatcacgggttcaagtcagttcagcacaacctcccggaggcctcctgtgtaccaggccccaggtggggcagtgctgaggtcacagaaagaacctgacctgagccccatcttcaagacccccagatggagaaaagaacaggccagacctcagcaagtatggggcatctgcgctgtaatggagacagaatgggtgctgtgggattcaggggagacacctgttaggtgttggggcctcccagaagaggtgggggcagagtgtcagaggacaaagatgaatttggaagatatggggaagaaggatttcaattcaccctcaaagcttcctgaggcctcccgtgggtcgggccctgcagtactggagacccagagtggagtcagaccagctcctcggggagctgccagtctcgtaggggaggcagacaccactgagggtcaggggaggtcagagaaggcctcaaggaggaagcggggctggaagggaatggcgttggatatgcggtgggaggaatagcctaagcatgaaatggcaggagggaaaatggcagcactggctgcgtctaggacaaggtcatgggagacccagggagaggggctggaagggaagaagccacttttgtccttgaaagtgaggctggagccaggcaactcatgcctgtaatcccagcactttgggaggctgaggcgggtggatcactagaggtcaggagttcaagaccagcctggccaacatggtgaaactccgtctctactaaaattacaaaaattagctgggcgtggtggcacacacctgtaatcccaattgcttgggaggctgaggcaggagaatctcttgaacccagaaggcagaggttacagtgagcggagatcacgccactccactccaacctgggctacagagccagactccgtctcaaaaaaaaaaaaaaaaaagaaaaaaaaagaaagaaagtgaatttgaagagctggactttatcctggtggtgccaaggatccatggagggtggtgagcaggggaggggcacagccagctccagatgtagaaagaccctttggggtcatggctggagggcaagctggtggaggggactggactggagggggacccaaaaggccagataagaggttgagatagaccaggcgcggtggctcatgcctgtaatcccagcactttgggaggccgaggtgggtggatcatgaagtcaagagattgaggccatcctggctaacacggtgaaaccctgtctctacttaaaaaaaaaaaatttccaaaaaattagccgggcacggtggtgggcgcctgtagtcccagctactcgggaggctgaggcgggagaatggtgtgaacctgggaggtggagcttgcagtgagccgacattgtgccactgcactccagcctgggtgacagagtgagactccgtctcaaaaaaaaaaaaaagttgggacaggggtccttggtgatgatggagagagatccaggggctggtagcatggtgctggaggctgacaggtggaggaggtggggcagggtctgtccgagtgcctagaggaagagtaaaccttccagagatgggggacccagaaggaagcgcagagtggggttgggggaaggggataccggtggtcagaagaaatttattaacagtggatgggataagtctgtgtctggagggatcctggtggaggcagaagggtcctgcctcacctggattctctcactccctccccagactgcagccgaaccctggtccctcctccacaatgtggcttctcctcactctctccttcctgctggcatccacaggtgaggtggccccaggagggggccaggtctgtgggagcaggtgcccccttcccaagcatgtctgggcccagtgatctgccagcccctacctcacccagagaccactaaagatccttccttcaccctccacctgtgccaatgtccctaagcccttaccgtcaggtgctggtgctgctgctctggagtcgctatgttgcctggggcctctcgctgcccacgacaaggaacacggtcctggggttacacaaacctgagctgagtcctggggcaaccgcttccttgctgtgtgtccttgagggaactgcttcacctctctgggcttcgaatgccttctctataagacagcacccrcttgagacaataacagtgaggtctcaatagcataacagaggtaatatacatagcaagcattagacaagtgctgagaggccaacagcacagacagactccagcttgagtcccacrcctgccactccctgtctcttacagggtctttgaggggattaaatgtggttgtgtgtgaggcagaagcataagcctggcycaggtagtgcccyttcaggtgtgcaagccaggcacggtgcttagagcttacatacaacgtctatgtgtggtgggcaccmccgacctcatttgacaagggaaggggctgtggctcagagggacggccacaacatcaaggtcaccttgggtgtcaggcaaactccagattgaactcagctgccacacaccaagaaattaattgtaacctgatgcctctcttctggagaaattggggggtggactttcattaacgttctgccacaaatgaccctcactcctgggggcccytsagacccccacgcctccagcctcccctccggctctctctgtgcactcacctacctgcctygcgcctgcctgctgcgcccagctggggcctccaccttcctctggcttggactggccaggtgcagcctcggtgcccagctgttcagcccgtaccctccgcccttcggaggacgacctcacccttcctttgttaagcccctygtccaccacatccgcattcccctggtctcacgggggcctttggcccagttcctgactgtgatggggagagtgtgggcatttggtctggctgtgcaaatcctgcccctgtgtgggtgggagtgtgcatggcttcaaccttcaggggatgcatccacattgcccagtggagaggggtcctggtcctgtgaccttgaatgtctctaatcatgtccttaagcataatgccattctgtgtgtgtgtgtgtgtgtgtgtgtgkacatgcacgtgtgcagtgggtatacaaggccctgtatgttcacatcctctccacatgcatgagccagatccccatatgtgaaacccaatcagtgactccacagatctggcttgggggctgatctagagatggataaatatgtcctgccctggctgcctctggcttcagctgcatgtctytgaccttgaatgcccagccccgtgtctgggtgctgccccagacagcaagtccacatctgagtgttggccttctgggttggtgtctgcagctctaactctacaaaatgtcttgtgggtgaatcacggttttaaccttgacttttttttgtttgtttggttttttttgagacggagtctcgctctgccgcccaagctggagttcagtggtgcaacctcagctcactgcaacctccgcctcccaggttcaagcaattctgtctctgcctcccgagtagctagaattacaggcacgcaccaccacgcccagctgatttttgtatttttatttatttatttatttattttttagtagagacgggatttcacgatgttggccaggctggtctcaaactcctgacctcaggtgatccacccacctcggccttggcctcccaaagtgctgggattacaggcgtgagccaccacacctggccaaccttgactatttattataggtaattctgtgcagatgtctgacttatgttggccatctccaggatggacctgaactttcacacgtatgtccctrtgactaaatccaggtgtcatttgcaaaaaacaactaatattattaagtagctaccagggctaggtatcactcaccatacatacacacatgcacacacacacatacacattcctacctcatccttacaacaatcttcattttacagatgaggaaacagaggcacagacaggtcgaataacttactcaaartttcacagctagtacattcgaacccaggcttaaggacccatctttgtccagaccctgtatgcaagtgtctgtgacactggatgccaagactcacactagagatgttgaatttaggtctgaacaatatccaattctgtgtgtgtgtttgtgtgtgcatgtgtgtgtgtgttgtattcatgtcttaaccatccatattcatatacacatatgaacatctgtgctgtgattcttttttttttttttttttttttttgagatggagtttcactcttgtcacccaggctggagtgcaatggagcaacctccgctcactgcaatctccgcctcccgggttcaagcgattttcctgcctcagcctccagagtagctgggattacaggcacccgccaccatgcccagctaattttttgtatttttgttagagacagggtttccccatattggccaggctggtctcgaactcctgacctcaggtgatccacccgcctcggcctcccaaagtgctgggattacaggcatgagccaccgtgcccagcctgtgctgtgattcttgaagctgcaacccatgtgcatgcaagtgaatttcagcttccagtcctgtccatagctgtacctaagtgtggaagctggatgtgcatgtatgcatgtccatgaccttgtatagccacatctgggactcatactgcacactgaatttggctgacatgtccagactctggggccaaggctgggtcacacatactgagtggccacatgcgtttgacgtctgtgacaatttggtgaccgtgaatgactggtttcaagtgaccacctgtctgaacctgtatccagtgcccctgtctccacccccaaccacagaggacttcttgccctctggtctgttccccttsctctctctcccagagtcttatagcaaatggggtgggggctagagttctggagaaaacaggcagcggttgtaaataaacaacagggcaggcggagcatggtggctcacacctgtaatcccagcactttgggaggctgaggcgggcagagcatttgaagtcagaagtttgagactaccctggctaacatggtgagacctcgtctctactaaaaatacaaaaattagccaggtgtggtggcgggcacctcagctactcgggaggctgaggcaggaggatcacttgaacccaggaggcggaagttgcagtgagctgagatcatgccactgcactccagcctgggcaaaagagtgagactccgtctcaaaaacaacaacaacaacaaaacaaaaaacagggcagggtgtcttgagaagttaggggaaaggcataggcatatagtagttagggcagggtgcaaggaaggtgtaggaggcaatgtaaacgtccctgtcctcaggcatcctctaccccttctcttagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcmcactgccaaagccggtatgaaggcaggggctcarggtcctgagggagcctggttcggggggaagagctcctakatttgggggaagacggaggcagacgccasaactcctgggttctgaaagacgaggaggccggatgtcaagcccctgggttaggaaggagtgtgtgtttcaaagccttcgatctctgaaggaggaaggagaagactagttccagcttttgagcctcagttctagggatgtgagaatcctggattcggggacagaccaggagggggctgggagtagttggaggggatcgagttctaggagtgtgcctgacttcagactcgttggtccttgaggagcaggggctggaaccattggcttcagggtcttgggaaaaggtaatgggatgtcgagatttctaaagggtcgggagacctcgggttgcccactctttgatctttctgtcctctacttgcgggtaaccactggcccgcactccactggcgggaaaaccactcgcccscacagcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctayccacgcgttgcccccacccgggggaggcctgtgtggtgtctggctggggcctggtgtcccacaacgagcctgggaccgctgggagcccccggtcacaaggtgcgtgaaaggatggagctggatgcgaggcctcaaggaatcctatgctccagggctcttgggcggaggggacaagggccggaatttatggatctgctccaagtccactgtcttccccagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgaggtcagagcctagaggggccatcaggcggaagaagagggatggggacaggtgtgggagtccggatggggttggattttctttgctttgggccagagaagatgctagggtkaggcttggagatggagtaggaagagaagttagaataggggtgaggttggagttggggttataggtggggattgcgttgtttgaggtggataatgtgatagttagtttgagatggcatgggttggggttgagaatgggaatggtttggtttgattctgggtgggaaatacgtcagggttgaattgggatgaggtagattttgtttggaatgcagaagacatgaagattgagattggattttgagatgggcatgggtttgatttgattttgaatggtgaggatgtgggctgagttggatttaacttagtacagttgcactggagttgcatgggggtragattggatataggttgggtgagttgtattgagctgtgttgaattggggttggggttggggttgggttggctctgtttgggataaactgggctgtattgagttgagttgggttggggttccctgggatggggatggattgggtttggggtgagattgcaaatggtgattaggatgaggatgaatccaggaggtttcactcaacctgagaccccctcttttccccacagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactgagtaaataccctctatctctggatcccagttaaaggacctaacagacactagattaccaagaatggctttttctttaaggtttagttctgggccgggcatggtggctcacacctgtaatcccagcactttgggaggccaaggcgggcggctcacttgaggtcaggagtgcaagaccagcctggccaacatggtgaaaccccatctctactaaaaatactaaaaaaatttagccgggcgtggtggcacacgactgtaatcctagctacttgggagggtgatgtgggaggatcgcttgaacttaggaggcaggagttgcagtgagccgagatcgcgccactgcactccagcctggtgacagagcaagactccatctcagaaaaaaaaaaaaaaaaaaaaagatttagttctgggcttcctggtagccatggcaaaaaggcaaatactgtcctttccttagccaggtccctgatatacagcagaggctggaactctgagctgctttgattttaccaaaaagccaagacaacctgttggaagcctatgggtttaccattgaggctgcaggaatctagttcctaattatcttcagagaccacaaaatgtgatgttcaaggtcgctgaatgttgaagtacatgaacctggctcgtgagacctaaatattgtactggtggtgggggggaagggtcattggaatctgtggttagcctgatcttgacctgggagggaaggttgtccagatctctgggactttggaggacaggacgttgagcacccataactgggagcaagaagtgggaggctcattgagaccccagcattgtttgggagggacactggattttgtaatgctaaagaacttaccctgggagacccctgaaacttcacattcctggatctggaggcactaggaatgtggtgatgtgtaccccaaaattttattatgaaaggaacagtagctttggggacctaggtcctgggtctgggagtgcaagaaccagggcattctgaaggccaaggcttatatttcagggggaactggcagctgagatgctagtatcttggctccgagtggtgcagggaatcagagccctaactgctggtgtttgagggcaccaggtctgggggtgcagggccttaattgagactgaggtatatggggctttgtaccaggggtcactgattcctccgtcttcctgtttctgcttcccctcagtccccccttgcctcactggctgctccccagagcaaagccccagagccacaggccctgccccacctggcttcaaccccaggaatgcgtccagcgtgatccagggcctgcagaacaggtgctggttctccctccccgtctacagctctggggatcggaggggggggggcaattgtccagcccccaggcaacaggggaagggccttggccaacatctgggtgccagcagggcaggggtggggctctgaggggataagggcttttaaaagcctccccagggaggttccccagttcctccacctgctggcccctggacacctctgtcaccatgtggttcctggttctgtgcctcgccctgtccctgggggggactggtgagacagtggggggatgtgggagggggaacgggccctgattctcttgctggcctcacatccccccccgataagaccttcccctccaacaccccaccctcatccctctggcccacagtctatcctagtccggggtgccccggctcttatctatcttgcgcggccccaccctaaacttccacccccgctcctccatgttgtcatagtgctcactcccacaccagattcctgctcctcccaggaagcctcagtactttctcctcttccctagccaacgccctgtcccaccgctttaccaaaggggcagattctgggccatctctgtctctctctggaggaccccaaccctcccatgggcttcccccaccccacaggactctgatcatcccctcctgccccctagttccctgcggccacctatttggctcctgagtctacaaatcccaccacactccagtgactttttccatccagctgtccgctctcaactgtgtcctccagaccctgacatctggtctccccagtccttccagggtcccccaaatttcaccagaaaaccctgcttcccaaactggcatgtgggatcccccatctggtatgggggggggtctgcaaatgtcccttcccacccagcacccccagctctcccaggaaaaacaccacaccctcccaccacatgctcctttccttggggaagttccatcccgccccaggccccagcccttctctgcctgaattgttcctacacagctctggttttctggaaccccacgccaaggatcctgaatgccttctcagccagcgcttctgccctggcctcccccaagtcagtatgtgattctacaacctcacatcaagtgggtcctgcattgcattcccacagctgcttggcgcctgttctcaccacttctccaatcctcttcctaggattgcctccaagaggaccccatatccttccagtaccctcagaccatgaaccccatccccatgagaaacgaagatcccatccttcaccctgtccgagaaggactgccactcacgcctccctcctcctgagccccgtcccagtcctgaccgcaactgtgttctcagggccccaacctcccctcagattgccattcctggttcacaggaaggaccccaaaacctctcggaagcccacctctagccttaaccatagccctttcttttaccctttaaccaggaagccctgaaatctaactgtcccagccaagctggccccttccaaccccaatgtagggaccccaagtcacccccaaactcttcagtccagatgctcttctttacctctcagacctggttccctaaagctgcatcctttcctgaacctcaaaagcccaacccaggtcctgtttccctagcctaggagccccttagccctccagattcttcctcagtgagcctctgatcctgtcccacccttggcgccttgatccctggtttccagaatccctttccactcccctaacccaccacctcccatcccccagccccagaccccaaatgacctgacgcccagatgcagtgtctgctccagacactgtctcctgtctcctaccctgatccctggaggctgctctactgtcagagcacaaaatctccccaccaggtccagccaccactccaaaagcccagggaacagtccagagtcccaccccttcccaacaccccttgcccatgtccccaacctccagccctggtcctctacccgcaatgtcccttcagacccacagcccagctccctctcctagccttgtccctggcctctcctgccaaccctgcccttcctgacccagcaccgcctctgcaggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgagtgagtaggggcctggggtctgggaggagggcatctatgctgccacaggattgacaggccagtggcattccccttggataacctcaggcaagactggggggctgaggcagagaggaaggctctggcgcaggtcgcctggcagggcagagctgggctggacacccctctccaaggctgcctgggtctcttgggatctggttctgcttgtgtctctgtgtgactgtgttctggtctctgtcttcctctctctcctctgtctccttgtctctgcatctcccctgtctctgtctgtctctgagtctctctgcggcatctctgtcactgtgtctcaccctccatctctctacccatctctctctctctgggtctctacctcaccgctccctcatccctactaaacacacacccagatggacctaagggaggccccagagtaaaggaagggctttatccccaacttgtgtgcctgggagggggcgcctctccctctgtccagctccccgccccacaggatatccctccactctggagagacacagggaagggctggtttcagcgggagctgggtggggcaactgagggaggaggaaggaggaggcggggcgagaaacgcgcgggagggtgctgggaagggaagggggcctcgaccttggacttcaggccaggccacctgcccctggggagcccgcaccacagccccagctgcagctgagccgctctcaggcctcccctcctccctacctgcccccaccctccccacctgcccccaccctcccccagggcctccctcccttttctctcccacactcggtcactcctgcttcctctctgcctctgtttctagttctcactctgacgtcccgcgtcctttttcatttgtctgcttctcgctcccttccgtgttctgttccctcttcctccctcttccctgggcctgtttctcgctgtccctgtcttttatccttctcatctgcctcttttttgctcaccctgtttctcactgccctcccctccgcctttctcacccctctgtccttttgagctcttttttgctctgtctcttcatttgccttttgcactctcaaactctttcatcttcccattcgctgtctgtatttctccataactatatctttcttcctctgtctccgcccacccacatttttctctttccctttctctctttggggaccctcccccatgctcccctgccccatccccttttccccttcccgtcttctcatccctccattcccatctttccccagcaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagacgctgtgaaggtcgtggagttgcccaccgaggaacccgaagtggggagcacctgtttggcttccggctggggcagcatcgaaccagagaattgtatgtgggggcagactgtgtagcccaaggcggggatggggactcctgcgtccaagggagaaagggccagggaagcaggtgaggtcgggctgcagccctttttctcccgggttcgtagtctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtggtgaggcagccctgcccccagggtctggaagggctgagggaggggactcagcctctgaactggcttctgagagctaaccaggcatctgcttcactgcttcccagctagctgtagccactcgccccatcagtgccccagctccccctccttcccccgcccatccagggacaactgcatctcaccccccacaccagagttcaccgttcctcgtggtaatgtgttgttaccgtcgagtcagagagtagtcctggagaggtggcctctgcgatgtgcccgcaggggcagcgtcctgcagatggtcctgcccctcctccccctaacctgtctgcaggcactgtccacctggaccctgccccatgtgcaggagctggaccctgaggtcccttcccccttggccaggactggagaccctgtcccctctgtgggaatccctgcccaccttcctctgggagtgggcactggaggccctgtctgcgagctggggctccccaggcagaacttgggccccgtagacctttctcactctcccctcccaccttgtgctcccagggtgattcagggggcccgctgatgtgtgatggtgtgctccaaggtgtcacatcatggggct

SEQ ID NO: 1694 - DNA, 29871 bp, Homo sapiens
  misc_feature (1)...(29871): n = A,T,C or G, or insertion/deletion polymorphism (see Tables 1-2)
aatacaaaatacagcgcctggcacagacctggtgcttatcaggtatttgcacaataactattttgcagaatgaacagcaggcttaaaaaagcagatgcccatctgctcattcagagcacccagctcccaagagcactacaccatcagcagaaattggaaacattccttcaccaccaaaggtgaggccagcagtgtctgtgactgcaaaacatgtacccagcatggggggatccagtggtcaccgccccattcaaggcaagcacaggtgttttcaaaaatgatctgtaaggctactaagagttaaaggtgtttctgccttaaaagcaaatgaaacaactaaaaagtcactgcccagggatttgagtcttttctttccacttctattattgagagagcctccagaagactacagctaagagggctgttattttcctactagaagagcagctgaggaaaggtaaaacagagcgagaatgatcatctatttactgtacaaccgctagtccgccactaagagaagtatgcaaacaagagcctccagaagatggctattccaccagtacatcaattaaccaaatagtgtaatgatacacacaatgtcactgacatgccagtacatcaatcagctacagagtataaaaccatgtgtggtccaaaaggaccctacaataatccccaagaatgctacgtggcacagtagctcatgtctatcagcccaactacttgggaggttgaggcaagaggatcacttgagcccaggagttcaaggctacagtgagccatgatcacaccactgcactccagccaggataataaagacctcatttttttaaaaaaaagtaaaataaaataaaaagatgctcccatgtgacagtcttacaatgcaggctagtgtctccaaagaagacttactgagctacacagaggaagctggacattaggaatcccacccagaaacatttgttaacccttacgaaatcactgattaagtttcaccagattcactgcttcaactttccaggtacccgtatttaggggggaaaaatccattcaccccaaatgaaatgattactggaccaaaattagttaacccaatcagaactacttgagtggccaagccattatcatcctataaagctggaaaggtttttgtatttctcaaaatcttatgactctcatcacaaatgagaccggaagaaatacaacgtttagcatggaagcatttgaactgtaggcacttttgctaacctacactttttttttttttttttttttgagatggagtcttgctctgtcactcaggctggagtgcaatggcgccatcttgtctcgctgcaacctctgcctcccaggttcaagtgattctcccacctcagcctcccgagtagctgggactacaggcgcacaccaccacacgcggctaatttttgtattgtatttttcgtagagacggggttttgccgtgctcgccaggctggtctcaaactcccgaccacaggtgatccgcccgcctcggcctcccaaagtgctgggattacaggcgtgagccatggcacccagccttatctacattttatttcatgaaaagagttgtgggaaaatgtgaaggctgccagtccatcattttcttggttactttggatccttctcctttgttgcaagaatcataaatattcccaattcttttacaggcaaaaatgaaacgtgtgcccaaatatgtcctttaaaaataaacattaaacattatgagggaaacaactggcattgtggaaaatgtctgtgcaccctggctaagcaactcactattgcttggattatattaatatacacaccataaagctaaggaagaacttaaatttgagcctctgcatttctgtgctgagtaagctgtagttctttcgacttatcgccttcatacttgcctgtccaaacaaaaagatctcaagaattccactgaaatagtccaaacaagagcttaaacttacaaagctgtttttcagagctcaatagtacaacaacaggaagtagaacttctgggatggggattttgctatttattttttctttcaatggccacttttaagcaagagagaaaaaagtctacaggcattacaaatcctggaagctatgaatcaggaagtgggaaatggctgatcctgaaatggccagcctgaaaatcctggctcttttatgtagtcaagtctctgaagccaggaatttcagaaatcttaggcattttgcattattttctgaatcttaaaagagctgagacttgagagaaaagagaagggccaggataaatgaaccaataaggaagcccccagtctccagctccatgcccctaccaccacacaaatcttgcccctataattacaagctcagttgggacatgctccttacaaatgacgtttgtttacaatgctgctaaggagagggggtgatagcccatggtttctgcagacagagcctgccccaggcttcagctttctcattctttcccaatgttgaatctggaatggactcgggaccctaaatatttcacaactccaaacaccctgcagttgattaaaaacaatggtcacttttgttttcaggaaagactatacctgatttttgctaagtctaagtaaaatgcaaagacccatgcaatgaacctgcatgaatgctttcagacatgcagatttggagggggacactgctctcttttgagcaaatggagatccagtaacagagcggggctcactctgcaatggctgcatttgcatcaacgtgagacaccaaacaaatgcccgcacacaggagtctactatgtggatcgagggaaaagagggcacctttatccttccaaatatgacaactcaatagaaaacttctcattccaaagtcctaagggtccctacaacaggaagctactggagcttgtgaaatatttccagttattttctacagaaattaaacatatcaattctaccggcaggtcatgtgagatgacaggtttaaaaatgtatgttgattgggggagaaaagcaaagaaaaaaaatagaagaaaataaagtcatttcctgtgtcagttgtaatttgggaggcttttttccagtgcccttctaagtaaatctgccataatcaaatgtagtcaaatataactgcaatgtgcaaaagcacagtgatgacctgagaggaaggtgccactaagaacccctgggaccagtcttctatctcttccatcagacatccactactacctccccaaaaaggctcagggttatttcataaacaccagtagcctcccatgtatttaacttagcacaaataagagaaccaatatgtaagggattttttttgctcttaagaaccaaccattcctcttaccccagcctttacagacctggaaaaccatccctgatttgcccccagcctcatcccccactacaacttaaacaaaccttcctctccagccttgcttccagccccaaaatacatttttaaagttctgatgccaagaccaccccatcaagtctagtataatccttctgatcatctaagtaccctcctccaggagacctccaagatccctctgggcaaaatgatctcttcctccaattccagggctctttcccagtgtgctcactccatcctcactcataaaagcatctggttccattccacagctgggcacaccttatcttctcaagagacaatgtaagctctttataaaacaggggctgcattttacacacctcacatacctcctgcaggtccccgaacatccaaacactccaaatttgtctctgtctccaaatcctacaaaaccaaattctctctacccagctcagctcagcatccctggggccccgatctacctcatctgcctcctctgctctagagtaaaagcaacaccagtcacccccactctgccgcccactgtagccgaatccaagtggcactctcagcccatgctcttatcagtgcactgggggcaggcctaccatctaccaagcaccagaaatgcccctccgagctttgtgcagcccccttgccaggcagacagcctccagggccaggttcggcacgggaagctagaacacggggctgactgcacagcctggggcagacacacctcagcttccacacccacctgacaaggctgcccagaggatggagggaagtcagtgtttcacccactgccctaatgggaagacagtgtttctcacccactgctcaagcctggaagcaaaaggtcccaatgttcctactcgatgacccgccctgtcatgccctgtccagatatctaaccctcacctttctctgtccatcaagcagtaagaattcatagcagccagcacatatgaccctgagggcaacgttctaacaaagccaaagaaaaggtggcacactggccttcaattcaaagcccagggtggcaagaaaagggtcactagttccctgaaaataactggcatgcaaaattcaaacaggtaattggggtggagttcatggaaaagggaagagaaaacctcacatgggtttgtatacccttcatttaagcacactgtcttcaggcagcagaggtttcaaggtgcatgctaaaaacccttgcgcaggtttcagagagcagataaaaggggctaaccaggctctcaggaagcccaatccgcacacgcacggagccgagccagtggaaaccataagcctgtctcatctgtctctaaactgctcacaggatgaacaggaaggcttgatcgatactgattttacagtcataggagtgactcatcacgaaattctacccagcttaaagctcagctgtgaacagaaacaaaacaacataatggcagggtcagatttaaaatagtaagtatgactggtaaacagttaatgctcataaacaattaacaatcaccttcccagcctcctggatttgctgggagaggaaaaagtactactgagggctctgaagcgggctgcagcagtaagtctgtcttctgtggcagccccttccaactcactgatgctggtgtcagctttacaaaaccctggagggtcacgaggagctgcttttaatagaattccacacatctgatgggtacgtgctcactgaggaggggagagaggaggaatgtacttacatggaacagagttttcagagagtgaaatttaagctctcctggagtataacttcctctatgtagctcctgcagagtttaaaataagcaacttatctgtcctaaaatgagagaaatggggtcatataaaatttctcaataattgagttcctctcaaactgcattcactttaaggaaagcactggggtgctcagaaggtgcactacacatttcaggcatttggttacagaggcgaatgtgctcagcgccatcctgaagacatgtactttcaagtactggattccatgtaaattttaatgatctgtaaccaactctcagacctggccaagaacttccatagagaatcctggtctggagatcccttcactatggcacactgctccactgttctgaactgcatgactgtgtcccctccaattcatatactgaagccccaacccccagataccttcagtggtatctgaaggtggggccttagggaggtaatcaggtttagatgaggtcctgagggtagagcccccataatggcaacaatgcccttacataaagaggaagagaccagagccccttgctctctccaccctgtgaggacacatgacatttgtcatctgcaagccaagaaatggacccttaacagaaaccaaatttggtcggcaccttgatctcagacttccagcctccagaactgtgagaaacataagtctgtggttttagccctcagtctatagtaacctgtcacagcagtctgagctaagacatccatacagccccgtaagagaaccaacccagggacgagcaacacctctcatcatctgacaccacctcctgcctgacgaccaggcaaaacaagcacatacacaaacaagcaaaaggggaggatgagagtggtcattcgggtttgctttggaggtccagagaaaatgcaagtccaacttccaggcacagaccagttgcycgcagcaggcttcctcccattggtctcagaccaaggtgagccactcccccgggcgggacagagaaagctcctctggaagccagacaagctcggccacctcgaagtcttctttggaatccagcaggtccaggcctgagccctggcgcctggttaaaccaaargatgacaaccaagcagaaaaaaatagccccagagagtatctgctggagaggcagacaggcggacctggccttcgacacacagcatgcgtgccatggtctctagcagcgcgtccctccaagcttcctggcctgtaaggcgaagcctctagcccttttctacttttaggatgctcagattcttgcctgcagaggtcaatccctttctttcaagggctcccccctctgtaatgagggagtccatttacaataaaaaaaaaattgagctgtcaaaacaaatgaaaaacttccagtataatcataatcagtgagggaatcaaacatctaaacaaatctctcttctggaaaaataagaaaatgaaaaagcaattacacgtcacatggctgattagcaataaatttcatttgtgactacrgtggcatgagagtttgactcctgacttgctttccttgaaagaaaaaaattatctgcaatactgtctcttgatatagaaaacagacccattccatctgactcagctcaaacctgcgttttttttcaaggcctctcctgacctcacagttcccccgcagtgatcccgtggtacctaggaccgccatggacaaggactggtctccttgaatttgtctccccaactattccacacatatactcgcataaacaattgagaaataagctttttaaaattgtggtaaaatatacacaacaaagaatttaacattttaacccttgttaagtgtatagttcactgacactgattcacaatgttgctcaaccaccgtaaccatccacctctagaacttttacatgttcccaaactgaaactctgtacccattaaacaccaattcctcattgctccctccccccagcctctattcaccgcccctcaccattctactttccgtctctatgaatgtgactactctacatagctcacgtaagggtaacaattatgcactgtttgtcctttcatgactggcttctttcacttcgcagagtgtcttcaaggttcacagacattgtagcacatcatagaatttccttcctttttaaggctcaatgatattccattgtatggatagaccacattttgtttatccacccgtctatggatggacccttgagttgctttcactttttggctattttgaattatttgctgccatgaacatgggtgtacaaatatctgttcgagcccctgctttcacttctttttgggcatataccccaaagtggaattgctggatcatatggcaattctatgatgaatttattgaggaagcaccatatcatcttcctgttaaaaaaaaaaaaggctgtgccattttaacagtctcaccagtaaggcacaagggttccaacatctccacatcctggcctatgcttgctatcatctggtgtttttggtaatagccatactaatgagtatgaagtaccaattgtgggtctgacttacatttcaccaatgactagtgactttcaacatcttttcatgtgcctatttgcctcaagtagtaagttttaaatcaaaagaattaacccctcctcctaagagacctctcatcacagaaagcaaacagtagtatccttacctactagcattgttaaattggttagtctgggctcaaaacacttttgttttccttgcaaataccaccataggcaatattcgcttagcaaagaccattcaagtccatctaccaagttgcctaaacaggactaaccttgaattctggtctcaggaagaccttgtgcgatccagggagcagagcaagagagcagctccttctcgcaccatcctgcatcaggcaacacactgcagctggcttcccacctgactgaagccttctcctgttctggcagccatgggccgctccagctggggatgctcatccttgcaagcagccatccacgcacaaagggcacaggttctcagggttctccacattcaatttaaaataccctaatttgtgttgcagatacttaatctaagtgtttttcagatcctgtgccctaaattttggctggaaacatagtcccactcacatccctcatgctcgtgaccaggctcttccccaggccacatgacccccaattacctccccctccttgaagaaggaagagactgaagggcgaagggacatccacagttcacattgataacgcaaatgatccatcaccatggcctcaaaagggccttggaatccaaatgacccacttactggaggaggatgcttcaaacggaggcagatgcagagtcaggagggagacagggacagaaaaggaggaagctgtgctgctatccccagtggagcgcttgtcaaactctctttacaagaaatgaagctgggttcctgccgggcgcggtggctcacgcctttaatcccagcactttgggaggccgaggtgggcggatcacaaggtcaggagatcaagaccatcctggctaacacggtgaaaccccatctctactaaaaatacaaaaattagtgtggcagcggacgcctgtagtcccagctgctggggaggctgaggcaggagaatggcgtgaacccgggaggtggagcttgcagtgagccaagattgcgccaccacactccagcctggacgacagagcgagattccatccaaaaaaaaaaaaaaaaatgaagctggttcctaattctgcagtcaaaaaaaaacggcaaatgtagctaggagcaaaacatcagaatcaatacacacccaaagggtatttttttttttaaaggaagtaaataacttctaatgcgtatttcctctatccttagcaacaatagtatcagctaactcctagtgtttataaaccctaggttctaagaaatgtgtatgtattcactcatgaagtattggtaacgatcctccaagatgggtgacactttttttttttttttttgacatggagtctcactctcgcccaggctggagtgcagtggcgcgatcttggctcactgcaacctccaacctccaacctccaacctccaacctccacctcccaggttcaagtgattctcctgcctcagcctcctgagtagctgggattacaggtgcatgccactgtgcctggctaatttttatatttttagtagagacagggtttcaccatgttagccaggctggtctcgaactcctgatttcaggtgatccgctcacctcggcctcccaaagtgctgggattacaggcatgagccaccgcactcggcctgatgggtggcattatcttccattttacagatgaggaaaggagagcagagagggtcaataacgtgccccggtacaatgcatcagtagacttctaattctccaaccctcatctcagaggggaatggtgtcakgaaacaagactggggggaaaagggagaaggcctgctttctagtcgagaaaagcggagaccgtctgaaactctacttgctccaacaggtsaacgtgattgaaaattcagaattcactctcctaatagcaggaaagtrttacaaaagcccacaggccaaatgataccaccctcccaggaagtctcttgcagaactgtgttttttaatgttatttgtcaagtgaaaacagttacagtggcagaacaggcagcacccagagagtggcactaatcgtgggctaaggatgggcaattgcttctcatcaagaaccacaatgtgtccagtcaatttacaaacataaatcaacacaagttcaaaagcaccagtagcaaagtccaggcctggatgtgaagctggcacccctctttaaacaaactgttcctcttcacttgcatggtaaggactggaaagagccctgccgcgttggccagctcttcagggtagcgggggccacygccctctcccagcctcgggaagcccaaggccactgcatcagcctggcccagcccagaaccagcctcgggcccagccggcccaactcagaaaaaggcaggggtcagtctccagcctggactcctctaaaaatcagaaagcagtgccccagcaaaygaacaacaacagcgctcacctgaaacagtttcaccttcatttttagaggagaggaacacaataggagggcgtattactccacgggttttaaccctagcccttgatgctaccaggtatccatgatgcccctaataaaggtgacagttcctycacttttctaacatccagctattctttaaaaaagttgaacactgcagtttccggagaactttgctatgtgaattgcctcactgcaggtgtgctctcccctagctctctccattccatgccttaaaagtgccaggtgtctcctcgggagctgccctgtgctaccgcccccagtcctgcagccaacctgttttgcgggtcctgcctctccatcaactgggactgctctctcgacaaaccaccccagcccacagctcctctggcaacccagcccctcacaccgaggacccatctcaccagtcacctccctcagstgggccaacctgtccagtccattcctgcttcctggtctcaggtctagagacaagacttccctccctgagcctgtcctcactgcctccctcatctataccatcactggctcacaccggggtgtctatctgtcccccaatcctgactccatcgagagaccagagcagcctccccagaacacccttctcagcgggtccactgcaatggtgcaaaggtttcagcgctcctcattctctagccagcagtcaattccttcccaccacacaaacaccggattctgacaccctctccactccatcagtgcacactgccacccacaccacacatggtcccttcctctcctggggagctgcctccttggatcttgagagtcaaatatttagggcacactaaagtcagacatcctccttaaagcttctcaagccattctgcagttccgtgaccccactgcctgcagcccacatacttctctccggtcagcatcccataacttagcactaaactcatagcatctgttactctccaccagtagttgagttttcccaactagacaacaagctcgagtaaaaaaaaaaaatcatattctttcatatgctttccatggagcagagaccactggaggccctcaaataatctagatatcagaaacagggttccatactctgtcaccactcaccttccactcccactccccttccacagatagggacatgaccttgaaccagtcagcctggttaacctaaaaacccattctcttcaggcacagagaagcaaggtggttacttagtggtttcaacaactgacctgagactcagacgtccgggttcaaacctttcactgtagatgtgcaaaaaaagaccctccttggccagccacagtggctcacatctgtaatcccagcactatgggaggccgaggtcggtggattgcttgaggccaggagtttgagaccagcctgaccaacatgcctaaaccccgtctctactagaaaaaaaaaaaattagccaggcgtggtggcacacgcctgtaatcccagcttcttgggaagctgatccacaagaattgtttgaacctgggaggaagaggttgcagtaaggcagaggttgcagtgagcggagattgcaccactgcactccagcctgggcaacagagcaagactgtctcaaaaaaaaaaaaaaaaaaaaagggccytattcaactggcagcaattccccagtgttgtggggaaggaggactggaggccccagagagagcccaccagggccacccaccatgaggaggagaaaaaaagagaaaagcatccatttattggatgctttctatttgccaggtttgctgggcagcttggatacattatctattgctaattctcattggcatccctgctagagcagtgttattccaatcacaggcagagacactgaggcctggagctccctttccaacatgcctccatgcgtgggagagagggagacagtgaattgtttgaggggacaaggcttcaaaggaagccctgcacatatgcaaaccgcacggagaagagcagagcaaagacaggccaggctgtccagctaagttcacatccagccggttcagcattcacatgagaatttcacaagatgcttttttacaagctactcttgaatattaacattccagcttcaaatgattatgtttacattnnnnnnnnnnnnnnnnnnnnccaccccactcctcggaagaggagactttaaggataatttctaaggtgttcattaagttcaggagtccccttgacaccaacctagacaagtaagctttcttctgtccagaggtcgggagctggcctcaccgtcgccctaccaggacactgtcaaaggccttcaccagcaaccaaaaccggcagggttggrgagggtgcttcaatgatagagagacctgtaagaccttgctactgtccctcccaggagtgaggcaaaagcttactggcctcaccaagaaaacaatgcaaaaaatagaagccaacttccatacgtggtgattctgcttgttccaaccacatctccctcaaatctccatctctctctctgcctagtatcttgagatctgaaggctggaagggcctgtgaaatgacctaggtccaccctgtaactcaaggtcagcaggtgtgcaagtaccctacccacccaactttctgagatgccaccctggccctctgcaccaggccactccggagaccaccaggcagccgagtccagcctgcagatgcttcctcctcaggaacccagctccargagggtttaaaagcacactacagacataaatcggtgccaatgaattattcattacatcttatctatagggaacttatggaacaaagtctccatccacagggatgaggtgatcttgacacaaggccagactcacaaattacccttccaggagttctaattttttttattcacctcaatgtgcaaaaagcctaatcaaacaatgattttaaagataattttattgctttcaagttccatgcagcagtaactggtgtgataaaatgttttggctagcagaggtgcaatgatcagatgaaaataaatttgttgtacaaagaagtgcttcaaagtgaatggcgagtatccctttaagaagtcttccgtttcttcagctcctcctatgcaccaggcactgggccacctcctgggaattcaaagataaccaaggtaccattcccctccccaatggtgggggaaagcaatatgggggagatgcccaaataggaggtatagcaagagaccacaggagctcaagtcagtgcaatcattctgcatgcagaatcaaggccagagagagggtgaaattacagctaactcttaaaggagcttgccagagggcaagctgrtagtattgtttgctattccaagcagaggggcttccacctgccaagacaaaragacacgaatgagtacagcctgaactgttcaaaatgtctgggaggaagggaggctgaagttctctctcagacagccaaacaaagatttccgaattaaaaataataaaaggcaatcatggggaaacaggtttaaggcttttgacacgtaaaactgaataaccagctatatattttgtgtaatctcagcaagaaagattctgaaaatatcaataaaacatgaaacaaaatacataaaattagctagcgaaatatagacggtgtgggacctaacacaacactggatgtatttattcttattctctgtgagtatttctggctggcgagcatcttaaccacatagaatagccaaaggggagagagaagagaatgaaagtgttactacctgtttaaatagagcaatggaaggtaaatcttgctgtatttttccaaatgaaatcagtagtgtttttttaatctctaatctcaaatattttggagctttaaatttattaaagtcctgtaaaattatcttaaaactctaactgtaaaagacacactaggtgttaacagctctgccatggagttgcagtrcgcctgtctgcatcacttaggaagaccctaattctctcaggacagctcgcactgacacagtagagtaaccttaatccaaaactgtagcccagtgatttctacagaagtctgtagtatccacattttcttgcaatcagtccccaggaagcaagccagagagtgggttgggatcgctatcttcctccttggggcactattaattcagtcacctaatatgctgaatttcccttctggccactagatggagcctatgcataggcgagatgggcaaagtgcacactggacacctctcaggtgtgagcagaaattgacaaatgacaatattaagggagaaagtgtaataaacagatctctgaaatggaaggcaaactgcagggggatgaccatcgtttactgaaaaaaaaaatcacaactgtttaataagcaacatgccatcttgttaataaacaccttagcaaaataaagttttattatacatttattgagcacctatgtgccaggttctataacatatttaaatggcaaggacaatcaaacatcaagtaagccttatatttctatccaaagaacatctctgttcgaggatgtcacaaccctaagaacagtagcagttgaagtccaagggcttaataccaggtgccaggttctattctaggcacttgacatgtgtacgaatttgatttctatgaatgtttaaagtagattctattaaaattataatttcacagatgaggaaactgaggcacaagaagattaaattatttgcctgagagcttagctastgaagagctgagattcaaaccagccactttggctccatggtcctaataaaattacaagcaaggaacaagacaaatcactgtcaaccagcaaaaccgtgggttatgaactcaaaaggagtaatgggaaagtagatctatacaagttagggaaatcccaaaaaccttcaagaaggaagaggaatttgacttggaaatgtaaagatggcatctctgacctattcaaaccacagaaaaggcatatgggggaaaggaatcacctgacttagcgtgctgccttttgaaagttatgatcttgtccctattttacagatccacctggaacttggaaattatttcaatttaaaaaacctattctatttcctcacaatttttctgactttggttttctaaacctgttagaaaaggttttcattctgttgtttagtgagaaaaggagaaatgtctcccccaaatatttttaagtctccgcatttctatcaagactcagaaaagttaataactttaggaccaaagaactaattggcagctaaggagaaactaaagctatggtgaccttcctgtgttcttaagcggcactttctgctattcagtattgaggatggaaggagaagtagcagagtagtgaagaggaaaaacattctcagctatggaaacagcagaagcaaaaacttgaagacaggcataacacagcttcctttccatcaagctaatgcacagatgctggggagtaccaggaactaacagtggatccctacagcacaggattactaaggacctgtttcattacttgattctaaggaccctggacttgatcctaggaccacaagaggcacgttctgagtatttggagctggcaagtccatcagactaagggaatggtacaggaactggttcagaggccaactcagcatgtagtcagagtcaatgcaggtctgcactggaccaggctggatcccggaataggggtcaatctgagcgatttcaagtgactcagtgagatcgaaaggcaacattcaattaatgagtctccccagaaaaggacaggctgcagaactgaaactgaacaaattccatcctgagccaatctctgttgctgaaaattttactgaggtgcatgtgagaaagaaaatcccaattgtatcacctgacgaagaaaggctaccataacaaaagttctgtacctacgactacacgatatcatgttgtgacctaacatatgcagtgaactcattatccacagaaatcagacaacagaactaagggaagcctcacagcagatctccctctgctgctactggtctctgtgttcatttgttttcgtggcaatctgtgcttctctttaaagtcctgagtctgtaagcttgtgtattatcccactaaaatgagactcagggaaattaggtaaagagaataaatacaggacaacacagataaatgtggacacaactgagagggattttacaatctagacagaattaatagctaatgacttagaaaacactttgtaagctgatgcagtcaattggatcatgggctcctacctggaatttctctccatgcttcctactttttccaggaagttatcaaaggtcactaagacgctttgaatttggggaaaactcctayaaataaattcatctctccctaattaccattagacttctgttctttaaagttctattgactaaactttggctgacttaaattggtgatgtctcatttacgtaatcaagcacatattcccaataaccaactttacagagactaaccacgactatattttttacagcagaggacaagctgaaagcaatcacaatgtatcaggaaaaatttcaagttatgctctataaaatatttatgctctaacaactatcaaaatatatttgttctcccatgtcaagagtaatttttaaagtggtatttatttttaaactgacaaataattccaaagccagtttgagaaagctagtgccatgttaaaaagaaaatggttgaacaaaagtatacaaaacagcaacaacaatgtatttcaaactygcagaatttggacgatggacggatggatggagatacacaattctgaacaaacggcattcgtattatgtaactcttactgaagtagagacctatggtattaagggggctaagactgaggagtgagataaaacaaagtttcaaactcctccccgcaagaactttctggattagcaagactactttctaaagtctttaaaatatgcaaaaaaacaaaaaaaaaatgttttccagactattaccaggtgagcaatttatttttatatatgtattttgtgtgtgtgatggagtctcgctctgtcacccaggctggagtgcagtggcatcatcttggctcactgcaacctctgcctcctgggtttcagcaattctcctgcctcagcctctcacgtagctgggattataggcacgggccaccacgcccggttaattctggtatttttagtagaaagggggtgcaccatgttggccaggctggtcttgaacttctgacctcaagtgatctgcccaccttggcctcccaaagtgctggggttacaggcaggagccgctgtgcccagccaggtgagcagtaaggtaggcccagctatcgctgcagtgtgtgatggccccatccacaggtgtgcacatcttccccatgtgactagccagccgccccactactccaaagaatgtgaatgcttcaagaccaccaaccaccaagtgagctccatggacacaaggcccaacaacttatattgcaatcgtaggtgttcatccctcaccataaaagaaactactttctgttgtggtccagtgaaaacagaagagcaatctatgagtttacaaattcttgtaggctgggggtggtggctcgcacctgtgatcccagccctccgggaggccgaggtgagtggatcgcttgagtccaacctgagcaacatagcaaaacctcgtctgtactaaaaatacaaaaaattagccaggcatggtggtgtgtgcctgtagtcccacctacttgggaggatcactggagcctgggaggtcaaggcagaatcaagccgtgatcacaccactgcattccagcctaggtgaccagagaccctgtctcaaaaaaaaaaaagaaaaaaaaatctgtagtccagggcaggaaaaagaaaaattttaagcttgcttactagtttgtttcgttttatttttttttttaataaacatggcagtaacatctatagtttgacgggtatctttaaaaacttatggtaagacattttacagtatcaaataatttctaaacctaaagaactgcatccagtaagtactcaacatgtatttactgtggaagaaaagagggagggaaaacgactatttctcagttcaagtaaggaaatatcagtttttccttaagatttgaaaataaaacataagtaaagccggcatcagtggaaaaaaagggagagaaatcttcaaaaatggtatctgggactttcaaacgagtaaaattgaccatttaaaaacttagtcttcaaaagtccaaaagtctcaaaatcaaaggtattgttaatactttgagtcaaataaaaccaaagcaatttaacaaaagaaaacatcatgccgaggaagtatgcttctcttgagataacaatctaacttgtttwaaagatcctttgtttactaaccattttatattccaaatatatgttccttcctcagaacaaatcaattcttttccagaccctcggggatgggggtgcaggcatgaggggatgtgtacatatatcaaagttttaatcttttcaaatagtggaactcagttatgcttcccaaatgtcaacaggtctcaatgtccacaaacactggggctgctaccctcccccatccccacttaaagccacatcacatctttacaaataactggaaaacctcctcttgctaagctgatgccaaacaccattttccaggagggatcagagtgcatcactcattaggcactttgttgtctctaaagtgttcagaattttccttcagaacatctcagactggaaatcaagaaactatatccgtaacatgtgtgcaactattatatatttagtacaattgagaagagctcatcccctggactcagcacctgtcctaagctggctaagaaaagcagttcaaatcaagttcgcccacaggcgcaaatacctcttccatgaactaggtctgatttttaaatgagttttgaaaacaaattggggaaaatcacaacctataaagaaatgtatcttgtatgctttacaattaaaaaacaaaaactttcaggatttgtctcctcactcttactccctcacgcttttaaaaacaccaagttatttacaaattataaaatgccctgaaattatgaatgcttcctgatttctagaaagctaactaagcaatatgtaatccagaaaacttctgaaataagttccatctttcttacaactcaaaacatgctatgcaacgttcatgtacacacctgtgactcctaatttttggaaaaaggcaactacaacactgcagtttgtaaatcacaattgccatatccaatgttataaagaagacagtgccgccagtcaagatgggttaacatcacctgtatgtcacagtctacagtgacatcccaatataacggaaagcaccaatgaggcaaaaaaggtatagggtaaaggcttctgatgaacaacactagagtcctaagtctacagaaatatttttaaaagaacctttaaaatgctaactactgtctacttgaaaactgcaccctatactgagtctgaaaaaaaatctgaatttcaagaaaggtggtttcatgcaagactctgcaggttcatgcactgagtagcacaaggtcagctttcatacagtaggtgcacaataagtgcaggctggattcagttgcttcttacagcacattcttacaaaacaaatgaaaccagatttaaaaggaaaccaccgtcccttgagggttcctcttggcaaaaactctaaggcaacaagtgaaaatgatacagttgattttcattactgccctgatcttgcaacaataggaagggcaggaaacatttttattagtaaactaagccttagacaaagaccaaaagcaaatgtaaacaacaattattctctaggtcttttcctattgaaaggccagggtaaatctggataaatgcacacagtttcaaaacaaaaatgcctttgccacattttaaaacctttcgttctgtaaggaattttaattttataaaaatcactgtatacttgaaacagtgtatcctaaaactactgcatcctaaagattctttctcctgctcagaccctggaactatgtaagaaataaaataaaactgcaaagaaaagaaacaacaatactgcattaaaatgaactgttctgttcatcctcagtccttactaccacttgtggtcaatgtggcatatcaaaaaatgagtgtttaaaacatcttaaaacagcaatgtctttctttgttggaaaacataataaaactggaaatacaaacagcccttcagactcagctcctaaactctatcctgaaaaaaaccatcatttcagattcagctgaggtttctattgtcaaaaatctgccctccaccagcatttgtgttttttaaatccagctcctcaatccctaactgaagctacatagaaccaagattctttttctcctgcttgcccatttctactgcgggattgaatccctgttgctaagcttcaattatcagtttgttgtattgctgcaactcacggatctgaaaaactcataaatgaaaagagagagagacatcagcctgtcaaatrtatgtaataattttaacgtaatttaaggtagcataacaagttattttcaacctgatcacatttctttaaaaaaaaaaaaaaagggtttattgagatataattcacataccattaaagtccccgatttaaagtayataatccaatggttttaagtatatttagagctatgcagccatcgccacaaactaattttagaacaattttcatcaccccaaaaagaaaccctgtgcccacyagcagtcactccccattccatccgcccccagcccctggcaaccactcatctaccttctgcctctatggatttgtttattctagacatttcacataaaccggatcatacgatatgtggtcttttgtgactgacttctttcactttttgtgatatttttaagcttcatctattcaaccttagcatatttcttagagttgaacttttctaatctttttcgacaaatcaaacattatgaccttttacatttcaaatcctgacacaaaccccacccttccacaaaacaccatttgcttgctatgtctctccagaggatctaaactataatttgctgtttaggttctttcagaagttctttttctgggttctccttctggtaataaaacactaacttctttaaacaccaacatttcacatacctacatttctgtgacaacaggatgcctggggtagaaagatgactgaatccttttaaggagatgggtacaataaatttaaagtgcatgctgactttttaaaaacaaaatagccctcagattatctggctatcactcagaacctccgaaccgccttcatttagatgctctgttcacattatggtgatacaaaacaaacacatccatatgactgcctctgcttcagaaactaagttttctaagataaacaacactctttctactgccatcacactcaaagaggaaactctaatctctcaatacgccagcaaaatacctgcaactgaaccaacaccctgtctttatttctccaccagacaacagctgaaagaacgccctccctgatagggctcagcagcttatttctatcagagttaagtggtctagcaccttcccsgctaaaaactgaacgcccgttcacaggcatagcttttaattctccacatttcagagatggagggaggggcaggtactgagtcagtcaagacttcagcaaaccataatcgagatttggggtgccttctgaccacccatcaggtttccaggaactaaccactgtaaagggatcctggggggaagctttggtatcatggagtaaaaacatacattaaaacaccccctccctyctgcctgtgttctcaaaaatcgccgtcttgcacaaasaatatccttcaagaagaacgctccaaaagaaaaacagcctattttaaaatgcccgactcctgcgtcggcgaaggccatccctgctgttttgaatttcagaacattaaaaacacaaaactagagaagctatacagttcaactgcataacataacaaaatggattatttctcccgtgtcttctaaaccgtacttatcttttaaagataaaaaccctyctttgtccccccagccaccacctaaacgacttagtaaagggagccggaaggctttcgcccaatcgagtccgctgaaagtttagaaaacaaagagcaggagagcccagatctgtggaaggtccggccccagtccgcgtcccactcggcagtaaacacgcgaaccacgatctgctctcgttccgtcgcggactcatttcttaccagacgtttaaggatttgtttatagaaacagcctttctgaattgccccggtgatggggccatacaacctccgctgcctcctccttccccgcctcactcgtgaaggctcagtcgtgattttttcaaagttaatcggcaccacctgcataccctcggcaaccattactcaccaacacgccctcaccgttcccagtcccagttctgcgacatttaaacttttaatcgtgttcaaattaccctaccatcttgaatgtaccagtaagccacactttcaactttttcagaagaataaaacccccacctcctccggccgtagacaccggggggagttctcgctccccgcatccccgcgcttccctactaacccccacccgacaccaccaaaacaaaagctatcagattgcaaaagacagcgaatgtggagcgacactgcttattaactacgtacaaaggaagtgcggggcggcagaagagagggcgacacgacgccgaccacaacaaaaccaaggccagggctccgcgctcgcaaaacacaacaccctccccgcgccgccgcagaccctggcgctgaaaccacagcgtacgacacctctcgccagggacgggcgtctaggtgtccccgtgaggcggcgactacaccccgcgctgcgagcacgtgtgtcggaatgcacgtcggctccgaccacacacccaccaacgcacactcggatgcggccctagtacccctccatcccccggcccgggagaaactgggagaccatcccagagccctctgaactggggacccagtggcgctccccggaagagacaagctgaggaagactcccggcctcgcacttcccggggggctgcccagagagcgcttcccctcaccccaccgcccagccccgggacgccgggggcaggtaacccaacgaggagcgggccaaagtgacgggcaaggccaggaacccgaggagcccgaggggcaaaagcacgttgggcgacgggaggcagcgacgggcgcttggagacgtgtcctggggcttcggggcctctccgcagggcacctcccccctcgagggcaactcgcaccccgcgggccgggcggctgcccgctccccactgcccggtcagccccagcagcggagacgcggtgcggcccagggtgctgtcgctgctgcctgcgcgccgcagggggatcagcgctgtgtgcggagaggctcktgcgcayggaaggggcgaggtgcgggtcgcggggcccgggaaccgcggagcccgccccggcaccaacttccctaccgagtcctcgcgcctagccgggaaacacggctgggctgtcaggacggagaaagagaaaagcccttcccgcgcggggatgcgcggagccagggcccgcggggctccagacgaacgagcccgggtcccgggtccgctgcagcctccctcccggcagagccgccctgcgccccaccccgccgctcccgagcccgggggcccgacagctgcgacggtggcaactcgggtttcgcaaacagggcgcagcccctcggaggaaaagttcccgcagtggccgcgggcggcgggcacatactcactttctccactcgtcggccagagcgagagcgcggcggagagaaacaggagcccccacagcgaggtcggggaccctcctccggagccagacttcattccttttatttgggatgaaattcccctttctcaaaaaaaaaaaaaaaagaaaagaaaagaaaaaaaggaaatgaaaggaaacaagtctcaaactcagtcttcgctccccctccaaaaacaagggcgaaggaaacaatactccgaaggcggcgccgccggggccctccgggtgcgcggacggggcgggcggcgcggggcggcccctcagcgccggcagcagcggcccagggctcggcggagtcgggaacccgaggcgcgccggggcggactgtcggcgtcgtcggcctccattttcaaacccggagaggcaggaaggggggaaaactgcaaagaaagggggcaaagcccaaatctgcctaggcgaggaaaaacaagcccggccctggccgcgcgggaggcggccggacgcccgagcttccgccgcgggagggcgcgacgcagttcgcaagatcgccccgaagtccgggtcacaggcgaggccggcgaggggcagaaacgcggagtcaaaatgaatgagcggctccccctcctcctcctcctcctcctggctccgctcgccgccgcctcctccctcagcgccgccgccgccgcggcgagctccttcccaaatccaggacacacacaaagcggcgggccggccgcgccgcgctcagcactcccgccgcgccgcccggctctgcgccgccgcccgccccgcgccggcccccgcccggcccccgcccgccgccgcctgctctgcgcgggggctccggctcgctgaaggtcacagccgaggcgaggcgcgccgtggagctgcccccgcgcgggaggggcgtggagggcgcggggggatccggggagcggggccgagggtctgcgagcgccggccgtgggcaggctcgctggcggcgtccctctcgctctcccgcctctctcgagttcgcctggtgcgctcgctcctcctcgggttttttccctttttttttccgctcagcggagttaatgctggtaaacaagagccccagcctcgccgcgccgccgccgccgctgccacacactgggggctcgcgcgcgcgcgcgcgcgccctggcccgcgcacacgcgcccgctcgcacactcgagcggccaccgccgcagcagcggcgcgccgagggcccggcccaggccggcgcgcgcaaaaaaccggagcccgggttccccaagacgtgcggagcggagcccgggcgtggggcgcgagactgcgaggcgccgccccccatctcccgccccaccgcctcccgcgcgcacacagagacacgcgcgcgtgcccacccgctcccgcccccaccgcactgcgccggccaccccgcacgcgccctcccctcccgcccgactccaaaaacaatgcccccgccgccggtccggtctcggcggggcaggggtgggtagccagggaaaggctaggcaggggaggggtgggcaggagaggggaggggtgggcggggagtgcggggctgggagaggttcattgaaaacaacaacagcgcggctggaaagcgcgtttccccggttcttgaaaagcttcattgtttcttgcagctgttgcaaaataaataaatgcgtgcatgcggcatttttttcgctgcgtactggaaagcccgaacgtggcggaaggggcgcacctgggagaaaggggacccccccccccaggctactacgccgggcactttcacgccaggctggggtgcccgcggcgttgcgaccgtggagcccggagtttgggggctcagggggagcggagggggaagggcgcggcccgtgtggctcggcccagagtggctcgaggagagaggaccccgccgcccctcgcgggccccgcgccccggaaggggggcccagacaggcagcgccgcgtgccccgggcgcgtccccgcggcggccgccagagggcgcggcgggcgctggggagggcagcccgcggagagtcgcctccctccctccgggggaggaaatgtgggggcccgggctgggggccgactcggctgggtcgcgctggcgtggcctcccggaccagccgcccgccctgagcgctctccgcggcctcgcgcagctcagggctccaccacgtgggcggctgcggggagcggccggggcgcgtgcacgctgcgggtctccgaagctcggggggcgtgtccgggtcccggggcgccgaggagggggtggaggctggggccgggaagcctcccttggctgcggtcccgacccgggaacacgccgcatgcactcgggatcagcggctactgcggaaacccacccgcacctgtctcgggtcctcccaggcacgttcctcttgcttcgtttgctacgtaagtgactggaaaccagtaccgaccctaagtctccgcggttgttttcttgaatgtgcaggaggagaggtttccccaaagcgagactcccctaggactgccatctaatgaataaatgctgcggagaccaggtcctcaaagagggaaacagcccagcagtggcaggagagaggagtttgaaatacgtggacttttacaaacagtgattggaccatgtgtcgcccttaatgtggtccggtttcatgactcaggctaattgatgccagtaataaatttttttaagatagctaataaaagagttgtgaattgtcgagataagaagtggttgtctcaaacaatcgggtaggatggtaagaagggacctgatgtaaaggaaggtagtaggtttcttttactctctaattctaaaatacttctgcattagaacgtgtatccatcgttcgtaaataattttttaagagctgaaaacaagtcaaaagctatcataacggaaacttagccctttttttctaaagttgtttcctagatcattttcctccttggaaatttctagctcaattcagagtcagttgtatagaaagaaaataaaccttgttttacctaagaaagttattcatatgatgggatggttttgtttaactgaaattcagcttgatttttaaataaagagtttcagttttggatgttcctagatttaacagtgaaataaatttattagaatcttaaaatgtattatttaaaaattaggcactacacatgaagaattaaagtccagtctactaatttttaaatatttcttaagttctctgcatgaggttggtcttgattcctgcagatccactctggagttaaatgcaaaggaatattgatatataatttcattatacttgatttcagaatttttaatacatacttgtaagacaaaaatttagagctgatttttaaaaggctagtgctaatataaaatcttcaaatactacccaatgtatttttagtattagtaataaatatgcctgtttatttgtccccaagaacataaagaggtctatagaatttttaaatgtatataggttgttgtaggggttgtaggatttgtttttgtgtgttttttttttactaaaatgatttttatttgtgaattttttaaatgtttgtgttttcctgaagtagtaggaaatcaatcgtattaagttattttaaacagtgaagtgggagatgtatcattatatagcttaatatttagggaaaaaaaaggaacaaaaatttaggttgtctttacgctctaacttgaccacatggacaaaggaggtgatttgtatttcttcaatgattatattttacatacacaagtcaaacttattttttcaaccttgaaataaaatcatgtagacaaaaattaattggagtctttgctttatacccacattgacaatgcaccaaactttttattttataccattttactcaggtatcttataggttctccctcttttggagcagaaactgattgcttgttttcattttttaaaaacgccgtttacttgataacagtttcatctcaaattattctgctaaatgtaccagactccccaaaaaatgtaatgtatatcatatacatcaagtgcaaacgtgagaaacagcacaacaattgacaagtatcaagtaatacagtatattgtgatgtattcgcagaaaggaatgttagcagcaaaagtgaataaactacagccccacacaacatgggcagatctttgaaacacactgagtaaaaatatacaaatatcaaaaacgcacacagcgtaacaccattttgataaagctcttaaaaagcaaggaaaactttaaaagttacagaaaattttttttgctttaaataataaaataatatttttcctttgttttgcttttgttttagcaaaagaattaatgaaggatgtgaattcctttggagaggatgagaagcccataggcacatgggtttccattgtaatttggaaatgagttcactcttggattgagtgacggatttacaaatttccattttataagtatgcttaataactaacacatgttctacatatttttgtatgtataaaacattaaagaagataaataaaaatatgggagagatccatgaaagagatcattctggttttccaatgggagtcgttcagatttcgagctgtccgtataaataactcagaagcattaaagatctactaaaataacacagttaatcaaggtctgatccttaagatatttcagaagaatgtccacacatctaatatcgatgcaatttaagacaaaaatcaaaagacaaaaaatttaaaagacctcacttcacaggtaataagcttcattaagagtgcattatgtcaactgtttgacagtttcttataaggtaaaacatacaactaacttacgatccagcaagtctagccctagttatttacccaaaagaaatgaaaattccacaaaaatacttctatgggaatgtcaataggtgctttgttcataatagcaaaaactaaaacaacccaaatgtaaatcaaaaggagaatggataaacaaatcatgatatatccattcaatgcaatactgcttagcagtaaaaaggaatggactactaatccatgcaaaaacataaatgagtctccaaagcataatgtataagccaaaagagtacatactgtattagctcatttatgtaaagctcaaaaacaggcaagattgatctagagctagaaatcagaatcatggctgccctgggtgggtagagagggaaagtttcaaatgactagggagaggcataaagaactttcttgggtgatggcaatgctctatatcttgatggggtgttggctatgctagtatatgcatttagcagaaacacatcagactgtacacttaagatgggtgcacttcattctgcataattgtatctgaatgttaaattgttaagattgtattataatttagatagttgcagctgttctaaaaaaaatgttagcacaatgcttcccgtttttactattaggtgagttagtagagatgctaaactccaacatccttgcccacagctgtctacagatgtgtatactttcagtgtgtatctgcctaaggtctttccttaggggcattagctgtggaaggcatcacatggtctccacagagcaccccaagggcaggaaaaatacaagtgatgctgtagctgattcctatccccacacagccacaagcaacaagagtctcagtcttgttgaggatctgtttatactcaacttg

SEQ ID NO: 1695 - DNA, 19986 bp, Homo sapiens
tgtacctgttacccaagcttagtgattaataacgtgctctttcactctataaacagtccccatctggaggataacgtatatggttcacctgcttacaggtcctatgtgatctggcacagctgactcctccagctccacccagcaatagcccacacactggcacatgctcctttctcgcagcatcactgctatcagagatcacaattttcttcactttgcaaatggagagaatgacactccaagaagttcactggttaaggtcatatggcaaattaggatggggagcagaggtttaaatggaagctgtgatgcttactctgctcatttccactcatctgcaaggcttagactggactgcactgggattccagactcacatgctgcagggacattctacaaacactgttcctacctcccagaacccccatctggctcactgccacttccccttcaggtctcagttgagccgtcactgacagctctgcgacaccccaaatctagctgtgcacataataccaagtgtgtcccctactgaaacacttacacaatcattctgcacatatttgttcacaacttggtatgtgtcaggccctgttagagtggctggggacacatgtagggacaaaatgccagccctcatggagtttcatgctagaggaaaaaagagacagaaaggaaactagcaaatataaaacagagttgcatgacattataaactgatacaaaatagtacaaatatctcatgaattcatcacaattcattataatttcctatttgcctgaccacatctccctgtgggttttgcagcacggtgtgtgatctgaggcttgcaacaaaggcctggtgaattcaatagcagtttccctttccattctctccattgtcctgggaacttgtcctgctctgataacatacaaaagataattatatctgtaactaatcttctaaaaagcatctgtcccacacattcagggttattaacactgatgccatgttcactttattctcaacaactactcatttctgaatcataaggttcctcatggaggtggagataaccctacctaccgggacattctgtttatgttttagggactgtcctttccatggcttccctagtccctcaggtgctgtgtgagttgtatttcctccattaattctacactagaaaaaggtgtatatgctcaagctgggataggaaataaacaatgaactcaggagtagcatcagcccagagatccctgccattgggcattcaatgattgggtaaaaagttaactatcagcaccttacaccaattagaaaggctactataaagaagatttttaaaaaagcccaggtgcggtggctcacgcctgtaatctcagcactttgggaggccaaggtgggtggatcatgaggtcaagagatcgagaccatcttggccaacatggtgaaaccccatctctactaaaaatacaaaagttagctgggtgtggcagcgcgtgcctatagtcccagctactcaggaggctgaggcaggagaattgcttgaacctgggaggtagaggttgcagtgagctgagatcatgccactgcactccagcctggcgacacagcgagactccatctcaaaaaacacaaaacaaaagacagcgttgctgagaatgtggaataattgggaccctttctaccactggtgggaatgtaaaacggtccagccactgtggaaaacaatatggcagttcctcaaaaaattaaacatagaattaccctacgaccccacaattctactgctgggtacataccccaaagaattgaaagcaggacctcaaacagatatctgcgtgttcctcttcacggcagcattattcacaataatcaaaagatagaagcaaccatcaacagatacaaggataagcaaaatgtggtatatccataaatggaatagtattcagacttaaaaaggaaggaagtcctgtccaatgctgtcacatggatacagcttgagaacactatgctaagtgaaataagacagttacaaaaggatggatactgtattctgcttctgtgaggtccctagagcagtcagaatcttagagacaggaagtagaagggtggctgccaggggctgagaggaaagacggatgaggaacgaatgttccacgaggacagagtttcagttttaggagatgagaagaatcctgtggatggatgatggcaatggttgcaaaacaatgtgaatatacttaatgtcactgaactgtacgctagaaaatagttaagaagttaaattttaagttatgtgtattttaaccacaataaaaaagttaactggtaggtcacctgggactgcggtttaaagcaaatgcttgatggttagactaatctggatggtccaactaacctgactctaccactgactggttataagacctggacaaggggctctactccttgagcctcagtttcctcatctgaaaaactggaataataataatatctaatttataaaggcttttggaggttaaatgaagcagtaatgcctcttacatataaataaaattctgagtatgatatacagcacataaattctaaataataaagactcaaaaccatatttcattggttttgttgatgctgattattattattataattaatactattagcttaattcaaaagctaacatcaacctacagcaacctgcagaaagatgtcctgccaaatacttgctaatttaatccaggagcaaaaatctatgattctgggcttgagtgagctttcctaattttaaaactctgatgctcattttgtccccaagaatgtgtttagatgacagagcaatcagaatttgacatgtataaatgcttggcatgttaaaataatgaaagatattttcaccattgtaaggaaacagcttttaatccatctctctggttcaacatcacatttttctatagtttctcatgacttcttccttaacaattggaataggtatgaaaaagctgagctgaacacatagctgcttagaaatgagctgcttaaagtgttaaaacaacagaaacagcaagcatgagtttaatgctatgtatgccgtcacaatactaatttctctattttaaattacagattacacacacacatacacacacacacggaatcacgtctatattgctgggattttcattatataacaatatatcattttaaatgatttgaggcaaattattgaaaaaaattaaagactgaactccataaaaaggaaatcacctgaaatcaaatataaccttgttaacaaaccagcacattagcaacatttttaggggcaacaacataatcagcaactctaagacatcaatcaaatgcattaaaaacaggaagtactaactctaattcctaatttccagaaaggcaaatataccataattaaataacacgttataaggagatttgtctgtgtaggtctacttctgaatccccgaagttacatacttgtaccacaagcccatactcttgaaagaaaattctggacccagtccacatggaattttggttaaaacatctaattcattgcagagaagaatttagtcttttccacggaagagacagcatgtgttagaatgagaatactttatagaaatgaccagtgacaagccggctatgtaagggggcttctgatgcctggcgttaacaagagacagagagtattattgttgaaagggatctttgagattacagaaggagctgaggtgtgaataatcgaacaccatccccttgttgcctgaaggagaagtgagacagcaaaacaaatcaaatttccaggagctgcaccgtgtatggtgagcgaagacgcaatgaggacatgtctgtaggagaacagaggtagaagttagctcctcaagtaacagttgccatcccgaggcaccacagcacaagacagtagcggaaatgaacatgacaacgcggatggtgggtgacaagagtcttgcctggatattgacatttttaaagtgtagaagaaaatcgcaggtcactgaaacaaaggctgatggtgcccagcaggttactcttgaaatcagaaacagaagttcatgagaggcaagaagacagaaacaacaactgaaaaacttagagtggatcgctaacttgcaggagctgtgcagctttggctttgcaggttttagaagctctccctacgccacgtctttaaatatatgtatgttcaatcagcaggaggaagggactaacaagagccttctgcggtaagcacctgcatcaaacaatggcactgatctcagagggattttaaacagctgtgcataaacttcaaaagtaatttgcaaccatattagtaaatgtcactcttcttcccgctagacacagcacttttaaaagagattaagcatccgcagtaagcctgccattttacaagggttaccaaagataagttagggaaaatatgaagatgatgattcacaaggtcggggtgtggggtggggtgggggacccaggaccttaggaatagggcttgtctatcacacagcctcgggcaagaagggcccagtggggaccatggcttctagggagcaaaccaagggaaaagagcaacggagtggaccctccaggcttcttgcctctctcacggagcctcacgaatcccagtggtttagaattttctttggcaaaagaaaaggtcaaagaggccggagttgacagaaagcatgggcggacttctcagatcttgtaggtggttcttaaaagaattcagcaggcttgaggtgtgctctcaaagggcaactggaacgtcaaggacttggacaccaggcacagatggttcatttcccatggacaggaagagggcacggagtgctccctcttccctccaccttctccagcctagtccccctcagcctgtgccactcctgaatcatcttttatagcaccacgtccagcccgcacaggggcaggacagcccagggaacaaggcagtcctgtggcgctctccttgcagaaatgaccggagtctcccaatccagccagcccgtggacctctcttcatgcccacgggggagtgcacacgcctgtagcattcaacagtcactctcccattgataacggtggctctcgaaaatccaataccacaaagatactttattgcacaaactttgcttggttaacctggccctcaaagctggggaataacctcacttgaggctacaggaatgagcacgcagatttttctttttttttttttttggtatctttcaaagacctgcctccccctcccccaggcccttgaccagaaacttggcttgtttagaagcctgagcaatggcacccccgtccgtgctccaatacattcccagaaaaggggttatgctcccctgtggacaggataccatctccagaaaacatgtttcctcacgcatttttttttttttttttaccaagaatacaaaaactttccaccttcttccctccccgcaggccccctttcgttcaggtgagaaggaaaagggagaagaaaggaggaagcgcccccaggccggcggcccccacccggctaaggtcgccagcatcccgcatcccgtgcgacctgcgtcccagaaacccagcggggaaattcttcccggtgcgctcttgcgcccgcttggttccatttcctactccgcctgctcacccggcagccctcaccccttcccggaggctctccgaggggcctgggtagcccttctcgccacgggtctcggcccctccagcccgctccctcccggcggcggcgcggggcgcggggccctacctggagcgagcacggcgccgctgctgcccggtggcgctgggactgcgcggggactgcgcggggactgcgcggggactggcggtcggggctggcggggctggcggggctggcgggcccggcgcactgcgggtgcgcctagaaggcggtgcccgccagggggcgctcgccagcctccccgccagcccggcctcccgggacccggcacctctagccagggacgcgcgctcggtcccccgccgtgcgcccccggtcccgcgcccaggctcccgcccctggcctccttaccagccacttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaaggtaatgttgccgccgtgcgtgtcattttaggactttttatgccttgcgggtaatactaatgatggtcacagggaggataaacggggtggtttctttttctatactccatgtaactaatttctcattcaggttagaaaattatatgtctggttactaatattcttactgaatggtttccttgcaatgatgacaccaaataattaaaacgtacttgattaagacttttgttgctgtagtgtactaagatcagattaatctgagaagtaaaatagtaattttttgtccttttttcttttcttgttttgagagagacattaaaaacgattaaaacaaaacaaaacaggccaggtgcggtggctcatgcctgtaatgccagcactttgggaggctgaggcgggtggatcgcttgaggctgggagtttgagaccagcctggccaacatggcaaaatcgtgtctctcctaaaaatacaaaaattagctgggtgttgtggcacgtgccagtaatcccagctactcagaaggctgaggcaggagaatcgtttgaacctgggaggaggaggttgcagtgagctgagatctcaccactgcactgcagtctgggtgacagcaaaactctgcctcaaaaaaaaaaaaaaaaaaaaaaggtttaacaaaagccaaaagttgaattagcagccttctgatcatgggaatgtaggatgtcaactaaaaagaacctcagaggttgggaaggcagatgaaaaactgaggccccgaagtgtttcaagacttgattaaatcactcaggtctgcactaggaagcgagttatgatgatgcccctaatctatatgaacccaaataaagccaaaacacacacaccttttaaggataaaactrtattccattaaaattagccccgcatttgtcaatatctaacagcattggactgaccctcaggccagaggctgtagctcttggaagatcctagccaggaggtttgagagtggccagtacctcggaagtgctggctcactctgacatcatcagaacctggcatacagtaggcgctcattgggtatttgctatggaaattaggcaggaaagtgcgtctgtgtctggaaacaaagaggcaaagcttaagcagtgatccccatgcagattctttctgcaaactacaaaacagaagcttccctagttcagactgccatccatctggctctttctccaattgtttttcagcggatcctgttacagtgcaaagaagaaatggcaaacggataacagctactgtgcctagaagatggtagattcctcacgctccatatctgggtttctcattgacaattaggcactgaaaggaagctcatatgtcctgttaatttaatcagtagttagtggctttagaaaaagtttcatatatacaccaggtatgataaggacttttttttttctttttgagacagagtcttgctgtgttgcccaggatggagtgcagcggcgtgatcatagctcactgcagttttgatcccccaggactcaagttatcctctcacctcagcctcccaaatagctgggactacaggcacacatcaccatgaccaagctaatatttaaaaagatttttttgtagagacggggtctcactatgttgcccaggctggtttaaaactcctgggctcaagtgatgctcctacctcagcttcccaaaatgctgggattatcggggtgagccaccatgcccagcctgtgatgactttagacgcactactcatataatattcataatctgatgtgatatgtatcatcatcattatcatctctctttaacagaagagactaacaaggcttagaaaggttatgtacctcgctcaagatcccacaattactaaagtaccagaaccaagattcaaacccaggtcaggctggagccaccatctcaagagctgctgaataattaattctccttttttttttttttttttgagatggagtcttgttctgtcacccaggctggagtgcagtggcacaatcttggctcactgcaacctctgccttctggattcaagtgattcttcctgcctcagcctcctgagtagctgggattacaggcatgtgcctgccaccatgctcagttaatttttgtattgttagtagagacgggtttcaccatgttggccagggtggtctcgaactcctgacatcaggtgatccgcccacctcagcctccgaaagtgctgggattacaggcataagccactgcgcccagccaattctccattcttacatcgtacactcagttttctctttctttctcttttggacaactgatctttgaggactcttggctactcaattgtcctataatcgtatagtcctacaacaggaaacccgttaacctgaagatcagatcttttaaaacaacatccatcatatatctacaaaattgggatttttttatcgtaaaatttcatctaaaacaaaaaattcacatctgttcttggtatccattaggtgtagyggacacctctagatattcttgatgccagcatcctgtagacccgccatctcctttcccaggccatggggtgtttctgttttctattagacactgtctcttagttatataaacgtggctgctctcagaagttctccacacctttgtttcctggaagaggaaatggcatttcctggaggggatgacacgtgggcggtgaggttccactcactacgttaaacacaccctaactttcagctgtgtacttcttttcctctttcaggttctgccctgatgtttcctggaataatgctgaggactgcctttcgggtagccgccctattcmgttcacttcatctcggaaatacctgaccyctgccttggatccagcggccctcctgagagctgaggaaggaggaaatcctatgtgtctgctcccrgagctgccacaacccatcttcccacaactcggaacttggaaaaaggaacccaggacacgactttgcttttcttttggacctagttggtgattatactctgtctcccatggagaccacgtcttgcatccttccttctatatgggatttaggatagaaattaaaaagaaaacatattattttgagtcttgatttggagaaaggtagtattcaggaggaagtaggctatgatacacatagaaaatttgaggacagtgttacttaacaaggacatttctgtctctgcagaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgtataaagtctagtgtcaatttattcagaaaatatcaaaattattctgggagctatgggtcaaagttgataggcacaaacaaacaaaaacgaaaggtattttaaattcacagcttggataagtaaaagggagatgttgtcatttctcttcttcaatccaactttagattttcaagccggaaaaagggtaattagaagttagaaattgttattgccagaaaatagctctaaaccctgaaaaaaaaaaaaaaaaaaaaaactgaccctcctcttggggagtgataaacctcaattactgttgatagtaaaactgatatcaactcttcgaaaccagtgaaaggtgaatggaaaccttaccctaggttaaggtttaaaaaatgttcataatatatatttgaaagttccattatttaaaatattcattagacatgctttgtaatgttaagttacttcaaaaaatcttacacaagggaagggaagtatgtattattccttcatttaagagaaagataatgtgtgaatattagttaatatttatcgtacatttactacctgtgtcgaagcgtagtgttacacacttaatttcaattatttaatttgattctaacaatgaatcccctgagatggataatatcctcttcattttacagatgagacaattgagacttaaaggttaaacaaatgatttcctaagctcattcagctaataaacggtaggggactgcttgacaccagtccagttgaccctcaaatccatgatttctgccaccatattcacagaaacaagacaagagctgaaaatatagcctgactcttgaaacagtcaaagaattgtgtatgtttatgaaagttctgattaataagatattctgaggacaaaagacaaggcatgggtagaggggcaatgtgtagattagaatgtatcacaatgcccactaaatagtaaaaccatagaaaatgaaatttaatccttactgtgtagaatatttagagtagattgttttttcctcggtgtcaattactattacaactatcaaagaatgaaattaaacaagaaacggttcctttggtttttttttttaaaggtgggagttataaaaacagtatttgccatctggttttagttatggctgtggaaattctatgggtacaatttgttgtcattgttgttaccactaccaatacagagatgctaattgtaacatcagtttctaaatcagatagtgaataattacattttcaatgttttcttaacatagatacaagttaacaggatatgcttctggcctgtttctggattctaagggtagaaccagcataaaactagtcagtccaagtatttctaaagatccacagacacagttctcctggatttgggaagcctagagatattagcacaataattaaggcccaagtgagtataaaattttatctgaaatcgaagagatattgattagataatccacagagactactttttagtgattatcttccaccagggtaaaagcaacagcagcctgaaaatgcaaaagaccatacattttaatggtaagtcctccccaggaaggattaataaatctcaggaggaagatttattatctgtaaatccaggaggaagaaatcaagatgaaaactatcatatttataaatttgattgttgcaattttatagtttgacatagtgcaattgctttagatttgaaggggaacttactttagagtaagtcactcaatctcttttttggaaaggcaaatgccacacctgatcctcatcactcccttctcctttgtccatagcctggctttattctgccattaacacacacacacacacacacacacacacacacacaaattgggaagaggatttctcattttacagaaagtatgctgggctacacaggatattctatcaggtttcttccagctataaaattctgagactaaatatcaaattaaagaaagtactaattgtcagcgatgggggatgtactgctatttgcttctagtggtactcactgctcatttcctatattcactggtataaaaaaatttcaaacaccctcaaaaaagcctatactggtggtaccaggaaaacgctgaaaatcattactttctgtgtggtgtccagctcttttggttacatcatcacttcgaccattcacttttaaagaaaaacttttgtggaacaaaaatataaagatttattttttttcttggtggcttagcacagtggcctaatgtggctgaccatgtgcacctgttgtgtgagtcacttagacgtgctttgtttcttggtcacagttgatccctcaactcaagcatctcaccctcaaaatgtttgtttgggacccaagaggcaaaccttgagatgggttatttctttcrccttggattggctcatctgctgggagtggagccaagctgacatttcctttcctttttgtctgcctatcactacgtagaggcagcacataagagagggaaagccatgcgcgtggagtccagcacatcacccagaaggcagatgttctatctccattttactcattaaaacaaacaaaaccacacctggattgcctggtacttaaataaaatgcactatgatgattgaagaaaaatatcttatatttaaggaatagttttaatagcttacatctgtatttctattagcttccgtttctatttttaatatttgtataatattaaaagtaattttaaaaatgaactaatctttttacatctcttatgagaacttaatggagatatgatgtttgaagatcaaagatacgtggtatttgaaatcagaaaatgtgtttgcttttctacacagattacaaatatcatgcattatttcacaaactcttctcaaagtgttgattttaaaattagtaaaaggagggtatattcatatcacatcctggcatttttataggcaagattgagcagctataacctctaaagtgctttgatccctataagcctcaagaagagaatggtgcaatttgaattaataactacccattatagagcatttgtatcacagtattttccaaatactatcttatttaaccctacagcaatcctatgatatggggattatgtacacattacagatgagaacttgaggctcggagaaagtaaataacttacacaagatcacaaagcaagtgactgccagagccaggatcagaacccagacaggcttcattaggagctctgctgaactctgtctagagaattctcaccacctgctgcaaaggctaaaagaaagggtcatattccacatgtagattttgagaaatatttgttatttttcttatgataaaggttatgcatacacactcacacacacacacacacacacacacacacacacacaactagaaattacagaaaagaaaaaagattagccagaatgtcaccacctaaagacagataatattttggtgttttcaaatattcttttatctatacttttttgaattattttattttaaaaataacttttactggttgcctgattatgaagtaataaatattcaccataaatattttgaaaaatataaaactgtctataaaagaaatttgaaatgattgctaatctcaaaatataaagatacctgtcagtactttggcattttatcctccttgtggctgaggtcacatatcttgagactgaagcacaaaatttctataccatacagtttatagtttaggccacaacatcatttttaaaattgtttctttggtttttacttgatttgctgatgttttattttttagaaaattgcagatgtgatttttaggcagctgattggaatgttctggttgctctgaataggactarctactttgttttttactgaaggacaaatattattcctacacacataaaaaacctcaaagaatgagtaatgatactgtttaaatctgcccttataactccaaagaatgacttcaaattttctttcttccaaagcaacttttaaaagcctttccactgcacagtgaaagaaaaccacaaactccttgtttaataagtgggatcacgtgcttttaacacgaggaaaaggtcaatctgaagcaactgatatggaactgccagagtaggtacgtaaatttaggagttacatcaatttgggagggctgcagaaatgtggatcagattttaatcacactgaggaagtttctttgagcaaaagacgtgatggttgttctctagaacctttctgtcctgtccgttgctttgccaagggagctagaaaagaaataaacatttaagaacttaaaaggcttctggataaaactcagcttggtgcaacacattttagctatcacagctttactcccaagcttccacctttcctaggagcgcagtaaaaacctgagccaaagaaaccaaacaatagaactgaaattctttaaacttgagttcttgaggttatagtctttgtgcactccataaagtcaaagccctaaaaagatttttagaaaacaaaacacttgtatctgtatctatttccccaaacctctctacatttacttaccttttgcagactcatgctttctcttttccttgtgattgcatttggatagaatgaagacctctcctacagttctcaacttaaattctttcttttatttcttagctacgaaagaaaattcaaaaaattcaatgctctactttgtaactccctggacatagtgagtccattatgtacatcatgaggagggagtggagaaagtggaattcttatgtaaattcatacagctttggaaaatggtttagcagtacctactaaagctgagcatatgcaaaccagtgacccaggaatgtcatgggtacataacctacaaaaatgtagacagatgcgctaaaagacatgtacaacatgttcactgcagcccagttcatcatcaccccaaagtggaaacatctcaagcgtccaccagctggaggctgcacaataaaagtgtggtactttcgtcggtagaaacatgccacagcttgaacacacgctgaaaacataacgtcaagtgaaagaagccaggtcccaaaaaaagacatactgtatgattgtatttacattaagtcccaaaacaggtaaactgaattcatgcaatggaaagtcatgagagtagctactgcatctggggaggcaggtggtggagtgccagggaaggagcaccaggatggctcatggtgctatttttatgacttgatgtaggggataggtaataggtaggtccactttggaaaagttcatctagctgtgtatttgtgacttgcagtcttttctgcatgtgtcaattccagtaaaaagattacttgaaaatcaagtataatattattgtatttacaaagccctttctacgtagccagaaacagggttggtttcccaggtgactgagaggtcgtcaggagcttagtgagtggagggcaggggacaagtgtgttcattctctctccctctctctctgctgttctgtaaggtgacaagttaggcttactgccagtgtgaccttaaataagccatgcatgctttctgaatccttttttcttatttggtgagtgacgtgctagttaaaatggtgtctccagccctttcccgtcctcactgctgtgattcaagccccctccttctctgtggggcttcctccgacctctcgatttcactgtcacctttctctcttcctctctctcctgcttcctccctgtccacccccatctctgtccccccagggccgagtttgttttatatctcttttggtatctcctctggttttctggcaccatgtcttacgtagagcaaataataatgctttaaaaaattctcgataaaggaaaaagttcagtaaagtgtgaatttcacattgtagtcagtggttaaatgcctcaaacacttaaaaagtagaatttatctcaacctgggcagaaggcagtccatgccaatttctaaatggaatccaatagcaagaatgcacaaagaacaagcaggagtggtgaggatttcctcactctgtccctcagaggtggcgcgtctcatctgtgaggtgaaagtgtcatcacgtcattgacataaagtataagtacagggaacataatcatctgggagattttaatttgagttaataagagataagattttcaggctaaaagtcttggggctggacaaagaatatttaaaaggagggttggtggataaagaaactgtggtatatttatacgatggaagactacttggccataaaaaggaatgaattaacagcatttgcagtgacctggagattggagactattattctaagtgaagtaattcagaaatggaaaaccaaacatcatatgttctcactgatatgtgggagctaagctatgaggatgcaaaggcaaaagaatgatacaatggactttggggacttggggggaagggtagggggcggcgagacataaagactagaaatatggtgcaaagtatattgcttgggtgatgggtgtaccaaaatctcacaaatcaccactaaagaacttactcctgtaaccaaataccacctgtaccccaaaaacttatggaaaaataaataaaagagggttggatgataagaatttgtcatcttgttttctgaattgttcaattgtacttaattgtacttctttccttaaggagttgaaaatcttcctaaactgctggaggatacacctctgatagcttgagacaaatatcctcttgatcattgtttcaccatatttgtctttgctcatggagaaccattttgatccgtggtttagcctcccaggtgattgaacaataccggtgatctgaggcagaccctctgtgacggataacaggtgagtctcttgcatgtttttgcatcatgtactgattacccagacaaaactgagttggtacagctgctaaatccaggatcaagtgctgggatagtagtcattcaaggaggaggtgtcctgaggggctcatccctcagtagccagctgtgcccagagcagagaggggcacagggtgacagagtgaggcaggcagaggaagccgcacatggccaggtgggaatggacatcaggctcctgactgctctcctcacccagctacaccttcagcttttcactggcagacacctgtggctgctgagataccatcccctccagtgagtcggctggcaattagcttatggtcctaaggatatttctggtgttgctgagaaagtcagagaaatagaggaaaatgtcaagctatgcttttagaaaagagtagatgttaacttgtttggcttctgactctcagccttaaagaaacatgtcaccttcttcctcacctgtaacggcaacaaatcctcgtaacaaacatcttccattgatacttgaagaacatgctcacatagtaggtgctggctagtttgtacaacacgcctctgcttgtatttatctactcacaggtgagaatgagttgaaataaaacgtggaagttcctaggaagcactcagtattgcccctccctgccccttttctgctgttatctgctgtgggagcaggggagcagggcagtgtgctgtggtggcagatggtggacttcagagtcctagaactcccagattcatgatcatgacaggtctgggctccaccactgacaagccatgaggacttggggagtcccatgatctctctgggcctcagtttcctctgctgtaaaacaaagcaatggatgagataacatttctttccacttgataaatccataaagtgcaaaagaacctaactctgacaaatatttgtataatatttttactccagcaggatgcatgatttgtattcagctgagatggattgactaaaaattacaccttctgctcactctaatttattgctgtagaagaaagaataagtgagatatttccatttctagtgacaggtggctggcactttgaaaccttccatttcattactcaccttaatgttttcactaaaacacatgtggttttcaaacacaggaaggaaaacatggtaacctgtggttacaatttccactagaaaatagaaaaggtgtaggtcagaaagaatgtttgtggggtgttccttttttactttaaacatgaaaacccatgtcagaagagttttctcttgagaagaacactgttaattgttgcaattttcaaaagttgatgaaaatggggcccagtggcctctgttgttgcaaccagggcagttgtggttgaagaactctgaaggctttagtgccagggatatttttaatcttccactgtgtcttcaagcagtctctctcttctcttttaattcaaattctgggaagcctaaagaaaatgtcttttcaggcagtccttctcatacccaagtagctctaagaatcccttttcagatcccatcttgaagcaaattagcttgttcaaatagcatttcctctgtagcaattaccttcacagttattttcagctactggttccgtagtttgctgtgatcagttgaatttacctgatacctaaaattaattaattcttcaataaatatttggagagcaccaactaagtttacgacatgcgcacacatctgagttaattggttaatcagaaagaaatgcaaaacacaaaagaaaaactcttttgaattttctaaattgtaaacatctacaactactagagatatggagtaagttttaagtaaattctattttcacaagagactggtatttgaacttcggaagtcctctttccagatggccggggtacctagcaggagggggtgggaaaccactccaataaatgttatgcattggttcaagaaaccagctgttcaacctgcaagagaaaaatgtgttaacggagtaatacatacatagtagtttagatttttttcttctaattgctttactgatgacaatcaaataagaatatgcgtagagctcttcagggtatcaataaaaacagatgcaagtcatgttcacgtgcaggttcagttttaaagggaagaaccgcagcatacatagaacaggagagcgggactgagctgttctgtaccaagctcttatctgccagacaagatcttatcttacgtatttatacacaagcacagatgtgcatggtgaaacatgcatttgtatcaatacaggatagcactggggaggactcctgatgggtgggaggactcctccagtacttgttccactgcagcctgccctcggcacaagcagccagaaagattccctaacagcagagtcatacctgccactctgtcccagcccccagggcttccttctccctacaggacctggccagtccctaggccccagatccgcctctgattcatcttccccacccagctccagctgcatcagcccctgtttgcttcttagcatgccggcaggctggagcccagggcacaagtctccatgtttggcttgaacatcaatttctccaggatgatttccctgatgactctgttttaaatttcaggccctctgtaacccctgtccacacatacacactagaccctatgctccctttccctatctccctccccatccctcttcccagttggcttcacctttctggaatagaaactctatgcaagcagggattttccccgtgtatcacttattattgtatcccaacaactagagagtacttggcacatagtagacgttcaaacaacgttcgttcaatgaatgcatgaattaaatgtaactaatcacaatacattcacagatatatgaaataattcacttacttatgcagaagaattgggtagctatggatttaattagtcctttcacgtcttaagaagtatttaattcatttacaaatataaacaaagagcaaattctttacctcacatggaatatcctcttttggacagctggcatcaaattggctccgtgaacattagtcataacacaatggtcatctttctttattcattggtcatcattctaacagtgtagagtcagagtccctatctttcagatagggagctgtattggttttctacaggtgctgtaaaaaacctctacaaactaagtagcttagaaccaaaatgtattgctgcacagttctgtaggtcagaagtccaggctcactcagttgactt

SEQ ID NO: 1696 - DNA, 25458 bp, Homo sapiens
ctagccacatttcaagtgctccatagccacatgtggctagcggctcctgtactggacagggcatccacagaacagtccatcatggtggaaacttccactggacggtgctagactagatggaagaacggaactgtgagccttgggtatttacatttatttttaaagacgtaggctgggcgtggtggctcacgcctgtaatcccagcactttggaaagccgaggtgggtggatcacttgaggtcaggagttcaagaccagcccggccaacatggcaaaaccccgtctctactgaaaatacaaaaattagccgggtgtggtggcacatgcctgtaatctcagatactcaggaagctgaggcagaagaattgctcgaacctgggaggtggaggttgcaatgagccgagatcgcaccactgcactccagcttgggcgaaagggtgagactctgtctcaattaaaaaataaataaataaataaataaagatgtacacaaaacagtttaattgtggggtcactttatagaagcttctttaaagcatcagctttccaactgcacacaactgtttcccctaagcaacttccaaggcacaaacccagtatacattctctcctaagcattatctcagttgtacattcgattgtagaatatctttcttccttaaaaaaaaaaaatctctcacccaaaacttaagagaaaggggtcatttacaggagaaagggcaaatcattatttttagatggaaagacctccctaagtcaacatttaaatattaaaacatgtagcaggtagtaccaaagggtttctccttcatcacacttgtatttctttactgtcgaaattctctgcccaggagtcagctctgtgtgagctgaaagcaagtgttctgtttgctattgcacatccattacaagcacagtgcctgcctgggacaaaacagatgcttaaatttttgtggaatgattgaatgaaacttaagaagaatggtattttgctaaagaacagcaaacatccttttagagcctggttccaattctttatatttggatagcaatccaccctttattttcaaatgcaaacttaaaataacttagcagactgattcatgcaagtatgcatgctacagctcagtatctttaatactcagcaaaaggcatacagcatctatgtcacagtaaaatatgagctaacatttattgcagttaaacaccaggcccaacgctaagtgttttacatatgctattgcatctgcccctcactctgatagtctctctgctaccaggaggaggaaaccaaagctcaggggaaattaagtgactggctcaagccacagggctagagatgtatagtcagaaaagctcccctggtgaagactatggacgatgcccgtcatatagcctgattggacaattcctgctttaatcaggaaggctacgattgtcctcgtctacaaggacctgcctccaaggaggggcatggctctggatctttgcagccccagagcttagttgagcacctgccctgcaggcctcccacatatttttgtggagaaagactcagcagtcctaatggcttaaggctactcagacttggagaaggccccttctacagaagcaggcacagctcagcacaccccgtctccctctaaaccgaggctgcggggaaatcactgtgaccttgccactatacagcagcttcatgctttggccaccgtgttgcagcctctacggccactctgctctagtaactggcctccttctgcaaactgaccagctgcaccagcatcacggggctggcagcacttccattattctttttcttgctattcagaatttcaacctaataactccactgttttaaaaacacagtgctttagcaagaacctgttgtgctccaagtactggtcagacaactgcctttaaggggctcactttcctatttggcccaattccctcagattagggtttccagaagtctgacctataagcattcattttcataaaaaccactactgacaaagcaacaggttctaaacgtatacattaaagagctaattttttgttggatcaatatttgtcaagggcttgccaagcgggggtacaaaagtataataaaggacatcaatccatgtgggggaaaggtaaacaaatattaatcaagtccctagtgattctacataattctctgtaattctttctgcagtcctatagcatagataacatctccatctatggatgataaaaagcactgcttgtaataactcacttcctaagtacctgcaaggcacgaattcagggccaggcacagttaatcctcataactccctcaaggaaaaggtattactacttccttctccagaaagacaggctcggggcgtctgtctgggtccgaggtgcccacgctggctgagagcgctgaagtggagtcagacacacaggcctgcctggctccacagaccatggtgccattaaatgagactgtcctcactctcatggggggacacagagaaagctccccaccccaaccacaggaggaaaagatgactgtgggagaacacatcaccatacagcatcagtgtcccattagcgcggaaggcaagattgacaggaaaaacaaacaaggaaatagtacagtgggatgcgcaggggctgtatgaaggtggttctagaaaatggggtggcctggcacaggggcagccattccagaactaggaaggcagggtaaggtactccacatgtgttggggggggcaggggtggagggagtgagaggggaacaaagaccaaggcaggctaaagtcagaccgtgtagaacccaaagccaggccagggtactcgtactgcctcatgcaggaaagggggaaccagaacactggggcagggattaaagtagtgatgggagattcactgggtgtcactcaaagcttgtctcaagtcacagggctcttctattcccccgacttatctgaacaggagaaatcctcttggctcccagacccgcctgccctggcattctcccgcagggaaacatgctttggttgttcagacgtgacttactggcacttagaggctgttggcatggaaaaaatgaacaggctgacctggccagaaaggagcaggtgatgcagaaacccagcaaaagatgaattcaccctgccaccctgagtaaattacaaagctcatatgaagggccgcagaagaaagaatgggagagatgatttaccagacagagaaggggaagtctcagccctaggcacctcatgagcccaggagagtgccaggcaaaatccctaaggcacttcactgagtcctacaacctcgcatagacatcactgtgctcatctcaggcaggggacacccaggctcactgtggcgaaagcacctggcccagatgagtaagggagagaagccggagcacacatcactggagcacactttattacagtgtctttctgccttcaatcacttgcccagttttgtaacttcataagagagtcatgatgcccagaacctcatggccccggggcaaaactctgcaccagctctgacactctccttaacctgctgtcaccacacgatacacaagaaccattcctctcaaatcacgaaacaaaggttaaacatattccaccaataataccacgatatgcattaattccatcagtgtggaaaactattccttgtgggagagggcgcacagacagacaactggaagagaaaaaaacagagagaaatccaagtcagatgttgtgcctaacttgaggcaggacttttcctgggatttaagtaggtctggaggctgctctggcacatcctggccacccaggccacgccttacatttctatttgcaatgcaccttcccctcctcctccactccccgcacttctccccaagtgccccatcactgaaaaagttcaggggccgcaggggctgagacggggcgcagggcaccgaccctttcaagcggccacggctttgcaacatgttcctgaaattcctacaaaccaaaaagcaattcagaatcgcaggagggaggcttatcctccactccgcaaaccagaccctcaagatcatcttttttatgctgaaaaggcttttcacaaaatattccaaaccatcttcatagattatttttcctttctcttaaaaaactaagcaagactggatgtcatttagaataccgacttctaaaaaagggcatttttgaactgaatgccacatgctgtattttgccattttgcctgcgcttcctgcttggagcctgtgacacagagaagcctcagacactggagctgctccgggccacgcaaactccgctccgcatcttccaggcagccctgtcgcaaataattcatgtccactacgcccctatcacactgaatacaaccacattgtactgctggaaatgggaaacctgattcagatcacaggagaaggtagaaaaacatttggttcaacacaatactgccccccttcttttttttaaagggaggaaacatatttcaaacctaggaatagggaaaggattcaagacccatcgtggaataaaacacagaatttaaaatagcatccgatgtgacccaaaccagcaacaataacgagaaaaccacccagtccttccagagatgcaccttgtttctgctgcagtgttgctaatcaaaatcgatctgcccatccaagcaatttaaagaggaagggcggcatttgtagaaaatggtacatgttgataaagcatgacctgtcccacatggagagcaataaaaggaaaacaagcctgagaacagtatgctgtgctcaccaggagatggaagagaagaaagccagaataagggcagggatgccgggggaagggaggacggggtgtcaaaggcctgcaggatttttgtaaacagcagcccgtaatggccacggtgagagagaagggaaaacagacatggagggaaacgtgtttacaactgcagcgacggcgggaggcggagggagggattccccgactctgcactctgcgctcggcccgcttcgctccggtggggccccggggctgggatgtgttttggctcctccaccctccacccgctttcttagtggggggaacacatcttgtttatggggaaggttactcctcctctgctctggtgatcgcctccctaatactcctgctgcatccttgcgggatgcccacttgactgacagacactccagccagtcgctgcccgggccccgcggaaaggtggaatttcccaacgcagcgattggccggcggggagggtgggccctggtgattggcgtgttattcggagtggaaagtagtaaacaaccttggtccacggcggcggcgcgggcgcggggtgcccgctccctcttccctcgcccggggcggggtggggcgcgcgcgccagacaaaaggagcctcagcccctcggaggggagagcaggaagggcgcacaccacagccggcggagcgggcgtcccccggagcccctgcgccagaactgctgacttgcagcttcacatcatttttgttctgtggaaaaccgcaaaggttttgtttccataattcggctcctcttcttcgtcttaggttttagaaagtctccaaagagaatggcaatttagttcctcctctttcctgccctccaccccaaccctccaccttttaagattaatttttagttctgtctttgcagaagttgttttaaatccctgtactaaaaattgttgctttattcacacaatacgccattaagggcacacgggtgaatcagatgccccgttagtccctttccttgcaagttcctggagctgtgatctcactgggaggggctgagtttgggagcaggcataaaaagaaacatgatgatattaggctcacttgacaagaaataagcagttacaccttgccttttccacacaggatgtagttcacccaggctatcatctgacattgctaagtccccttctggttggtcttgactcacaacccattcctcattctggcctctccatcctcacaggacccccagccaggggaaacttcccagcttccagcgggaagtgcygcttccccaaattgggcagcacctggggatgcctctagatgcataatcacctcagaggtcctgagccagagtccagagattctttctgagattctggcaaggccccggggtactgatggaggactgggaaggtaggagaaggccacggggagggggaggctggacacaggagggatctccacttcatttatgtgctctttggtgcttcgctctgatggtaagtcacgttgtcactcttggccagacagccagactgtccaagctgaaaacgtaaacaaaagctccttgcaggaagcaacagggtgcaaacttgccacctggggggcctctctgccaccccttggccarccctctcctccagcatctggccccaccccggccctgcccgcctggcatgtaaagcaccccctcctctccaagcatccgttcctcagccgctgtgttcctgtcgcaggtccctggatgggccacacacaaaccttcactcagcttattctttctaggccttaccctgcctgcccgggagaggccactgttctccacggcttcccttgccctggccagcccacttcctgcaggagtgctccgaaatcggttttggtagcactgtgttaaggttgcagatggtgttttcaacactgtactccgactctacttgcaggtttctccacctcagtagaccctgagcataccagggcaaggtgttatattctaatttgtgtctccagtggagacacaggtccacaatatgcactcaatcaagtcttgccaaacatttgcagcactcagttctcgtcttgtccaacactcacacctgcttctgctgcccccaagtcaagtacccctacctagtttcttgctaacatgttaacatggtacccccccccaccaagtgccaagcccttgtccatcactcagtgattccctgtacacatgcagttacttgtaacgtatgctgcttcctctgccagttatgcttttctgacttctcttcttggcaaattcctattctgtctaaaaatcacttcttcccttggcaacatgccacaagttccacctgactcctctgtgctcccagagcacctcagagaggcctcgttgcaacctctgccatcttccgaggacatggctacagagccacagctggcatggtttgctggaagaaccaagagctgaaaggcagatttaccaggtggtgccccccccaggtgtctgcagaacccacatattccagtctccagaccatggaagcagtgctgtttccagcttgtctctgccacagggtccttctctgctctctcagcctgaaggcctcctctgtgtctgtgagtggctggctccttctcaaccttcattcaggtctccgctcaaacaccaccctcaccaccatgcccacctgccagctactatcmcacagaccttcattttcttcatgaggtgattctgaagagaaaataagcttgggagctatcaccctaacttacttattccctcagtgatggaatttgggggacattttcatcttttgccatttgaaacactacaatgaacaactgcacaactgtcatttcacatgtgtgcaagtctatggggtaaatgccccctctaagattggtgggtcaaagaatacgtgtttataacctgagagatattgccaaattctcctctatagatgtgctattctgccgtcctcccagccatgtggggttgttttccaaagagtgtgttatcaaatattttggattttttccaatatgagaagtgaaaaaatggtatcttggtgtagttttaatttgcatttctcgtatgagtgaaatcaaactttttttctatgcttagctatttgtgtttcttcttctgtgagctatctgttcaatacttcatcccaaatcctattgaactgttagcctcttccttaacaatttctaggagctctgttttactttgtttttttaaacaagggagattagctctttgtgatagaagtttcagatatttttctcagtttggcatctgtctttgcttatggtttttggccatgcagaaagtttttttgtaatttaaattcaatttttatgaatgttttcttttctggcttctggattttgagttgaaactagaaaggctttctctgctccaaggttataaaaaggaactcgctatgtgttcttccaggactttcatagttttgtttacacttttaccttggattcacttggagtctagcctggtacatggtataatgtatgaacctaatttactttcttttccagagaaaagaaacatggcatgattgggccataatttacatgccccaatccagtaaatcaagagtttatcttagtcccaatgatttgtgaagctacctttatcgaataactaaatttccacaggtacttgcatctacatttggactttctattctgttccattggtctgtctcttcatctattggtatctcactattttaattatttaggcactatggaagtttttaatacctggtaaggactccttgctcttgttcagttttttgtttgtttgtttttgttttaatgataacctcagaatctaactaaaagaaaaaaatctgttgtatttggatttatattaaattgaaaaacttacggagaactgacatcttgccatcttgctaatgatgattattcctgtctaataaatgtggtatgtctttccatttattccagttgtcttctgtatcttttaatagtatggttatcttaaggtgttttctctytttattttaattggatgtagaatcttcagtaatatcatctagcaagttatttgcatattgtacagttgtatgatgataaatttgtatgttatttctggcagaagatgttctattctgtgcctttagaaggacacaatgggatgggggggaatcaaagggtgatagtcttaacaataaatagaggttgagatcctaatcaagaatcaaagcaatacattytgagttggcattcacaaatgagtaagtcaaatggtgtggggcataatgctggggtggccatggaagaattctgcccaacagaggatgatgttccttaagcttccaacacagcaggttcagagaggttaggaaaaataagcaaggsaaagaaacaagtactgatctaacaatgacggaagctgactccatgccttaktggatgcttgcggaggatggcactatcttggctgggctgactgtattagcaatgcatgtatctaaatcagctctaaaacccatagagagactggcactttagtgtgaacacgtaaactgtgggtgatggtctgtatttcacataagttgtgatcactgcaaggctctgctggtattttacaagtcaaaaacaagtttcctcttccacagccatatgtttgaaagatatgtccctttaagaataatcaaactctcacccaaaacatgtatttttcaaacctagaggttccaacttgaaatactggaccacagggatactcagctcagatcctctttcagaaaggacttgctgtccagctccagagtgtcactagcagatgccctccagctgctagctcttctagggtccacttcaacttttggcctaggtcacactcttcctaggcagctcctggccagtaactgagcccagcaatggtcccagggcccggttatatccatctaacagggggctctgcaaatgagctcccggagggctggcagagtgtctgtcctatcagagtcctggtcaaaccgctccccacacccatcatcttcctcctctcttcctttcattggtgttatcctcagtaaacctttcacatccctaacttcatctcagtatgtctcctaaaaaactcaaatagcaatgaaaatgtttagcaaattttgggaaagtaaaggggggaataaacattcccacataatgtagatccagacgattctggaactagaagtagaaaggcctcatcacacaagccaactaaaatgcacctcaaaggttaatgtcatcgaatttcaaaagtcctcgaaacttccatggttataaacgagcatttcctgcatgctggactcttcatcgttggtctggattaatcctcacttccattctaggtggtgggtacaaggacttccattttatagacaaggaaaacctgatgtaagtaagtggtagaaagcagattcaaatgcaggcaggactacctggctccaaagccttttcctttccagatggtacactgcccacatctcttagtttatcggcacagggtcaagaaggtggtgagggtatggactgacayggcatctacggagctttccatacttataccaagacgcccccctgtaaagagtggactgtccggtagccgggcaaggtggctcataccttaatcccagcactttgggagtccaaggcagaaggatcacttgaggtcaggagttcgagaccagcctagccaacatggtaaaaccctgtctttactaaaaatgcaaataatagccaggcatggtggtacgygcctgaaatcccagctacttgggaaactgagggatgagaatcacttgaacccaggaggtagaggttgcagtgagccgagatcatgctactgcactctgacctgggtgagggagtgagaatttgtgtccaaaaaaaagaaaaagagtgaactgttccgcctttgtctgatgaaggaatataataattggcagccatacactatattcccgggtcaaggaattcctgggtcattttcagcaagcctaaaacaaggtgttcacacatttatttaaaaatatcccaacaaagtgttgcaaaatttcccttgattgcaatgattctttaagctgttaacattaatcttgggtggatgcaggagytgtccactggctttccaaaaggcatccaatgcctttaaggcagcataagagaaacactgcccctctcgatgaactgggtccctgagtctggcagtactgccctgttctccactgtgtcacctatacagggacccctgagaagaccagtgtgcatgaaccagagactggacagtgcctctgttaccatcaccgtgtggtatcatgaagaggtaaccatcccgaagtcacccaacttgtcagcagaactactgggaaaagagcttaacttttcctgtacttaaattcttccatatgtagttggagttacaggccccaaagtaaagacctattaagcttgcctatattgctcctaaattctctactcgtctgttcattatttccaaatttaataaggccatactgttgtgtcttcatcctggtcaatgcatccaatgataccttgataactttatcagagcagtagctagcagaagcacagaggcacggaggatgttaaaactgctcaacaccacggtacaaatgcattgtcagcttatgtaggagtctgctttttatgcaggcttatgcaactggtgtaattttaaaattttataagccatttgaaagagcaactttgatattaatgaaatggggagaaatgtatatacagtcaaagaaaagtgtctttcctttagctgatgtcagagactccctagaaatgaaaaattattactgtcttttagaaaaacaaaggttaaatggaaatagcactggcaggagtcatatcacaacagcaaaatataacagggccaggcaaaccaaggatattgttgcaaatgcagagccttgatcaggctcatatctcgaaccttttattttgtaaagctgccaattttatagcacaaaaattttagttagggcacctttaagattcactgcatctactatgagaagagagaatgtcttagaagagtttttaaaaatactactttgaaacacttatgggcaaacaagaattggaacactaatcactgtaatttccccaccaggatcactaggtaagacattcagagaactggtggaagcaagtgatgattcagatgcagtagtagaacagaagattgccaatcaactgcaaacaaagtgccgcacaggcccatctcaactgacagcaatggtagagagagaagagagaaagaagagagagaagagaaacgagagaagaggagagaggagggggaggaggaggaaggagggggaggaggaaggaggaggagggaggaggagaaggaaggaggaggagggaggaggagggggcaggagaaggaaggaggggaggaggaggagggaggggaggaagagggagggggaggaggagggaggcgaggaggagggaggggaggaggaggagagagaagaatatgagaagggaagttgggagagacacagcccgactgactcagattccaaattacatatgcacaaagcccctcaaaggttatcatgccctatctgatccagggtaaatgaaaactaaatactgaggcgcaattcacaaggaaagtcagagtgtctacactgttaacaacatacattgaataaagtattagaaacatatttactcttctccctactctcggtgctactgaccgtctactgaatacaaggtacaagaagagtttgctaagttttgggtactgcccaggtcgttccacggctaacaaggcaaaaacactcatgtaaactccttggtgggcctggtatgttgtgtgtggagagggtgcctgatgatgtctttgaacttcactttttggtttctcagctatctcagaggtctggctgtagaattactaatattttaaacaatgcaaatgtaattatagttgaagcatactctttaacagaaggagggaaagattggcatttagaagcttcattcaacttttggccttttcaaggctaaatgaatcttagggaagaaataaaaagttcccattgattcacttaaaaaaagattkcttgcaattaacagatctaaatctatgaaaaagggagcatttatggtaatttccataatctctcactttctctagacatttcaaatcaaattgtaataattataaaatccctccttctctctaaatacacacacacacacacacacacaaatatagttaatcagcaaaactttttctgatctcaaggaaatgtcagttacatttacacaagcctaactagtttaagcaatttatttgtaagtagacatgcctcctagattaggaaaaaagtgtatttagctgtatggcatgacacgccccctaccccaaaccgtaaatagtttttttggcagggagtcagcagaagagctataaaaacatcttcagggtatagaaagatgttcaggacttagaatataccttttctcatggttctcttatcccaacgtataaattgtgacaatttgtttaaaagattgaactaaaytatgatattctctttgtcttccaaatttatttagacttggtatcctgttctttctctggaatttcctttgcttttctttttgtcagtaagctaaattacttctcctcccacatgcataaaagcattaatttataaaacacatagccatatgtcatatctcatgtaattctattttacattccactgccgcccagacttatctaacatgaacaaatagatattatttactgtagtcagaatgagaattatctaatgccacttacatagccataaattgatttttgattaatgtttaagcaaaaagcaaacaagcccatctgctctgaaaacaaacaaacaaaaggaagcagcaaacgcatagttcacaggaatttctgcagtattactatgtttcagcggctggtgaggatggaattttttcattgctatcgtgaaaatatactgcttgacaagaagagaactgcatatatagatgcagcttcttctctagcaactgttaatttaatagactactacttatggtgaaacaaaaaacaatcccactctgaagaaagcactgaagacctataaccagyggtgaatttcttccgtattgctcagtggaaacaaaagaaagctcaaatgggtgagtttttcttctttcagggttgctttctctatggatcaaggtaagaaggaagaaaagctaggtctcctatctatctcacacagcagattttaaaatattttwaaaatattttaaatactttcaattttttaatattttaaaaacttttaaaactaactactgtatcgtgtacctatgaaatttcgttttcagtgcaattcaaaattgctaagacaaaccaataagagaagtagaaacacgaccagaaggccctgtcctgtttattggtatcatctctgaggcttcctcagtatctcgcacagtatctgtcagttgacagctctaatccgtttagagttaatttgttctgcgtctattatgcaggtaagagaaaaaaactgctgcattaggtgggaatttcactaataccaatgaattcccaatattctaactttctggggaaaaaagatgccaaaaagagtgaatgcattttcaacaaaaacagcatgttaggattgtagcacagcaggttgaaggatgaaagaatggtaagagcaatttcacagcaaccaaaatgacacaaggacacacatgccggtgagcaaacaagaggcacaacttaatgacgcaagaggaagcagtttgacttgcaactttcaaaattaaattctaaccgtggtaatataaagacagctttacatcccattcaccacgttacacatattgccatttatttgctaacagcaaaaattcaaatgagtgtacttgagtctctaaatattttctacaaacgctcacccccagactaagatagacactgccaaagtgaacgagtcactgcatggctagatttccatgttgaaaatcttaggctcatagcagaatacttgcacaaatcctactgcatctccttaaaaatcactctacaagttgcatcctaagagttcttgtcaaaattgttctttaaagcattacacacatatgcacactggcctagagaacaaggatctttgtctttctttgccaaaagacagtgtttccccaggcctgttttagccttcgactgatggttctgattttggttcagaaaaataattgcatgactgtcctaaagtggaaagagaaaaacctcaaaaattgttaacacatcaattacatcaaccttttctaattacaactctgcatttcattattctgcaggcaaaatgagtaccttaagtctagagccccaggtaaacaaagcctttccctgtcctcatttcaaaactttgtttttataaacattccccgtcccctaaactgaactacagcagcacaatgatcctgttgtgagcactgccttgacctctataggacaacagattgttgttcacttagcccctcagagttaaatcagttttaatacagaagtttctgtcttatcaaaggaagtaaagaagtaaaaacaaaaaatgaacgtatacaagcacagatttttgagcttcgattgtagagaaatggtagttatgtggcttgccaagaaagtgcatcacctacttctgcttctggggacagaggtgaaggggtctgttctggaactttctaaggaggccatcttcgttattacatcagggaagtttctagtcaaaatgttattcctgtctacagggaaaaacaaaagcaaaacacaaaagaacactgcttctaatggcatcatagcaagsagtttatctagaaagatgatgccagcagtcacctcttttccaggaagacagaaacaaaaaccgttctcctcgagaggccaacagtgtagaagccccttttccagaactttccaaggagtaggtgaacttctttgtaagtgtatcagcacaggggagagtggtgctccatgttccaaggaagaaaagcaacccacagctcctcctgcccgtgcagcagatgaccagaaagacgagaaagggaaacaaactcccaytcatggtgaggctgcttgtttctcaaacacacttttccaatgcctccacaagttgyttgtttctgtattttgaaagcactcaacatgcagagtatttgctaaccacaggcagagtacccagtcaggatgtaccaactcaaactcctccctggggcaggcaaggataaacagggaacaggtaagagaggcctaaaaagccaggtggacagagaccacatgtgaccccaaacagaaacaggctgctggaaactaactctctctctctctagctgatacttattcarcacttactgtatgtcaggtactatyctaaaaactttacgtatagtaactcagttttcacacagatgcaattattttccatactttagagatgagaacattgaggcatagagaggttaagtaatttgaccaaggaagcacagccagtaaatggcaggccaaggatttgaacccaatcagtatttttttttgtagctcatctccatggagttagttggagtctcatcagcacttcctcgtacagggctccattttactgatttctatcaaccacaggacatacttttcttttttcttcgtaccctgaagaagaaatgcactaggtaacttcaatatgatggcagtaagattgtttttcaacacatacacacacactttcaaaaaaaacttagagaccagatgcggtggctcacgcctgtaattccagcacttcgggaggctacaagcgaaaggaagtcaagaccagcctggacggccaggcgcagtgtctcacgcctgtaatcccagcactttgggaggccgaggcgggcggatcacctgaggtcaggagtttgagaccagcctggccaacatggtgaaaccccgtctctactaaaaatacaaaagttagccaggcgtggtggcacgcagctgtaatcccagctagtctactcgggaggttgaggcaggagaattgctggaacctgggagggagaggctgcagtgagctgagattgcaccactgcactccaacctcggtgacagagcaagactccacctcaaaaaaaaaaaaaaaacaaaacaaaaaacaaaaaccccgcctggacaacaaaatgagaccccatctctataaataattagccagttgtggtggcatacacctgtagtccccagccacttgggaggctgaggcaggaggactgcatgaacccaggagttggaggttgcagtgagccacgactgcactactgcgctccagccggggtgacagagtgagactccatcttaacaacttaatggtaaagcaggcctccagtacactttctcctccctgtcttttcttcttttctgaagattactacttactcaccgttccccattggtttagatgataacagaagaaacaggacactataaaaaccttattttgcaccacagaaagcaagatgtgaaggcagtcaggtttgataacagtgcgcactgtttttgcagtatctttcatcacgaggctctcacatcatgtgctctgagctcatgtaacacactctgctggaatgcccccattcaagaggggagagagtccgtgacagtcctccctgcactcactgtgctagcaaagatgtccgggaaggacagaaaagaatgtaatgtgcaattaaaacaagggagagtgattaatgtaggcaaaaattaatcacaagggcagtgtcaaagtttggtgggacaactgcgtgttcagaagacacctgaaaaaagtaatcccatgataaataacatggtaaaaagcttagattgtgccattaagttttcttaatattatggataaaatgacaacaggcaaattattttctttcccaggtgaaatgaagaaccaaggatcatctgagcaaagactcaaggaccatttgaacaaagacatccacatctataccacagatgacttggcatctatggaggagtggaggtgagcaccactctaccatgtagrggaagcagccactgtggaggctgggcttgtggagattccttctggatgccctcagatctgtcattaatggggacaaagcagaatcaagggactgctctatctcatctaccactaccagctccaccatccagggtactgttcttgccactgcatctagaaagaagaggaatgcaatcttgcagttagaaaaggctgtctcgctgaatatttattctcattcctctacccaaaactaatgaaaatgtgaagtctgagtggtgtctgaacctaatattttcgtgtccgaggcacacaaggttgagctgccacttctagccatctgaaccacccagtgtgagcatatatgtggctgggagggtgggtggtgatggtggtggtagggaggtgggggagacttctaatgagaggcagtagagagtagggtctaagagtaggtactctagagtcacactgatttcggttcaaaccccaggtctgccatttactagctgcacttccttggccaaattacttaacctttctgtgcctcaattttttgtctctaaagtggggataaatagttgtatctgtgggacaactgagtatatggcaagtgtttagaatagtacctggcatagagtaagggctgaatgagtgtcagctccagctgtcatctaggtgtaagctcactggcagcaggtgcaagattcttttggatggctaacaagctacagctttggctgacagtgctgtttgtgaaacccagtggcctcttcactccatagtcagccttccagtgctcctgcccttggtggccttggcaggagcctggggttgagtggggactcagacaactgaagctctcccagcaaaagcaggatccccacgtctcccactgacactaaaaaacaaattcttgaatttttcccgggtctgctgagtgatcacaagaggacagctggggctggatgacagagcctcagcagtgacagggaagcctgcttacttccctcatgctcagagtgccttttggccacgggcttatttcagctgtcttktgttccatttctgaggctctaaagggatgctctgggaactgggatctaggaataaatcaagatgagtggggcaaggttaataccctgattagatcagcctggcccaacgccctttgaccttagagtactggaaaagtcttgacaggcaagggcatgaaaaggtcatgtgctccaggggcactgtcttcaaagaggagccttcctggggtaaacaggcgcatctaccttctcaataacaggttcaaaattcaagaaagcaaacagcattccctaactatcaatattccactaagtcctagaatagttttagtttttaacatcccagatagcattttcaattgtaatgcctggaatgagaggcagaggatcttcagggtcacgtgctattttttatgggtttacatgaaggatgcagatgtcattttaatttttatctttctaaacatagtttggccaccatccctgctgaagaccacagtgagtccaaagaacatggttaactgaaatacacagataatcacagaaattacttttaggcaatgatgtcaactttgtcccactgatggaagaaaataaaaaagctgaaattagaaaatctaagttttttctcataaaggtgaaccccaaacctgtccaataatactctactaaataaagtctgttagtaaagaagggatgaaaaaaatcagtacctaaaagactctcaggccgtgaaaatgattttgtaaattctcaaatgggctttgcaagccaacagatccaaatcacaactgtggtcaaggcattctgcagagtctcaatgctaggtgaagaaggcatcttgggaaccagcagactgccactctctcaacattgaaaagatatctccattctttgaaagtcactttcagccacccagaaagttacctggagaaaagtatggtgaatgaaactgtttagagtttgagaaggagcaggtctttcctatgtaaaaattccaatgaataaatgacaataagatagaaaattgccattaaagcatggcagtaataattattgtagataagctccaccaaagcatgacaagatcagtgagtgacaatgtgatgagaaacaggaccttggccagttgtggttgggaggctgaggtgggaggccaggagttcgagaccagactgggcaacatagtgagtttctacaaaaaatttaaaaattggtgaaggccaggcatggtagctcatgcctgtaatcccagcactctgggaggccgaggtgggcggtcaggagatcaagaccaacctggccaacatgtgaaaccccgtctctactaaaaatacaaaaattagctgggtgtggtggtgcctgcctgtaatcccagctacttgggaggaggctgaggcaggagaactgcttgaaccagggagttggaggttgcagtgagccgagattgcgccactgcactccagtctggcgactgagcgagattctgcccaaacaaaaaaacaaacaaacaaaactggtggggcactaattagtgatggtgcacactagctacttgggaaactgagatgggaggattgctcaaacccagaagtctgaggctgcactcccctgcctgggcaacagagcaagactgtctcaaaaaaagaaaaaagaaaagaaatatgaaaaaagagaaacgagacatctgcatactgtgagtatcagccctaagatatcagtaacaatgcgaaaagcagaaaatttacactggagaaacctggcaggcaccacctcaatcaagtgttcaaggctaagagatcatcagtggtaagatgctgacatcacacagatgtgacgcactgagatgcaatgtcaatcttgtagtagtcttccccaaaatgtataaaaatgagtttaatgatgagaaacattagaaccaatttggagcattctatgcaacaacctgtccatactattcaaaaatatcaaggtcatgaaaaacaagcaaagatagacacatttttacagactggagaagactagatatagtaagtaaacacaatgaaggatgttgggactgaaaaaggatattagtgggaaaactggtgaaattcaaatagtccatggttaacagtattgtgtcattgttaatttcttggctgtgagaattggtgtatagattatgtaaaatgctaacgttagggaaaactgggtgatattttacaaactttttttttttttttttttaaagagacagggtcttaatctgtctccaagactgttgtgcagtggcatgatcatagttcactgcagcctggaactcctggctcatgcgatcctcccacctcagcctcccaagtagctgagactacagccacgtgccaccactgctggctacttaatttctttttttttgtagagatagtctcacagcttggtctcaaactcctggctttaagagatttgtcttggtttcccagagcactgggattataggtataagccaccatgcctggatgctttttcaacttttttgtaagtctaaaattatttcaaaataaaaagctgagagagagagaaaaaaaaaaatcagttcagtttctccccggccagtggggtcatcctcactacaaagttgctggtttgggctctagctctgcggattttcctcactggacgaatttcataattgtcgctaccactgatattacacaattgagattctaactgaatggagagtgatggaagaacatgaatgaagaagtcatgctgacattggggaaagagaacttactgaaaatttttaaaatgttaaatattttacattatcttcacaatccctgtacccccaacaccttccacagcaaatctccctcaacaatacttcagtaatctggctagagcccaaaacaaatacttcttattcagaacttggctttgaagaaaatgcagccctaacaaaattttaagtaagttactgaaggatgcagaggcttcattttacaggagttagttccagaggtgattttgggaccagcattattcccagaccccaaccacatctaaagctgccaggagggtctggcttttgattcctctgtgactcctttccagactaaatcaatgtcacttggttccaacaactgcagctcttccctactctttgacctgctgtgcctaaaatttaactttcccaaattgaggagggttcatcctccttgcctgggtcaatccttggggtggacaaaaggtattaagacaactatggaagcctatccactctgtcgagagaaacaattactcctaaagaaaatctctacttaaagccacgattaaagtcactctcctcttcatccctcaacaacttgctttgaaagggtaagaagggaaagaagatgagtgcttccacttcgctggtaggggtgaatggtaggtagtcctatctgcactctttccatctagtcccctacacataatagcaacaagtgtgctagttgtatgctacagttgttgtagcctcttagcagagccttcaaatcctggtgtgtgggtgtaggtctgtgtgggaaggtgtgtgggtgtaggtttgtgtgggaaggtgtgtgggtgtaggggtgggtgtgtgtgggtgtaggggtgggtgtgtgtgggtgtaggggtgtgtgtgtgtgtgtgtgtgtgtgtgtgtagggggggtgttctcttgccctggccacctaaaaagcctaagttactactgacaaaggatcctattccttttcactcaatataagcctataagacatctcaacactcgccatcttacaaacatagagaagcatctgggtgtctgggcgtgccctggacccacaaaaatccctaaccaaaactgttagctctgacaacggtttaagcagaagtaatagcatatacctctgaaggcagaggtttggtttttattgctaggtttactcctgctcgtttataaggatgccctaaatgccatctcccaatgaaaacccttccatgtccaggggcaaaggatgctctggaccctcaatgcttgagcctactgaaccatccaggaccacttcgcttggctcgtctagtgatgcagagctgttacatggttctgcaaaggattctcagagagattcccacctcacagtcactgctttgctttcagatatttctggtaacccccagagttcagtgtctttctagcttgatttgtcccaacagaatggagccttattgaacctatggatcaattctggtgaaatgtcaaataaggcaaaataaaacagaagtaagtgtgaaggcaagagtttttaccagaatctgacccttttgtgagataactcacgtgacggaaagctctgatgatattgctgaagctggagtgtttaatgacctccattttctcaagagcattttccctgtaaacaaagatgacaactgttacagccagagaaagtgacagcttctgaggtttccaccataaacacttgctgaggctccactgatgccaggcaccatggtgatgctggtgatctaaagacaagagtcaggcttaaaagctttgcaaactctttcccaaaaaaggtacagtctaggcaaagttcaagctgtaaacttgtaacttcaacatcagctgttacatgctccagcaatagaatggattaatttcttggggacagaggagaggatattaagggtaaagaaggattttaattaggagatgacatctggcaagtcctcataaacccagcagcacagagctggccacataaatcaaacccttgtattcagggtccatactattactcaacaagggtaattcgagtaattaccagagttatcatgatccaacacataagttcatttgaggaccctgactatgcaagcatgaatatttttttggctgcctctagatagcatgtttatgaaaaacaggttaagttactggctccaaattactttttaataaaaaaagcaaacaataaaagcttaagcttttaagatttttcttttttgtttttaacctggaaaataaatctccctgtcaaaaacatgcaaaatgaatgatttatgtgatataagcttgggtatctgtgttattattacatgacatttcctaacagcttataattgccttaaagattgttttggaaaggttataccttctccctattcccattccctttaaataaacccttgtgtaatctctggaaatttttagactacaactatcaatgggccattcaaaaatggagccattgtcaagtcacccacatgaaatagtgaaggtttacaaccaaaagagaatcgctcacttccacaaaatagctgatggaaatactgtgctccgggggcttacgtggaacaaacattaggaaggtgtctacctgcaaacccgctctaaggctggaccaaaccagggggtccaggtcaatcacaagtactgaatcaaccaggaaagtccacagaatactgagagccatcaatgacaccactttagaatttaactgttccaaaccctttgtttggcagatggggaaaggagaggtagagggagatcagaagagtcaatacaagaatcttggctgattggctggtttttctaatatggttcattcaccacatcatgttattctattgaagttcaggagagggtaccaggggatacctcaacccaaaatgacttcttcacagttttaagtctagggggaaaggcccataatgtagtcctcaccactttttcctaggaatggctagcatcagacatgacctaaatctgtagagctagttcaacattcaggttaccaaacaaagtcatgaaagaatgtaattactatcacagacatagactgtctaggttctaaagcaattaagctggtaacgtactatttacaataaaaaaattggtttcacaaacctgtaacagagaccaggtaaatgtgccagaaattgtataaaccatggcataccttgtatcaatttttatgtagacacagcaagcaaacacagttttggaagataattcctatattccaacttagcataaggtaattaactgtgtcttaaaagaggaaaagaaaggagcctagagctttattaggtgtcccacctaacttaaatttgtttttctagaaaaaaaccatgcactcaagaaaggcaatcaagatctacatacttaattcacattcacagaaacttgtgaatatatctgtaaaaggattatcattaatccttcaagctcctagagtaggaatacaatacccgggcagtggttcaagaaatctaactcgtgagaaggttacacatctcaggggtaatctaataatgtaaacttttacaaactttccttcctggtctcttgccttcagtaggtcattcatttaaaaacataatgagctcctggaatatgctggggaccctgtggggaataaggcacttgtgattcctgcacccaagagtgtagctggggctacaggaatgttttaagacacctcttaactgtttaaccgctagtgttttaagacataattcctgccct

SEQ ID NO: 1697 - DNA, 15042 bp, Homo sapiens
ccagatgtggtaagaagctctttcagccggacttggtaaaatgccttgtttgaatcgaagtctgaattggcggttatttttaaattaataaagtttttctatttggaaggacttctaataacatagagcagtatcctaagaagcccttggggacttttttaatgaattagaataatgtgcaattagaccgacagttgtaactgagtgcttcggagggcttgaaagtagttgttctcaagtagttcacgtagcatcaagttcacagaaaggattctaaggcactgaattgctcgattttacaatgcactgggatataaatgaacaaatgcactccacagtacatattaggcattccctaggcttaaaaaacccaaaaactccaaaataggaaaaaaaaaaaaaaaaaaaccatgctcagcaaatatattaggataaatatgtatcagaaaaatattcgtttcaggattcctttaaatagtaagtccgcctcatgtctgtgtgtcttcacagatcattaatttcttggcaaagaagttggggtgcagacaccctgtggccacagcactggaactgaaggtcagtgggaacgtgatgagaggggttttgaaaagtctgcgctcctctgaaaacattctgactatgccttttctctctccacggtttcccaaggccactactctatcttcctctgtttgaatccaaacagaagtacaaggagtcagatccacaaatgagtcgttttatcttgccctacctctctgtgcagtcaatggccaaccatcctatggatggacagtcacaggggcccaaccaaggtgtcttatacgagcaggcagagggcttgcagtggctttttgtaggtttttggctggagctgaactaactgcaaactaaaaaaaaagttcccaacagcagcccttcctgaagctgacggtctgactgtggaagtttagcccgagtatttagggtgctgggaagacatgagaactaccttatgtcctttgttttcttcctaagcaaactgggcagtcttgttcatgcaaaaccactatggagtgatcactgtaacaggcacgctggaccagagggtgaatgcccccagcgggaatctctccctaaagccttgctttttcacatcacgccacctcccctcttccaaattttggaggcgtactaccaataggaactcactatctgactgattaatcagctttcagtagacaggagcgggacaggtgtgggagaaaacatttctttccaactcccattctccactgcagaataccacaataagaaatcttaggccgggcgcggtggctcatgcctgtaatcccagcactttgggaggccgaggcaggtggatcatgacgtcaggagtttgagaccagcctaaccaacatggtgaaaccccatctctactaaaaatacaaaaattagccgggtgtggtggcgtgcgcatgtaatcccagctactcaggaggctgaggcaggagaatcgcttgaacccggaaggcagaggttgcagtgagctgagattgcgccactgcacttccgattgttaactagcagtttaaatgaccacatttaatcagctaagtgagagttggtttaaaaggccaattacaaaagaagtggtaaatggccttttaaaccaattcatagtatctccaaatgccttggtttaccaagtctgagggtttcctagaactctccttataagcattagaatgaaatctagtcctggctcttttcccatgaccacttcctctttggttcattaagaatataaacattacttaaatagagcaaagctccctgagctaaggggtcttcatggtatacattcaaacggcatgtgaacgaggttacagggcatagtgcagaatccctcctcggattccaaggtggctaaaaatgcctatgtcagtggatttgcctgttttccaagtcatttgctctgaaactcctaaatacaaatatgaaaacaacagcatgagacttcattgtcatgtttatttgttattcattctctgattcggagttggggggcaggggaaggattagacacaattttaagccaaccagcctctaaacagaaatatggtttattctcggtactcaaattcaaatcttagtaacatagcaattacattttaaaataaactatctccttgtgcttgcttctaaggagagtgtttagtgggatatgaaaagagtctaatcctaggcagccgtatggccagaccaattataaaccccgtagacttttcacacgtcacagagagcaaactgctccaggagcagctcttaatactttattgcctattcaggtgcacctgcacttttaagatatacttgtcagcaacaaaatacagcacttccctctgtctttatcacattggttgccagacaactgcacagagctaaagtaggtaatgttacagtaaacagctccctaaaacatttacatatgtcactgataaacaatagaaaatttaaaagagatacaaatgtactcttggaaccttaaatcttcttcccactgaggcctaagaacttaaaatcttcatacacctggctgagaaaaaggaaacaaattccaaaggaagtctagatttatagcctaaatatgtcttcctctagaatatttaatacacttaagctttagtcattctatacactttgaaaatgcccttcaacgataaattacagtcgttgcatttttcattgcagttcacttaaatatcattttgctttcaggaaaacaattataggacagtaaatcacttttacattgcattccaaaaatatttaagttgcaacatggacaatgtgtagaatcacaagaaaaatacagcttatatattctatcattcagtcttctacagcaaacgttaaatccctgaggaaagtcctaccgttagtttggtttttaaatatttagattatttcagcgtatgcacataagtattagtgcaacaaatatttactgaactcccgcaatatgcagtcatccagatttggggtagaaatttgggaatccccctgatttcaagatatcaaccactactaccataattacctgcttcatgggcatttaacatggcaggccccagcctaacaactctacacacacagactataccatttcatccccacaactttcctgagaggtggagatcatcattctgattgaaaagtatggaaaggtcaccaaggccacatggctggtgacactggaggatctgcccaacattcacacccataggggtgatcagtatagcatgccctccatatctgagggctccacacccatggattcaaccaactgcagatcaaaaatattcaggaaaaaaaataggatgcttgtgtattaaacatgtatggacttttctccttgtcattattccctaataatacatgataacaactatttacattgtattaggtgttataagtaatctacagatggtctaacgtagtggtccccaacctttttggcaccagggatcggttccgtagaagacaatttttccacagatgggtgggggagagggatggttttgggatgaaactgttccacctcagatcatcaggcattactgagattccctgcatgttcagttcacaatagggttctcactcctatgagaatctaggacctctgctgatctgacaggaggcggagctcatgcagttaatgctagttggcctgccactcacctcctgctgtgcagcctggttcctaacaggccatggaccgggactggtctgtggcccaggggttggggatccctggtttaaagtatacggaaagatgagcatgggctatacacaaatatcacaccattttataaaagggacttgagcatctgtggattttggtatctgttggggtggtcccagattttggtatctgttgggaggtaccagttttctcagggaaaactgtatatggtgccactaatatggtgccactgtatatggtgccactgtatatggtcttctaagctatgccaagtttgtaaaattaaagaacaaaacaaccgggcatggtggctcatgcctgtaatcccagcactttgggaggtcaaggcaggtggatcacttgaggtcaggagttcgacctgacctcctggccaacatggtgaaactccgattctactaaaaatacaaaaattagccaggtgtgatggcgcgtgcctgtaatcccagctactagggaggctgaggcaggagaatcgcttgaacccggaaggcagaggttgcagtgagccgagattgtgccagtacactccagcatgggtgacagagcgagaatccgtttcaaaaaaaaaaaagaagaagaaaagttaaaaaataaagaacgaaacagcgtaatagatgatcaagtcttaggagagtgactgcagactacaactgcaacagagtgtttaggaaaaaatagatgttagctagtaagtgatgatcaaggaaaaagcatgggaaagaatgccgagcaagtgggagaacacatgagtaacagcagtggggtgggagacaagggcccagccttttggcagaaccttcagaaaaccagcctaatggcccatgcctctggaaagcagcaagaagataagccaaggtgtcctgggggaaagctgagtctaatggttaggacttcacatcacagagaacagggagccaccatggtattttgaacatatgagtaccttacctaaacgagttatttagataagaagaagtctgacaataatttacaggatgtattggagggaaggaaaagctgaaggtgagaccgaaccatgaggctgcaccagagaaaaggcactgggactgaaagagcagaggaaaacataaagggcatttcagaagagtgaaagagatagggaggaaagttcctgagttctgcctaattatgtgagccgttcaatactcaccagcaagtgaggagaggaaccaggtggccgtgcacacagggatgtgcatttgctctcttcgacctggggagaacgggcagccctgtcaatattctccactcctgtataggctgctgtcaaccagtcagccccgagaatgacaatacttccatgttaccctccctagttccgagtgctggctatgcgacaaacatatttttaatgagaaaaactatttttgtttcagttttgtttgaaccacatcattcacaaatgactgagtataagaaacaacacaattccaaaaataatgttgcttaattttaggatgtctagtctttttttccccctctttctctctcagaatatgcctgaaaatagtggttagccaagtttttgtttgtttttgtggtggctgttttgtttatttaaaccagggtgagaaatattttctgggagttttaactactggatcacaaacagaaaatgggggtggcagctatgcaaaaacccctatgatcatgaaaccaagaagttatggttactaagcactgtgaatttaacaggagcttaaaatcatggctctgacacctggaaagatgccactgggctcagaccagccctgtgcagctcacaacttcaactggaatcaaacctgaccatatccccacttctcacttaaaaagaaatggttttggccgtactggtagagcaaaaccagaaaatagactttgaattagtcttcatgctttgcaaaaaggtactaacttgttaagatgcatcctccatgtctaactaagcctggtctaataactgttttgcatctgtcctctagcagtctgctgctgattggtggtgggaggggaagagggaaacagcttaaaccattactcctgttttgtgggcatttgaagtagctgccaggcacatgacaccactgctccaattggttcagagtgacatcacttcatgattcaactttgtttgcatttcggcttcctcctttccaaggggttctcaacttcaccctgccaagtcactttcaaacagaaagagagaggaacagcacatcttatgtagtcatgaagtgtcaaatgtcctttgtgtttcttagcccagtttatgagaggagacctggagaaataaaggtttcaatcaacaccacaatggtgtatgactttcttcacagcatgaggtggggggaacgggaagaaaagcaaaaggtggctgctaagctttgagtaagttaaaactgatggacttcaataaaaatcctcaaagtttgttttcaagtgggaaaactctaaaatagaaaccacatgcaatactatgctggaacctcatttaaatcattcacgcttctaagactcagagaatgtttctaatttagtcaaacactaccctctctttctccaaaataattattcttaatttatttcacctaacttctgttttttacatcttagcaatgtgaccaccaraagctggagcaactgctttctgattcagaaaataaaagtttattctgatttttatttctgtcttccatacagtcagttaccagggaactcacaaaatttggagagttcgagcacgattaattttgtgtgttcagctcaaaggaaaaagcttcctcataggagaaatgcatkaatggatgagcgaatgaataasargctttataacccaaccaaccagaagccgaggggctcactatattaaattataccagctctcaatacaatgggtcaaaatgtattttattttaaattctaagttaggctccaaactttacatcgggaccttgtaagacgagatcttttatcatgctagacttttaytatcccctaggaaatgtagtgacattaaccaaacacacaaagccatctcaagcctaaaaatgcctattactccaatcctgtactcacttgctccctgccagagayaacayaaagagatgagtatacacactcaggaaaacttygcccgggccttcsaggtagggcsaggactgtgcaccacacgagatgacttgaaaacctgtaggaaggytgtatctcagtgccacttgctttgaggagactcactgggtaactgtttgagggtggctctaatgctctgcaacagtccctgcagggacaaagagaaatttccatctttctgaaggcctaacatctcttttcttgtaatctcattgacttgccttgcctagactcaccagtcaattattatttatcatttacagagtagctcatattgacaacatacctacaagtattttagcacttcatataccttttatggtataagtacctgtggaagggaaagggaaatgagttggcctggagtgggaattaagaagccatcatgaatatacatgtgcctgtgtgtgtgtgtgcacacatacacccgtgtgtctctccacgtctgaggccagcagctaattcctgctcacctttcaacacttctagtcttggctcctgagccccaggtactctattcctgaagatccttgcagatatcaatcatcccaagaatgggctagtggtttccgggtttcatraataaagctgtcccattctcatcactaatcaaggtaagagagttacatcttatttctctgccttggtttcatcatctatggaagagcagtcatactggatctcgaaacatgcattttagtgcatcatgcacatttaacgcctccctcacgcatcactcaactgactggcaagccaccccttccccttcgactctcttccaaaaatgcttacgaacttgaaatccagcaraaaaggggccacagtgactacgtactcatgattctgttttactcttctaaattcacggtctacttactattaacttatatacacgttaatatttaagttccagatccaagggaggtaagaagcagctaattctagggaggcagggctagagagagtgatggtaaaatcagtttaaaaaggggggggggaggcgtgtttaaaataaaagacaactataaaaaatcaacagaggaagggaaaaaccagaagcgcacaggccatttagcgcaatgtagcgcgtctcacaccagaagttgtttacacactcttggacgcctgagttctccttgayttttgtttttcttcattttatctatcttcgtttatccatcttctagttcatctacttaaccttcttgtaactcagtgctgccaagtggattcggcatcagcatttacataaaaaacacattgcaagcaaactgcattactctagctgttgtacaccaaaaagaaaagacacatttaacatataaatatgtgttcacataccaagtgaagaccaatttatgttgtggtacttccgtgaactggggccttgcgatacttaaagaaaaaattcaattgtgatgtcaaagagaggtgttccgtaattcaaacgtactcaggccttcgaggtcagtttattcacattctgagcagtggtttacttttagcaaaatattacccatgtcattaaattaatatttgggtttgaatctttttgttttakatgcacttaatgtgtaaaatcatttaacttacagttgtaaaagatctgcaagcgtaaaaaattgacacctaggccttataaggctgtaggtatttaagtatctttataccaagtaatttataatgacactgagggtctgtgaatttatcttttgcttttaaaaggtgtctcaattaccttagatgaaaaactgccttgcccacctgggagcatcattatcttatcatagaatgaagttactttcacagtgatgaccctgagtattgasaaaaagttggattatgttcattatattctttttaatgcaagcaatgtaaaacgtcctttakaaatgtttcctttaaaaattatttaaattgtattgcttaaaaaatatgactctttcaactcagttatcacttaaggtttcctggaatattctgctgtttagaacatatttgtaggatatgaaattacctacgtatgtgactcttataagaccagagaaaaaggctagaattatatatatatatatatgaaaatagcrtcagcaattccacaaggccatcaacttggggtatgaactatccgtgaaggactagtgatggctgaacttcaaccacactctgaacagcataaaaatgagaaaactgtactccttgatctttagttctcaaagtgtggtttgtgaacgcgtaaggattctgcagctttttcagggggtctatgagattaaactattttcatacactactaagacactgtttacctttttaactcttattgtctcatgaatgtgtgccgtggaagtttccagaagctgtgtgatattggcagcagaataaacatagaagcaggtatgatcatccaattgccttctgttaagccagagattaaacacataaaacaatgccactctattcatatactggggtgggatatagtttttatccaacataaaagtacgttaacgcatattaagttttgttactgtttctgaatcaataaatctttttaaagttattaattttaattcttcatacagcaagtatcaatggatacaacccacataaacgaaagcttattggcgtttgtcctagcctgtctgggcacctataacaaaacaccttaaactaggtagcttttaaacaacagaaacttattccttacagttctagagtctgggaagtccaagatcaaggcactggcagattcagtgtcttgtgagggctccactttctggttcacggagggcaccttctagcagaagaggcaaagcagctctcttttataaaggcacaatctcattcataaaggtcccccaccctcacgatttaatcccttcctaaaggccccagctcctaatatcatcacatggtgattaggtttcaatgcatagattactggggcaacataaacatgtagacagtggcagggttttccatttttaacagtgtgaaggggtccagagaccactgaatttgaaaacccctggatgatttcatttttctcgacagggaagctacaagtagatgagtgccaaatgtttctctccattcctggcctgtcccctgagccctacactgctgtgttcaactccatcttagcttgccccccctggatgtctgaggcatttctgacctgagagatgcaagacagagctcctgccccatctgccttctccaccacacacttcccaaactacactgctcctccctccccactcctttgcagctcaggaatggaagcctccaccccctgttctgtccaagccaaaatgtctcagaggtatctttcactctcccagtctccattcccttcaggctatattttacaagtcttcaaatattcctaaatctatccactgcaaattgctatgactctggtccagtggttctcaacagggtacaattttggtctccccaccccctaatcccaggttaacatctgtcaatgtctagatacatttttgattgtcatgactagggggcggggtgggtgggcttctggcatctagcaggtagagactagtgaagctgctgaacattttgcaatacacaggacagccccccacaactaattatctcacccaaaatgccaacagtgccaatgctgagaaacctggcactggttcaggactgcacccctaccccccgccctgccactccccaactaattatttcacccaaaacgtcaatactgccaatgctgagaaacccagcactggttcaagccaccaacatctctcatatgcacggtcccagcagcttcctaagcggtctccctgctttttccactattcctccttctccccttctccacccagcagctagactgactgttgtagaaatcagtgtgccactcttgtgcttctcactcatccccaacttccactgtgtattgagtaaattctcactcttgccatggcctacagaccctctctgctctggtcccatctaatactgtgacccatcttataactcgacgctatgaaatcaattgtgtctcatccccggccacctcccacctccaccctgccaattcatatgtaggaaccctaacccctcatgtgactctgttgaaggtagggctgttaaggagacaattaagatcaaatgaggtcataagggtgagaccctgatacaattggattaatgtccttaatcagtgaagagacaccacagcttgctctctcccaccactatatgaggatacagtgagaaggtagctgtttgcaaaccaggaagagagccctcactagaaccagaccttgttgacacctgaccttggactttcagcatccagaaccatgagaatatgcttctccaaccatgacgctggagagaagaggtgaagtaggcagaggcaagactgggaaagtagggctggggtggtcagaaagggcaaatcacgaaatgtctggtgtgaaaggagaaagggatctccccagagcttgagtatggaagactattcaacttcagaaatgaacacagagagggagagggaatgctgcaatgtctattgtttaagccacccaggctacagtaatttgtcaaagcagcctgagctgacaatcactctcagtttccctcatcttccaagttccagccttgctggtcatcagtctgtgcccatgtgacagctttttcttcttatcctttctcctgaacttcccatggctggaccttccaatctcccttagtctaaatgccaccttttcacagaggcctcaatgactacccagcgtaatacagcacccctcaaccacacctggcccccaacccagcactcctgcattgtgatgacagtactgttttgtgttttcttcttagatgctcatcactagcttattattctctttactgtgcatcctaccatccccaccccagtattcttactattattattattattattattattattattattatttttgagacagattctcgctctgctgcccagtctggagtgcagtggcatgatctccactcactgcaacctctgcctcccgggttcaagccattctcctgcttcagactcccgagtagctgggattacaagcatgggccaccacacccagctaattttgtatttttagtagagacggggtttcaccatgttggccaggctgttcttgaactcctgacctcaggtgatccgcctgtcttggcctcccaaagtgctgggattacaggtgtgagccaccacacgcagcattgaagaaatcttttctgtcttgatcactgctggagcagacagagcaccacagctgcctaatgtttgttaaattaataaataagtgaatgaacctggctttgaggatctcagatccatacaaccgggcatttatagccattctctgagtcaggcagctttctggagccacatggttatgagaatgtgccttgccccaagattcatctccctctcccacctccccaaagaaagctgccatgtttgtggcaatctcatattcctctggggaccacatgggacaggaaggagtaattaactgcaatatccacagcgagtagctattcatattcttacactccagggagcatcaagtcttaaggttacattaaaacacaggcacaagggaagtccccagtgtttattatctgcagctacagagtgggtaaggatgagatctggtcacttcaattgaatttacaggcaacttctcaagagcccaactttgaactgcccaaagaaaacacaggcaagtcctactggcacaagagaatggggtgggccgatggggagtgatggccggctagggttgacatttgttttttccaccatattcaacacaggcaagtgctttcgaattactggctccctgaaaagggggatctggacacatatggcaatgcgatgaatgatgattcctggaaagaaaaatgcttaatgaaacaagaaactcacaatttcctgagacctgatatgcacaaggtactgggcagatcttgtagttattgatgggaatttcagagaaaggcctgatgaggcaaagctggctgctggaacctcaaagagacaggaaaacaaggatgagacccatgattagggccactgtgaagactccagaagcttctgaggttcgagagaagaggtgaagtaggcagaggcaagactgggaaagtagggtggctggggtggcctgaaagggcagatcacaaaatggctggtgtcaaaggagaaagggacctccccacagcttgagtatggaagactgttgagcttcagaaatgaacacagggaaggagaaggaatgctgcaaatattttaccatattgacttttaattagttgagaatcaatgtaacaggtctagacctcatccagggtggaggcagcatgtgggcaatggtaccaagaaagcatcagaaagaagaagggcttggaaggcaactacagaacaggctgccccacatcaaacttaggtagaataagactcacttccattgttccttctctagccaaagctagagaagctctgaatttctctgcatttcgaaaacactccaacacacagagtcacacaaaactctcctttggaccagatggaccctatcctacgcactgagagatttggagtgaatgggacaagaggtaagcccagtctctttcctccctccctcatcaccccccacacctaacctcttccaaaaacatcaaatattttcttccataaataattgcaataggatgccatagcttttcccaaacaaacaatagcctgattgtgccctgtttgcatgggcccagcccggcatacacaaaggcctgctttcatgcgccaggcctctccccactgtagaaggatgggcatatttcgccctcctcacttcttcaacaacttcactgaggcaattccattcggaaaggagcaacaggaagaggttgttaccaccaggaataggagcaactcccattaaaaagacagccattgttccccaggttttctgttgcctttcgacctcatccagaaagttctttcaccagaagagagctggtttgccccaagagccaaatgacaacatcttatgctggtgatttcttttaaactttttattaaatttcgaatatgattttaaattgtaatcactgactgaaaatattcctgtttttatgtcatgtatcttcttaacagtatcagaatagagctaaaacaaacgcataaatttttgtactactaattatttttctggtaagaaaaaaagctgaactaaaagattaaactaacaactttataactgctactctgaaaaaatatccttttgtgtttaaaaacatgaagtattaagtttcctttcagaatgtaagtttgattttcccccacagatataaggaagcatcatagcaagtcttcttcctgtttccagtaattcggaatggccattctcccaggtagagccacgcttatatcagatacaatttcttctccccatttttggtcttccattcatttctctttcactcttctaatttaagtgaaatggaattccaaatggccaagacactaataagctctctgaaagccatcttgagagcatatacatttttgtttttaaaaccatataaacaggctgggcacagtggctcacacgtgtaatcccagcactttggaaggccaaggtgggaggatcacttgaggccagaagtctgagactaaccccggcaacacggtgagacccccatctctacaaaaaatttaaaaattagctgggcatagtggcacatacctgtagtagtcccagctactcaggaggttgaggatcgcttaagcccaggagtttgaggttgcagtgagctatgatggtgccactgcactccagcctgggcaacagagcaagaccctgtggctatatccatccatccatccatccatccaaatcatataagggcaccgaaagcagtgctacacagggcattaaaaaaagctttcactgcctggtaagtgttgctccaaagtgatgtatcattcatgccagaaagagtaacttaaattaaaatgtattttaaagttgaatcttggttttgcaacaggatctagtgacgcaagcaacccacgatgatgtgctccatttgctatg

SEQ ID NO: 1698 - DNA, 20026 bp, Homo sapiens
atgccaggctatcccacgtacctttcccaaacaattcccaaacaacatggatgtggtatctgtgtgtcctcacaacttcattactgcacagaaatagtacctcaccaccaaaaaatcatgttcattggaactgttctcagaaaaaactccaatcataaggcaatgttttataatgagagtttatggatcagatattctgactaaattcaccaaaatgatttcagaaggaaaattactattatcttacagctgctattgtttcctctaaacttatactatgtcagacagaaaatccgactgcttgaaagaaggacccataaacggcaaggagacagggtatacactaatgacaacaaagctatgacaaaagtgaagtggcttccacatacacagtgtttcactatggcccaggccctgctgtaaactcctcacagggattagctcatttaaacctcacagcacaacaatccctcactattaatgccatcttacagagagtgaaacagaggcatgagtctcaaaaatggcagcacaaggataaaatcccatctggctgctgagtggatgttttggtccttatcctatctcagagaatgcattcaaacctaaaactatgccaggagtctaaatttaactcaaacaagctgaagaaaaccaaaacgtctcagatatcacaaagcagtgcatttattgcataatgttgcacaacaaggaaagtttctagaaagctgcccgaacttacatggttactaccaacatccaagcaaaagaaagtcccaaaggacaaagaacgtgtcccacatgtacacgatctggttcatctattcatatatccaggatgcagcctgtgctcagcgccctacttacaggaatctgagctttacgattagtatgattttagctgctaaaaatgtgacacctacctctaagtcatttggatttataaaaatcccaccatgctacaatcaagaaagcatttcactgagcaactgtaagccaggtacagggcatgagctgaagaatgtcccaggtgagtgaggccgttctaatttcaacacctaaagaacaggtcacatcagacgttataaattctccaattttcttttcttttttttcttttgagacggggtttcaccatgttgcccaggttggtcttgaactcctgacctcaagtgatctatccacctcggcctcccaacgtgctgggattacaggtgtgagccaccgcgcctgaccaattctccaattttcatgacattaatgatcacgttaggcttagggtcagctgtgccctaaagctctcacatcaatgttttatggatgtatgggcctaacactggtatacagatacccttggctatatccctcttactaatgccagagaacgggtgtttcttgccacagtgccactcctggctgtccagcacatgttcacaaggactaggaaaaagggatctctccctggcagtcagcttctcttttcacagtgttgaaaactctgtgagataatttccttaggcgtcctggtaacacctattagaaagtgtttatttaatatttattcccacaaataccaatgagagagagagtctcctactattcaacagttttttgttttttttttttaatcaagaaatagttgaaaaggatgggagtgaaggcactttaagcccacagatgccagcagaggtgggacatgacaagtgaggctggggggctggccccaaactggtccctcccaagtcagcttggacaccacacagcacttcgtgcgccctcggctggcttagcacatggacaaggcattgccgctggagtcccaccttcttagagactcctgaaaaggagctccacgccaccccccacacctcgccctgtgccactcttccacttgtcctgtccactctggacatagagccttcacggtaaaccagtaataggacgtcaactactttctggaattttgtgagcccaggtgagtgaggccgttctaatttcaacatctacagaagttatcaagtttcaggtttaataacctagcaagttatcagacctgaaagcaaggggcctggcaacaaactctcaacctttcaggcaagtcagacagaagtgtgggcaccccatacctgctactcgcatctgcagcaagggcagactcgtgggactgaaccctcatccctgtggagtctgtgctaactccaggtggtgagtgtcagaactgcactgaattgtaaggcccccagttggtgtctggagagttagagaactggttgttggtatggcaaaaccccacacatttggcgtcagaaatgttatgagtagcaacagttcagagtcctttatgtgcgtttacaaaagcaataatttatggcaaggacttatcagaactactttacgattttattttagtttcttttaaggaccaagattaaagatttaattagttaaacaagacaaccaaaacaaatacttcctcctgaccttgagttatcacagactgccacccaaggggcaactgaaacagaaagggtggcctgcatttcagaagggctggaggggacaacgggcagtgtgctctcaggtgctctgaatcacacacacacacacacaccatacacacacaggcacccttttggaacagacaattatgaaagcacattaaaacgcagcatgccatttggaagtctggtcttgctgctctgcccaaacacagggtacacacttcagggaaaacaatcctagagaaacagtagctctgtgaaaaatgagaaatgtaaaatgtttcggccaaacacaaagaaaaaaaaaatcagcgtgtgggatggggaggagaataagacctatcagaattctttttgcttagctggccaactctggcagcataaagtttaaatggaagtatcttcaaattaaatcgcacctgcatgtatataagactcccctgtaatgctccgataacacctcaagattgaggtcatctaaattcaaaccttaaatataaaaccactcccaaaagagaatgcctttgaatataatggcagtttcaaactttggcaaataattatcctgttcttcttatctgtgagaatctatcatttattttaaaaattctctgcagcggccgggagtggcggctcatgcctgtaatcccagcactttgggaggccaaggcaggaggatcacctgaggtcaggagttcaagaccagcctggccaacatggtgaaaccctgtctctactaaaaattcaaaaaattagccaggcgtggtggtgcacgcctgcagttccagctactcgggaggctgaggcagaattgcttgaactggggatgtggaggttgcagtgagccgagattgcacaattgcactccagcgaaactccatcttaaaaaacaataattatctgcagctccctgtatcttccagtaaacggattagcaggtattttctgagtgtccatgatgacggtcttagcactctccttcctgcctaaggagtcacaatcgcattcacaatcaaatgcaggtgctgtgtgtgcgctgctctcttcctcccatagccccgtttcactttctctggagtgcatccccatcctctcaaagcagaatcaacaagcaaaccactgtccttctttcaaaaaacaaaaacaaaaacaaaaacaaaagtcatgtgtttatttcttcccctctacttgtgcctcctaaattccttgccttagtcccaaatcagtcctccaaacgcgggttacttgtaacgttattcagaagtggaagattaccttgcaaaatggcagataatgccccaactagatatttcatggcattctaaaactacataaaagcaagatttcttaacattcctctaaataaataatagtgtaataaatatatgaaacaggctatgcatttcctcagtgttcttccattccctccagtgaccacacatgtgtactgcatggtgagcccatgactgaggaatagaaatacagtcatgaggcagctaacagcgtttcaaagatgaagtgcatatacgatagtggtcctgtaaggatagaatatagctagaaaattcctattgcctagtgacattgcaaccgtggtaagatgtacatgttcctcatatgtttgtggggatgctggtgcaaacaaacccgtgctgccagctgtataaaagtacagcacgtacaacagtgcacagtacataatatgtgataatgataataagtgactatgttattggtttatgtatttactatactttttatagttatttaagagtgtacaccttctacttattaaaaaagttaactgtggccaggcgccgtggctcatgcctgtaatcccagtgctttgggaggccgaggcgggtggatcacttaaggtcaggagtttgagatcagcctgggcaacatggtgaaacctcatccctactacaaacacaaaaattagtcaggcatggtggtgtgtgcgtctagtcccggctactcaggaggctgaggtaagaggatcgcttgagccttggcggtcgaggctgcagtgagctgtgattgcaccactgcactccagcctgggggacagagcaagaccctatctcataaataaataaataaataaataaataaataaataaataaataaaatgtaatattcactaagtgtagcctaagtgtacagtatttatccaggccttcacaattactcaccactgactcactgactcacccagagcaacttctggtcctgcaagcctgactcctagtaagtgccctatacaggtgtaccatttttttatcttttacactatattttttactgcaccttatctatgcttagattcagaaatacttaccactgtgttaccattgcctacagcgttcagaacagcaacatgctccacgggtttgcagcctacgagcaacaggctataccatggaccctaggtgtgtagtaggctgtatcaactaagtttgtgaaagtacgctgtatgatgctggcataatgataaaatccaattacctaacaatgcatttctcagaacatatccctgtcattaagcaacatatgactgtctattactgagatctgtacatttttaattaccttcatgttactgaatccagctttaaaaaaacagcaggaaaccattttttcactgtgtttcaagtcagctacaatttaaatatcattagttcggtgtcaacctaaaatggaaacaattaccagtagaacattacatattacgtttacttttcatttttggtagcacaattcctatctaggaaaacataataagtttcctgtaggaaaagtaagataaaggaattaagaattcttaggggtctcactcacttaagaccgctaatatatgagaaaaaatatcttgtgctttgagaagtaagcttcaattacctgggaaatcaactcaagcaaaaaactctttcaatgatgctagacaaataaaatgcacaggtagatgtttgcacgtccacagaaattgcagccacaatcagatgcattcttcagatgtgaattcgtgcatacaagcaacccctgtctttcgcagagttaagttcaaatcctgtacacactttgttccacaaaattgctgttggcttgcatctcttttgtcacctttctccatccttaagtcctccaaggttctctcagggccaagactgtagggttcaatgaccttccctggtcagctgtaaaactagggctagcaccttcagaatccgccagccacaccctgctccagctcaccaccatgagttttctctcatcagcctccaaagtccaagccatcgctacatctcagagatgacgtacaacatgtgcctttattttatactctcaagatgctggatatagtagttattatccagaaagaatgacttcacaatcaggatccgagactggctataaacagtgatcgaatcctcaactcattccctctcgcacctacaggaaggtattaacaactgatcctccctttcatttttagagtaacaaacccagcttgtactacccatgcctacaacagcccagatgtggcactcaaggttgaaaaggggccayaacttggtaacgggacacacatgaccccatgcaggagaacagccagggccatgaggaaagggactttggtgcacaatggcaggtacctatgcccttgctgggacatggggcatcagggtcattaccagatgggtttacaaaacaccaaaacacggacagcaaaagtaagatgctcagtccattggcttgcagtgtttcagagtccctgcttgctgctagccacggggatgggggctgggagtcatcctgtttaaaagctgcagtgaaaacccagtgtggtcgtctctgttctcaatgtctaccttggaagagggagttcttaacctctgtggcagagcaacctgaaaacagaattatactccatayacatagctacaatgcctcatgcagaatgctcttcccaaaacygtgctcaaggatacaaacccaggctgtccaatttggggaaatcattgtttgagggtggcacagacaagcagtcggcttggggtttgctccctgtgcacagctcgatcatcaaggaaaggcctcttccgggcctcaaagctccctttgtgaggaatgaggcccactgtcgaggctcacacaggcagctgtaaycaggctgcccctctctctgggtgtttgttttgatagaggttcatttatgccagagacaatgcccgctctctttgttctgcccccagcaggaagcagtgcagggagggggaccagcattgtcacacagcttccaattcaggttttggtggccacaacaatggggcctcaagggccacaaataaagagccgctcacggggagcagggcagagagactggcacatgtggaccccagcacaccccaggtagaagtcacctcctaacaagtgctcaggctcactatcaagggctttgagggctctgaggttggggagagggaggccacctcctcttctcttaagtggtgctgggagggagaagtaagcaaggtccccggggatgacaaagccttcctacctctcctaccatttatcccaactaaaggagcaaacactcaaaaaagcaagcaaaaagaatgcacacacatgcttcgtgttctaacttaccaacagttgcacaaggaagaaaaaaagtctaatctgaattgccaaaaatgaacaatatcctttaaaatgaagcctgggctagatggctgcaagtgaatgaaatgtattacccaactgctgctgtaacacaagccctctcctcccccttctgggcctcattcataaaaagcctgcttcgccccagcagctgcaggaactgggactggatttgtgttttgtgccggtgttttccaagacagagggaaacaattgaaacagacaatcgctcagataccaacaccaagttcgcctccccttgagaagtttgctgcagtctcctggtctaatccaaataggyggagggagggctgggagggcatcctgcagagctgttcagtggcggttctaacgctaacacccagcgtgttattaaaggaattcccatctgctgagtcacactccgtatctttcactccctgacattttatttttttttaatcaaaggttgttctttgttggtaaaacgggggttgccaagttaattaaagattgccaaattggggtagagatagcaacacaactcccaaagaggtaattttttcattgtccacttttaaatggatattaccatctacagactttatgcagcctgctagaaatcttatgagataaggaacaacttcaattcttaatatatttttctaatttatgaataaaccaacaaccaacatgcttcatccaggcaggatgaagcactgtctccctcgcccacacccttttccacagctgccctcccagcccagcatcttttatcacctagaagggccaaggaggctggtttgtgcaactcaacaagctctgtaaaacaccaagtccctagaaatctcagaaatcaccatgagaaacgagaggctaccaaactttttagactcagcagccttcttcaaagcagggcccaaatacaagagcatgttctaatttaccaggaatggttttaatacaagaattacataagaacagagtgcaggaaaggaagggagaaataaaaccattcttgttgccctaataccagagcagtcttccggtgaattgatacataaattctctccagagacaagataatccaagctattaactgttcccctctcaactcttgcaaaacacaaggcttcgaaaccttgaaggggggcaggtggaggggaaagcctgctatatatttctagaaaataccaaatttaacaccacgatcccagcctgctcatcactgctggggatcagccattctgggaaggtaacagcagccctcagcactcccctccgctaagtaaacactcctttctaccacactcggtcccccatgccggccgcctcccacctctgcctgtggactgacagccgaggaaacaagaaaacaagctggagataccaaatgaatcttgcgaaatacatggtctgtgattaaatcacaataactctaacctcctcaaaggcaaacatatcaagatagcaagctgagagcaaaataagcaagtcttaacagaaattatgccaagctttataaagggattacccacacctcctagaggctgtgcagcctggaatccagggtggtttgggttttttttttttaaacttactgcagcccttctagctatccaatgaaagctcttacaaagaaaccttcaggtctgcagttctctgtgggttttctatgaatatgaacgtactttacgggtggagaaaacatatccatgatcatgtttgaggggctcacgaaagggggaggcacatgaattataccatgaatacagatataatgaatacagatttagtgagattttaatacctcaatattctctggtcccactcttaaacatcgcccttcaaccatcaaaacatcttaaatcctggggtaggggcatagttacccaaagttgtggtaccttccctaaagaaaactgaaatacataccaggacacacataattctgtcaagtttgtccctaactgtgtgatcttggacaagttagctaacctctctgtgcctcagtttcttcatttataacatggctctaatagcagaacgaacccttgagaggctgttgcaacagctggtacacagtaagtgctcaataaatattcgttgctgttattaacattgtccctatgccatctcaccccccatataagctctctgctaactttccaacacagagaacaaaatccaaattcttcaccatggctccagggccmatgtgatctaatagccctctctgcctgtcactcaccaggctccagccacccaacctcatctcatcctcctcactggacatcccacgtgcatcctgtgtgcaccagacagtcttgctggtgcttccagactctgactacttctctccactgaccatctccaccatcctggtctaaggttcatcttctctgccctacactggggcaacagcctactcctactggtctctctacttctgtccttgcccttacagtctctcttaacgcagctgccagcatggtcctgttaacgtacacaccagctccaaactctgccatctcctttcagagtcaaagccgaagtcctcaccgtggcctccagggccctacataactgactcagtttaccccatcccccaccaagatgcaccaagctctccaagctcctcgcctttcccytccctttcctttaggtcttcgtccaaatgtcacctctctagagaccttctctgaataccctacgtaaaaaggtacccggatacctgcctggcaccacgtaccctgtaccccacacctaacatgtgacccagccctcccatccccttccctactttaataaaagctccacagaggcagaggcctcattttgtccacttctataaccctgacaccaggaacagtgcctggcacacagcaggtgctcaataatatttgtggagcgaataatcgatgccatcatggagatctttccctcgctggggcctaccacctcatgttcctctccacgtcttctcatggctgattcacagtggcagggcaaatgtcccctcttcagaaaggccttctatgagaatccaacttaaaagtctccatcacaatcagtgagtctgtatttttttcatagcacttaccactgtctgacattattttctgtctacttgtttgttgtctgtttctaccactagaatgtttccatttgttttccatttggagaatggagttggctttgtctctgtaaccccaagtagctacgtcagcacaacagaatgctcagtccgtatttgttgaataaatggcaatgtatatactgacattctttaaaaactaaaagcacacatccagaagaggaaccgggagggctctgtcttaccccagatgacacataccctgcaggtgcatgtgcatggaatgccttgggcacctgaaaacaccaccccgctcccccaaccccaaatgaagagctctccatctgacctgggagaagcactcagaacctagacatggctccgacgcaaagaaaaacaatttgaagttactaaataacagcccaacatctgtcaccacatatgaacaactctatgcacaggtaacggtccactcgccatgctcactgtccaaacacccgggcatcaggtttaccttccccctgagtgggctttcgagcagtcatcacagctgcctgggagacacagctctaaaacggggctcgggctgcagcccaggggccaacactgagctcccaaagctttggatgcatttcctactcagcatggacatcaggtgacttccttaagaggaaaaatcaccccgcaagactgctgagaaagcaggtgtggcatttatcagtgctgctgtcatccatagagaagccaggaacaacgaaatgtaactctgtgtacacagaactctgccaccccacacagrgcagatggggcagccatcagaaatgcggggcatggacccaaacgccagcatagcaccacacccccaaatgaggggggaacaggctcagcaccccaagacatccaagcaccatggcttttacagctagatgcactctccacaagccaacaggagtcgcgagtgagagccttcgaacacatccagtgtgaacatgcattcagcaaacatttcctgagccctgctttgtgccaggctgttctcagtgctcaggatacacaaggaagaaataaataaaarataaggtttctgtccttgtaaagcttatattcgtgtccgtgtgtgcatgcctgtgtgtatgtataagaatacattcaatagacacaattattaagtaaattaagtcatatgttagaaaataagtgctgtggcaaaatccagattaaaatcaccaatcactagtcaggagaccccatcagctacgsaaagaccatacaggtagtgtgcagagacaccagagaggtcaccctgtttgatcgacaaaagtatgctcattagaaggtaaaccacaggactatggggtctttatctcttttytccctgcaggattctcagctcaagaagagcacctggcacaggtcagggactcagaagcatttgttgaagaaatggaagtgctcacccactgagttcttgcttctgcagcattcctggcaggtmaccctctcgagttggctgaaatctttccaagaatgaaaagctgggcttttacaacaaactaacaagcaaaccccaaccaaccacccccacacacccccaggcgcctttactgtattactttctggaccctctgagacacacacagtctactactaacgccagcacatgctgtgatgggattcccccagcagtgcccacacgatgctgggcccacacagcctgtgacacctgctggccacttcgctcccayggagaagcctctttcacgttcatatgtgctggggatctgtgtctgctgagagctgagctgcctgcctgggatcagccagatggagcaggcagagayggcacggaccacactccagaggaacacgccatggatggctrtaytgttgatgtttcagatatccaaaaagtaaattataaatcttagcggtgatttagctatcctatttgccaaaggtagtttacacgggtgtttcaaattacttggtaagaaggcacaggtgacacgaagggaccacccacaaatatctggcatgttccagtcgcatgcatggcatgtcgcatgtggtgcgacagttctcaggaaacagcatttgtaaaaacatgcttattaaaaaattagagagattttctataagaaacacataataggcgcagtggctcatgactgtaatcccagcacgttgggaggccgagacaggtggatcacgaggtcaggagatcaagaccatcctggctaacacagtgaaaccctgtctctactaaaaatacaaaaaaaattagccaggggtggttgcgggtgcctgcagtcccagctgctcgggaggctgaggcaggagaatggcatgaacccaggaggcggagcttgcagtgagccgagatcatgccactgcactccagcctgggcaacagagtgagactccatctcaaaacaaaacaaaacaaaacaaaacaaaaaacaagaaagaaacacataataatgctaatctaatcatttgtgtatttttaagtttttaacttactgatacatgtcaatgtgttaagaccaaaaaaatacatgaatttaatttaagtctagacggcaaagtcaaattaatgtagtatacaattttcttaataaacttttcctttcctaccctctttcgccccattttgaactttaaagaaaaatttgcctttttgctgcttcctaaacaatctatgactgctacaatagtcaatctttattttcccacttagtttgcttatggatgtgagggttaaatgttatgaacataatttagtgcttacaacatcagcaaatctggcttcttccttgagctgatacacagtgaggttaaggtcagggaaacatccgtgccttctggtccaagctgagagcattgctaaggtaagcaatcaaagctgggaaggctggggttggggaggtgtcaaggatgacacaatacaaatgctaaagtctacaaaacaaggttgaagactcaagtccacagcagcagtggttaaggggcgggggattcttgcttgaagacgacaccaggcacattttccagttggagagcttgtagtgaattcagatcacttggtatttcaagtgtttcccaaactactgtagatgaagggctctgaaattattccattttgaaactcattactgattttgttacaaccaaatagcagcaaacatttgtacagcagtttccagtagttgtacataaaaatgctttggaacacattacttgggaaatggaactttacacagacaaatcagaatgccacttacctaatggagacagtttgcttactaattaattctcaagtccattttgtaaataaaaacagaaatggggccatcctggagaatcatgatgctgttaactgagctacatggaaggcgcagttttcctcctcttatcactggtcttttccttctcacactmagcaatctgagcaccacggggggcaacacctgctctctaatacagaagagatgggtgtatacctccattctaatacagaatgtctccatatacccagccatttctagggaaaatcatctctgacagctggcatgaaatcaatgtccacctgaaaagtacctttgagggccatctaataaaggccaaaactatgsccacgaatccaaaactgcggaagtctagactggcgtttctaaataagctagagaaaaatactcaatgtgcgacatcttgtaaactcacagctgctgaagaacagtgtctttcagtcacatagctgaactgaatgcagaggacactgccatttgtgaccaacatttcctttctagggaggaatacccaggacacttgttacggctgctacctaagtgctaagatagggcgcttcgccactgtgccccctgcttcatctcaaaaactaaaattttccatcaaaaattgccctcattttgtgcctttttgcaaaagtgaagctatctaaattctagcaaaggaacgaacacaggtatttcagaataccccacctttaagggtctcaaagattccagggtgttccctcttaggatggagttttatcttggctgaaataaaagggtcttaataaagtctttttcctgcagacctctgggtataaattatagattcatgtcaaaacagtgaaagggatttgaggcaaaagatatttctttcataaaatattatgcatcagagtatacgttctatgctataaatatttagcaagggataatgtgacatatttactaatatttctgtcaaaataacaacatctaaactgtcacttcaacaaggaagcttctcttcctgttttagtatagagaagcactaggatatcgtctcttttccttttaaagaaaaatgtattctgactgctggtaaaatcaggagtaacttgagtctgtgacttaaagggcagaactaagccctatactacagtgataacagtaacaggaacatctgattacagataagctggctcctcataaaccctgatacaacctaaggcctccattttcattacacaccttcaaagatgcttttaaaatggacttgtttattgacaacacaagattttttttaagtacttgttttccttttctaaaggggagacttcttgctatttgctaattttcacatctgtcaatgctgacaacaactggatctgttgaataaacatttattccttttgacaaagaaccttcacataaaattgaactcaatggaactttatgatcggggcaagagaatttggagcaacttcacagattagtaatatctaacagtggccaggccctggaggttctcttgcagtgaccctggggaatggaccagtctttgtatcagcagaggacagaccagagcttttcaggaggaagaaaaaaaacaacccaacaaatcaatacagcaatatacaatggtagacaaagctacacgcgtttacagagtttcagcgcatagaaacatccagttcagaagcctgttaaacttacatctgtatttggaatctcatgggaggcaacccctggcaaaatatcaactcttattgaaccaaaacaaaatctgtgtaggcacagagtatcagtacaaaatatccaaaaacaaaagctcacttttccaaaagaaaaacgctaagttcaaggaagcagccaataagtaagagaagtttgggcttttgaccttcccaccctcccatgccacctaggaatattcatttttaaaagactgaagttaaaatatataatacatatatgaaaagatcccctaatttgggccagccataatcatcttaaaatggtaacctgggtaacaactacctatcataatttatcctttgaagataaccacagattcatggttttgattttaaaagcttctttccaaacaaataaataggtatcaaatcaaaaggcacactttaaaaataggaagattttgctaatttgtcttcatttgcaaagatgaatcttactctgaaacctcatttgagagtgctctagtctctcaggatgcatagaaatgccttataaatgctaagtcatataataatggttatgtatttgggtgttagtcatctgctcttcttgctgagataaatagctaccatctgaaggtgaacacttcaccttccctacatttacaatactctaccatcaaactttcatttagattagcaaataaatgggagttgataagagagctgtcaggcatacctaacaaacctgaaacctaagtgttaggaaagttattctgactcaagtattctacatacaatgaatttggggaccttatagggtaatagggaaggaaaaaagatttttctcttaactagctgctgggccccacaaacagggagaattgtctaaacctgagccaccattctgatcctcaaaccctgccaggtgaggacctatagctagattgtgtactggaggatattagagcagattgctcctctgccaacttctctccttccttcttctatttcttccctttcaaaccagaccactgaaactctcagtctgtatttatgtgaaataacaggaacgttaaacatgctaccttctatttgtacagaattgccatgcaacacaaagaatgattatgcattagctacgtcacatttacctgtgaaatttatctcattgtagcactataactctatttactaaaatatgttcatccttcgatcacatagtattttcaccaacttaaaattttaaacggaatcagaaaatatacagcctttcctaatggcctccttaggttttcaagcttctccccaccttctactttttttcagatggtataaggacttttcatctgtgataccaatgggtacttttggttggaaaatcttcctctgacacagtccacaagtcacacattacacacctaagtggtcacaaacaggattttaatctatgtgaacagatcaccaatcttggtttcatccttttatgagtaaaatgtcataaaaaaataaactccttaatacatgtaataagttacaagtgaagtaaaaactaaatattagaggaaaagatacaaataagttagttgttgcttttttaagtttttcaagatacagaatatcattacagctgttgcatttgaaagatgatgcaacagacaagggcaaccacacccccaagatctttgcagctccacaagaataggatttagacccttaaagaatatgtcttaacatttatcagtcaataatgtattaggcatttttaagtaatttctaaccaacaacccatcatcatcactgaatcatctgagcatgaactaagctatgcaaacttctttaaagaaagtctgggacaagcttcaatctaatgaaggcttaggaacagctttactttgtgaacaactacagcttgctggagaagaggcatctcacaatagcacaaaagaacacaaaaaagaaagtgatctttttgattaaccaacgtcactttctgctttgttttaggcattataaggtaaatgaactaaaggtaatcaaatgatgaagttcttcctgccctaaatgaatgtgtgtttagtccatttacctactgagtcaacatggaaagaaaaataagaaagaaaactaaattttgtaagacagtagaagttttaatacatactcagttctaatgccgttaattttgttttccttccgatttccttaagggaagactctggttgagtctttctctgctttccacatagcccctcgaggcacagagacagaagggtctgctgtgggaagagaccatggagcaggtgcagtggcccctctgaggataaaaacaacacgcccagaggctacaaagccagctagtgacccagccttcaccgctcccagactccatctcccctgctcccccgctataccacaggacctttgcaagtgcaaactgcatttgagataagcttccccagacatgctttcatgaggagcttatggcgttttctgtgctcacaagcagggtctggcactgccctaccaagggaatgatcacttgtaagaagagggaggacaaaactatccctgatggctctttcacatgtttcttttaaataaaaagagtgatgatctttctaggcaaggacacaagttgcccaggccaccccctttcccttcaaacacccatacccacctcatatggcacatatagtaccccaaaatgccagataagctgggccacctcacacactgcaatgaccaagcccatctcctccattgtcctcatccttccttcgaaatcacctgtcccggcctctttccaaacccaagtggaacagagccacttgaacagagcttccttcacagaaatcctccggaggcaaaatcctagagcacaaactacatagaaactgaacagttaatgtacatttcctttggctaagtcacagacactaaatgttggcagacagagtacatctgaagcaaatcagggccattttcagggcagagacttgcttttattctctgagctccagcaacccgcctctctgacttcttcctcccatggtgcttttccacccagataactcgcccccaaagctgaggaccctcccaaggccatgaaaggggcctgggttcacctccactgtcacagagtttaagaacacatgccctgtatagcctattttgtttgcttgtttctttattaaactataagagcatcatccaatttgaaatgcccctcctccaaagaaaaagctgcgtggcccaatgttaaaggtctacatcagaagtcactgttgcacatcattataattaagaaatggcatatcaccttctttgtaaggtataacattttcaatgttgcaatataagctgaccacctcctctaaggcgaggactcggcgtcaggggcagggaagtggtgagcaaagaaagggcaaaaacaagaccttgatcacagaagcaagaatctgacattggattatttttgaaacatactacatacataaggaaaatgatgatgctataaattaaagttgtggttttctacattttaaaaaaaggctagccagccgaccttatcatccctgtcattccaatgggaaaaagcgtcatcagcacaattgtagaagcctagaacaatgtgtccctgtcaactcagtgagggttttcttctttcaaagataaatcaagatgccataacctaggaataatataactacttacacacagagaacaaagttggcaatcacgatctgagttaagtttaaggtatgtttgtctttccattttacaagaaggtaaatgaacaggaaagtgagctggaacaagtaaactgagccataagcctacgtgtgcttttttgtagaagcacagtctaaatacacacacgcaagccactgcaaaatgactttctaagttaaaagtcagagaaatcaatgtttgactgactatggagcatacaaattcttcatttgctttcatcagctgaaaaaaaaatgctagaaataactacggagaaatggtaaagaaaaaaatgtaatgtacacagttttgctgaaaaccatgaagataccagcagaagaaaaaagaaaatgaagacgacaaatgtatttcacacaaagatgaccggggctgtttctgcacagcctccacctggagctgaatcaccggccagaacagggattaggacaggcctcactggcctcccagagctgtcagacctcagcagggcgggcgcatccttgggtagcccaatcaaggctgagcagtatagaccgtttgcaaacttgcgcaaactgtgaagttatttacatgcattcagggaaaagactcccccaaacagggaagcttctaccaaacaaatgccttaaaaattattttatgaaagagatgtctgttatgtgtaaacagacactaattgttgctgcaccttgggtaagtgacagggctcagagaacaggaaggaagcctgtgacttagcagacaacaggacagttcttccctttgaccttccactggtcccagattatgactcagagactgtctcccactctttacccaaggggagatccctgcacctcctcctccaacatcctacatctttaaaatgctcctctgaatcccagaactacagaaaccacagcactcgtgctggtgagcagattcctaattgcagaagatgcatacaacttgatgctttcagattagagtctacccattcctaccatgcatttgttcctacacaatagcatacgggcatgtgtaggaggtcaccccacattctttattaactt

SEQ ID NO: 1699 - DNA, 13082 bp, Homo sapiens
atgagaggcattctctgtgagcactgaatcctcagtgatacttgtagtctggacacaccagctaagggctctctgcctgagtcccctcaaggttggatgcagatgtgagcacacccaggagtctgcacttgccaacctctctctctgaaaccttgtctgtccaaggttatcctgaacctcttggccccatttccccatagacaagcaacttgacccctgagcacctccccttatttactgtgtccatgttcctggagagagaatagacctggtggatagcaacctatcctataggaggtgagtttgattctccagctgtgatagaaggacactaggccgtggcaggagccccacatgctgtctcagagtctggttccataaagagaaagtcccctaggaattgttccctgagccagaccctccaggaatagcagctctgctcttacctggagtggccctgctctggaccacagatatgagcagcaccatcagtaatgctgtcagagccactgtccaggggccccctgaaacctgcaggatcatcatggagttggaaaaggttggcagaatgaagagagctgcagtcaggaaaacaagaactcattaaagggagctcctgtctgaaatattagagaccatgaacccaagcagtcttctgtgaccctaggattggacagactctgagaaaagaaccaatgggcactgagctttgtatgagtcattgctcactgggcagaaagttagtattaaagatctgacaatatagagccagtgatgctgttacgaggacagatggagaacactgacactcattttaaccagtcagagtcatgagttttggggagatgatgtgttttctttgctctgaaggtgatctcagatattctgctggcccacctacagggattatcatttccccaattctgccacacctcacacacccacaggacatggcctggtgtggaagaaatgctatctcaatgtgtaaaaggtcattcagtggcatgatttagagagattagagtatccatcccagaactgaaaatgaggcctggagtctgttttgcctttgttcaaggccgtgcttcagattagtgcacattcatattttcttcctcccacatgtctgtgagtcctgagatgtgcgggggatactggctccttccataggactgtcatcagggtcagcagggctcagtctaggggccttacacctgggagcatggacacaccacctacactaccatggaagtatgcagcttgaaggacactgcctgtcttggacttcagttctttgtcttcagtatggggatgatatgacctgcctttacagcagggctcttaaggtcaaattagatcaacggatctgtaattgctttggaaaaatgagactaaaaattatacagtgaatgaggaagaaatgaaaaaatgtcataaaagaccctacattttccaaaacatctgattctgtggtgtttatactgaatagtttcataaactttcaaagaatattactccttaatttaaagacctataaatgtgatcctgtacgacctcctaatctaataaagaaaatgtaaaagtggcatcatttgtttatataaatgttaaaatgtaaatagaagactagcatgtaaaattcaagagaagaaaataattatgcagtagaaggggccagtataggattgcggggaaaaagctcacgttccctgccatagtcaccaagacagcatggtactggtataaaaataggcacatagacaaagggaacagaatagagaacccagggataaacccaaatacttacagccaactgatcttcgacaaagcgaacaaaaacatatggtggggaaagacacccttttcaacaaatggtgctgggataattggctatccacatgtaggagaatgaaaccgggtcctcatctctcaccttatacaaaaatcaactcaagatggattaaggacttaaacctgagacctgagactataaaagctctagaagatcacattggaaaaacccttctagacattggcttaggcagggatttcatggccaagaacccaaaagcaaattcaataaaaacaaagataaatagttgagacttaattaaactaaagagcttttgcacggcaaaaggaaccatcagcagaataaacagacaacccacagagtagtcacaatctatacatctgacaaaggactaatatccagaatctacaatgaacacaggcaaatcagtaagaaaaaacaaacaaccccatcaaaaagtgggctaaggacatgcatagacaattctcaaaagaagatatacaaatggccaagaaacataagaaaatgctcaacatcactaatgatcagggaaatgcaaatcaaaaccacaatgtgataccaccttactcctgcaagaatggccatgataaaaaaataaaaaaacagtagatattggtgtggatgtggtgatcagggaactcttctaccctgctggtgggaatgtaaactagtacagccactgtggaaaacagtgaggagattccttaaagaactaaaagtggaactataatttgatccaacaatcccactactgggcatctacccagaggaaaataagtcattatatgaaaaagatatttgcacatacgtgtttatagcagcacaattcacaatcacaaatcatggaaccaacccaaatgcccatcaatcaacgagtgggtaaagaaactgtgatatatatatgatggaatactactcagccgtaaaaaggaatgagttaatggcatttgcagcgacctggatgagattggagaccattattctaagtgaactaactcaggaatggaaaactaaacatatattctcactgatatgtgggagctaagctaagaggatgaaaaggcataagaatgatacaatggactttggggacctgagaggaaaggtgggagggggcaagggatactgctcaggtgataggtgcaccaaaatctcacaaatcatcactaaagaacttactcatgtaaccaaatactacctgtaccactataacctacgggggaaaaaagcaacataaccatgaaccaactaataaaaaacaaccttgccttcagtctgcatcctaccctagagacactctctctgtgtcctcacacttggagctaagcttctgacttttgtctccagtacacccctgaggatcctctcatcacggccatcagaaacctctgtagaaggtcaaatccagtgggttcttgtcagtgcctctgacttgagttactgataatatttgcaccataatccacttctttctaatgagctactctgtccttatttttctcctatttactgaatcctccttatcatcctttgaaatctcctcttaattattatgttctctcatcataccctgagatccctgcatttctgatttttggcactcttcctggaaaagctcatctaacctgcacctatgcttgatgactctcagttctctggcttaaactcctctactgagaccacccatcatacaaaaatgtttacatattatttttccttagataacttttagacattctaagtgcaatagccccacactgaactcagtctcttctctcagtcaggctgtcttctctcattaccctttttaatgaatggaatcaagatgtttgcattgggttggggagatgttggtcaaaggatacatccatttcatttcatttaggatacatttcaaaagatacatttcatttagattggaggaataattttaagagttttattgtataacatggactatagttgctaacaatgtattgttgaaaattgctaaaagggtggattttaagtgttctcaccacaaaaaataagtatgtgaggtgagccataagttctttagcttgatgtagccggtccatgatgtacatacatttcaaaacaacatattatacatgataaatataaataatttttgtcaatcaaaataatttagaaaagtgacacacacttacacacacacacacaaaagagatgattgcattggccagtctaggaataagagttatctgggagttttctaagtcggatgccaccgacatcactcaccaataatccctttaatgtcaatcaaattaagtcctcttcttccatcattttactcctatgcccatttcctcactctttgttcaggcactattagtcttgcctcttgaaccaacttctttcactcatgctgcccactgttgccgtagtgatcttcctaaattgcaaatgcgccatcactctcctgcttaaaatccttcaatgattccttatgacttccaggacagagtagccactcctgagctttgcatgtaacatctgtcatgatccagcccctgcctgtctatttttccttttttcttgctgctgttccacatccaaagctggctccattcatactgaagcagctgaagttcttcagatatgtcattgccacactgggcccacacttttgaacctgcttcctcctgtgtgagaagtggcttctgccctgttttcggactgcctacattgaagccatctgttccccaggaaaccttccctgatgccttgacagcagcatcttgtgcctgccccatatctgcacttatccatctgggcctgctgttgtcttgtcacttgtgttctcttctgtgaactgtaaacatcaggaggacaagacctatgtcttacttttatttgaatatttagcatctaacaatgttcgacatatagtaggcttttgatactatttttttactatgacattgtagtatatgttaatatccagtaggacataggatatattctctctgttttcaatttttcattgtttacacacatttataattctatctataaggatttacaattatttacatgaaatgaatgaaataaatagagaatgttagatattaagagacagtgtggaaagccaggctgggactagggatgcacttaccttaggtgcaaaatttaggaggataccaaaagaactcagtaataaaagtcaatcatattttaatgaaatatcttaagaaatctaaattaatggaaaatatataatgaacaaaatgtcaaaagagaactattcaaagaaaatggagaagcagagaggcagaagaattagtagaatatactggcacataagccaaggaggtaaagatttccaggaaggaggaagtagagtggagtcagaagttcaacagaagtcatttcagaaatcttaccttggttttgaaatcctttcagagagcagttttacataatgtgagcaattatttctccttcatccccatcattccagaattgagcttcttctctggcttcagaaatgtggcccttccccttgtcaggatatgttggcgacatgatgcatgcggatgccctcaaagtcagctggggtttgggggtgaaattaattgactttagggaactccttgaatgctaagttctgttcacctggaggaccagagagggcacagagatgaccacctagcttctgcctgggacctaaacagggcagagaaataggaggatcaggtataaagggagcagggaagatgggtctgggcttacagtactgaacccagggatgacagtaactgtgtgtgtctcgaggcaggtgacaaaatatgtgaaaggaagaggacttaggagagatctgaattccagctgttttacaagctatatctcagctttctttctcaattcatgtgctctctaccccaaaggctgatggaattgctgacccttcaagttctcttctcatctgcaccccttccctcctgctgcacactgttcagcgacatcacacacttctccagcctcctctcttcctagtcttaccccttcccagtttccataactgaactgtcctgttgaggagttcttagcagccctctgtgaccacaagtgcaagttgcactcccttctgagacaaagtcccccatttattccctcctgagggcgtgtcccttcccctgaccctcatggactctcccaggtgcaccccctgtggatttgctcctgggcctgagtttcccctacttccctgatggtgtctggagggcaaggggtatctgtctatctactgagtgtcataaactgcccaactcagcacacccaccctctacctcttcctaagtgtagtgacacggtgagggaggtaatggggtggggtctggaatcagacaccaggaggaaaggggtggtggctctctttgcctctcactctgtgtgtatttctctcgggtaccaggaggatttcctaaagatttctttctcctgactgttttctggacccgtcctggtctccaagctcccctcctgattctctgcagtgcccaggtgtccaacagttgagcctggagccaggccaacttgtcagcttcctgtatgaggatcagactggacgacttcaacctgcttagcccgtcttctgaggcctcaccctagtagttggcaagtaagtctatttgctcctctggtctgcctggcccacacttttgtgagaaagtgccctagaacctgtacgctctaaactgtgaaaccctgttccttcttttggccacaacacacctacgcactgcccaaagttcagtcacttctagcccagagtttgggcttagagtgcatccttctctgcaagttgtgttagcctgtaccttgggcaagttacttaaattttttgagcctcagtttctacatcttaggatggacagtaaatagaattggcacaaacaagtgagaaagtgatggcacagtgtttgttgcactgtaagcacttgataaatggcagctattgtgattactgctctcatcgtcattggtttcaactttcatcaacagatctccaaccctgttgacgcccctgcttcagtcagtcacttgaacctctcactccatgaccaggtggcaccttgtggctatggccatgaagggccagtctgtcaccctcattgttgactgcaagatgtgagtcacccggcctctcccctgaagaactagtccagtgttggacacctgtggggtgataattgttggtgcctgtatcccagatgaagaaagtctttgaggttaccacaaaaatcagagaaaggagtgacttctggtcccttattttgtgcccactcctcttctggccccagtatgcaatgttcctatttcctaagccttcattttttttcttgtgaattttgatttgcatttcctatcttcaggactgctgatctctgcagaataactagatgtccacttatgtggcaggactgtccacagccacttattctatccttcagtcttcatctytccatctatccatcccttgaacctatctctctcctcatccaccccatccatycactcattcaccagtccacctaygcacacatccaccacccactcccgcaaccatttacccacctatgcatcacaaacttacccatctactcatgcatgaaggcttatatccactcacctgtccatcctccccctgcttaaygactctccccttctttacacacatctattcgactatgcttttgttcatctgtcctcttcaacttatccatccatctattcactcacccacccactcacacaccccatctacccatgcatacaaggatgcatgcatctgttcagccacccatctatccattatccttcctggaactcaaccactctctccttcaatacactcatgcacccatctcctcacccactcacttcacatccaaccgttcaytcaaccaygtattcaattccacccatctatctattcactcatctgattccatctactctgtacctcccgctcatctacccactaagccttgcatgcataattccctctgcaggagtcccattgtacctgttttgtgcctttcttttcactctgggtcatggtagccatattgttgaaggttcacttcccagatcctcttttcttggctgcttcctgtckgtacagcyrcttcctgtttgtccagtttgttttgtggccatcttggccatgtttaattttccttggccctggcatcactcttgcatccaagtgtttgtcattttattttgtgtcccttagttgttctmatatcttccagtattctctgtcagttggactgcttcctgtctactctgctacatcttctgcctgccttgcagttatggctgccttttctaccctgctgctgcatcccacacctcctgctcttggcacccgygagcttctgctgcctttcctttatgctgctgtctgggtctttggggttgatgtgggatmtgggagaattttgaaayggatcattgctgtcaggatgaaggtggagaggggcattctgaagatctttgttttggggagttggggtggtggtgaatgtttcaccttctccccacccttatcttgsctatggcctggatttgggaacaggcatctgaatggaggtgtgcaagggagggaactggttggcttggagtgtacatgagggccagaagaagggcaaagcatcctgctgggagaggaactgtggggtgyattgtagggggctgctctggrgcttggataactgagcccaagaactrtatgttttgcaaaaggcagttatgaggcctgagtttggaatatctctgggaaatgctctccaaatttmcttggagtatggatacttaacctgtgcagggtttttacatttttgaactccttcaaattctaaataaaattttgtgcataagggcatataccttttcttttttggagaaagactgaaagactcaaagtcctctttctgaaagaggctcttcaggatttggagaggttgtgtttsctgaggtgggactgrgaactggggtgcagggaaccctgagatctccttggcaggcatgagagttttgtgaacagaagtatttagaggaagcctgtggggcttgtgggtagggctggtctggtctccagaggacccaaaatcgaggttggagttgagatkggggcaggcctggtgtcctggctgctcatgggccccactggggttacatgtgtgtctccctyaggctgcccatgggccccggggkctgaagggaragaagagagagcctgcagtgctggaacctgtaagtyatgctggtcacagggctgaggtggtggaaagaggagaagcaagtggggtttagtgtgctggccctgtcacctgtgagttttaacctttgactccacagggtatgctcktgraggggmcccctggtttagaaggccctgtggtgagtctagcagtgacctggtggccattgttttcttagagatccctcctatgtgttcatctgtgccttccccacatatgctcaggcctcctcctcagaactccggagggtccttccaataaaagttttttaaaaaatcatttygaaaaattaattcaatagtttttggggagcaggtggtgtttggttatatggataagttctttagtggtgatttctgaggttttggtgcrcccatcacctgasgaatgtacactgtatccagtgtgtagtcttttatcccttacccagctcctactcatacctggaagtcctcaaagtccattatataattcttatgcctttgtgtcttcatagcttagctcccacttataagtgagaacatacaatatttggttttccattcttgagttacttcccttaaaataatggtttctaattccccctaggttgctgcaaatgttatttcattctttcttatggctgagtagtattctaaggtatatagatcacatatatatcatatgtgatctatatatagatcatatatatatatatgtgatctatatatatatatatatatatagatctatatatatatagatcacatatatatatatcacatatatatatatcacattttcttcattcacccattaactgatgggcatttggggtggttccatatttttgcaattgtgaatcatggtgctgtaaacatgtgtgtgcaagtgtctttttcatacaatgrcttttttcctccagtagtgggattgctggatcaaatggtagatctatttctagttctttaaggcatckctgtactgttttccataggttgtactagtttaatttcccaccagtagcatagaagtgttctcttttcatcacacctaccccaacrtctatttttttttttatttttaaattatgaccattgttacaggagtaagttggtatcacatagtggttttgatttgcatttccctgataattagtgatgtagagcattttttcatatgtttgtcaaccatttgtatrttttcttttgagaattgtctgttcctctgcttagcccactttttgatgggagtatttgtttatttcttgctgatttgtttgagttttttgtagattctggatattagtccttttttgtatgtatagcttgcgaatattttctcccactctgtgggctgtttactctgatgattatttcttttcctttgaagaaactttttagtttaattaggtcccatctatttatcttgtttcttttgcatttgcttttgggttcttggtcatgaactctttgcctatgccaatgtctagaagagtttttccaatgttctagaatttttatggtttcaggtcttagatttaagtctttgatctaccttgagttgatttttgtataaggtgagagatgaggatccagtttaattcttctgcatgtggactgccaatttccccagtaccatctgttgaatacgctgtcctttccccactttatgtttttgtttgatcagttggctgtaagtatttggttttatttctgggacttctattctgttcaatttgtctatgtgcctgtttttataccattcccatgctgttttggtgactatagccttgcagtatattttgaagtcaggtaatgtgatgctccagatttattcgttttgcttaatcttrctttggctatgtgggctcttttgtagttccatatgaattttaggattgtttttttctagytctgtaaagaatgatgatggcattttgatggggattgcattgaatttgtagattgcttttggcagtatggtcattttcacaatgttgattctacccttccatgagcatgggacgtggttctacttgttagtgtcatctataatttctttcggcagtgtttttaattttcctcgtacaggtgtttaacctctattgcgggaagtcagggaccctgaatggagggaccggctgaagccacagtggaakaacataaattgtgaagatttcatggacatttatcacttccccaatcaatactcttataacttcctatgcctgtctttactttaatctcttaatcctgtcatctttgtaagctgaagatgtatgtcacctcaggaccctgtgatgattgcgttaactgcatarattgtttgtaaagcatgtgtgtttgaacaatatgaaawctgggcaccttgaaaagaacaggataacagcaattttcagggaacaagggagataaccataaggtctgactgcctgcagggccaggcagaacagagtcatatttctcttcttgcaaaagcaaataggagaaatatcgctgaattcttttgtcagcaaggaatagccctgggaaaagaatgcattcccgggggaggtctctaaaatggccactctgggagtgtctgaattacatggttgaagataagggatgaaatatgccctggtctcctgcagtgccctcaggcttgctaggattaggaaattccagcctggcaaattctagtcatactggttctctgctctcgaaccctgtttcctgttaagatgyttatyaatgacaatgtgtgcccagcgggatgtggmacctcatcagtgattctagttttgccctctgccttgtgatcttttaytgccctctgaagcatgtgatccctgtgacccattccctattcatagaccccyrccccttttgaaatccrtaataaaaacttgctggttttgcggctcaggtgggcatcatggaacctgctgacatgtgatatcacccccggagacccagctgtaaatttctctcttttgtactctttctctttatttctcagactggcccacacttagggaaaatagaaaagaacatactttgaaatattgggggctggttcccccagtaaacctccttggttaggtatattcctaagtattttatttttttgcagctactataaaaggggttgagttcttgatttaattctcagcttggtcactgttagtatatggcagtgctacagatttgtgtacattgattttgtatcctgaaactttactgaattcatttatcagatctaggagctttttggataagtatttatggttttctaggtatacagtcatatcattggtgaacagtgacagtttgacttcctatttactgatttgtctgattgctctggctaggatttccagtactatgttgaatagaagtggtgagagtgggcatccttatcttgttccagttctcagggggwatgctttgaacttttccccgttcagtataaggtcggctgtgggtttgtcatagatggtttttattaccttaagttatgatctttgtatgtcaagtttgctgagggttttaataaaaaagcgatgatggattttgtcaaatgctttttctgcatctattgagatcatatgatttttgttttcaaatctgtttatgtgatctatcacatttattgacttgtgtgtattaaatcatccttgcatccctggcatgaaacccaatttatcaccatgtatgatctttttgatatgctgttggattatgttagcttgtattttgttgaggatttttgcatctattttcatcagagatattggtctgtagttttcttttttattatgtcctttcctggttttggtattagggygatcctggcttcataraataatttagggaggattctctcyttctctgttttggaatagtttcagtaggattggtaccaattctcttctttgaatgtctgattgaattcagctgtgagtccatgtgaatctgtgatttttt

SEQ ID NO: 1700 - DNA, 16326 bp, Homo sapiens
tgtgctcaccctgctgaccgtcacccagcctccggggggggtcacagctggcccccaggaagctgcttcccagcagggcaggaattccatttgagtcttgtccctgttccaggagaagggctgggtatgtgtcccccaaaggggagagcattcgagaaggatggcgccagcctccccagaactgacctgtggttaaaaaaaaaaaaaaaaattgtgctttttaaaagatgagttttatcagctcacacatccttctagagtctaatggagattttttgtgtgtgtggaaatagtaaacaaggtcttgaatcccacagagcaaaaaagacttcctttcatgggcagcactggaagggttgttactctggaatggtttaaaagaggcgtcacatggcttgtttgtgctgatgtcactgcctcgctgctctcctgtggcacctcctcggtccctggccacagggcacagagccaagcacatctcatgctcttggcccagttacgcttctgcccaggggtaagtcagctggagaggaattcacagcccaggcatttcatgtcgttatggcctattttaatttttttaaccccaatcatttttcttaggaagtgatggggagtttggaaaggcaggcttatttgtcatcaagctgccagcttttatcaatgcaaaccacatccctgtgacatctgtgactgttccttggacagttaggtgagggagggtctcctggtggccccagggttactcttatttaggttgagaaaaattcctttttccaggatcgttggtgatcaaagtgtagtcattctgttgcgcagagaactccatcccagctccaccctcatgaattttgtaatcttggacaaattatttagtatcttagtgcttctgttccctcatctgtaacatgggggtatattatagtcagtagcacctgcttcacaaactcgtgaggacttcagcagttcacacacataactgcctcgctgcctggcacctagcgtgcacatggcattctaccgtggggtagacttttaaaattctggctacagagatacttttccataaaagtggccacatggaactctccaaatctaagaagcatactgtgggggccttcatattttgtctaattcttttctccccagaacaggaacctgcacccttccttcttttaaagggcgacgtggtaaataaacatttttagacttgcaggccacagtctctgtcctaatgtcctcagctggtagttgtagctggaaagcagctgcagcccacatggaaatgagggagcgtggccccatgccagtgcagctgatgtagaggcgggcagccccgggttaggccctgtggagacgcaggcccccgggctctagaacgctgaattctagtgaattctggatggctctccctcacacccaggcccaccctccctcaaggttgcaccttctccacctgaaggaagctgccaggtggccataggagcccttctcttggcaggccagcttccaggcccagtggcttctcttacatcaggggcctccccttggaatgttccctgaaggccagacacgggcaggtagtctgtggtcaagcagccaccctgacaggaggctagatgccactgggtgtgctttgagtttcctagatgtggagagttctgtgtggccacttttatggaaaagcatctctttagccagaattttaaaataaagaggataacttcctggtgagaacagacgtggaaaggaaggcactttggtttcacgctcatgtaagagagggctgttggcggtcactcctcagaactatggccagccctggatggtagccagctgctttttgccccaaaagtctgtttagctgggtctctgcattctggaagcttgtcaaagcccgggcctttcctgggtcagggcagccggctttccttgtccacgtgtggccggctgttttcttggggagccccggccacagccggcaggactccctttgctccatgtgactctgagggcctcacaggtatttgcagcccaggtgctgtcggagcccagccgatgcgaccgacacacagcacaagcgtcatcctgttctgcctgtcccttgcgtgtggaggggactcgtgcccagggctctccttgctggcttgttggaatctggcttcaggtctacacggggcctctcgtttggtccagaacagcctggctcatcggctggggcttgcttgtgcagggctggagcgagcacgtgctagatggagacagcagactcggagtgtgcatttcttcgtgttgcaagcctggcctcacagtgccttcttcctttggttgtctgccaggggtagccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagacgcctcagatagaaaactggttatttttgtttcttagcactgccaccatagataacagctgtcacgatggacagtgtggacctggattagtccttcttgggaaaggagagtttgggttttgtaccgtggtggttctgggttctgggggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccggtttggaccccctcccgtgtgtcttggctgcaggtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaggtattatatgtaggagttttcttttaatttattttgtgataaattaccagtttcaatcactgtagaaaagccccattatgaatttaaatttcaaggaaagggtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttytgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagargaaggtgtccaggcagcaccatctctgtgcgaatccccagggtaaaggcgtgggkcattgggtttgctccccttgctgctgctccatcccygcaggaggctcgcgctgaggcaggacygtgcggccatggctgctgcattcattgagcacaaaggtgcagctgcagcagcagctggagagcaagagtcacccagcctgtgcgccagaatgcagaggctcctgacctcacagccagtccctgatagaacacacgcaggarcagagtcccctccccctccaggctgccctctcaacttctccctcacctccttccctaggggtagacagagatgtaccaaaccttccggctggaaagcccagtggccggcgccgaggctcgtggcrtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataayggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcaytttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacaytgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagacygtgttcgtggccgacctggcctctcctggcctgtttcttaagatgcggagtcacatttcaatggtasgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagcygaatggcttgccagtggctctgtggcaagatcacactgagatcgatgggtgagaaggctaggatgcttgtctagtgttcttagctgtcacgttggctccttccaggktggccagacggtgttggccactcccttctaaaacacaggcgccctcctggtgacagtgaccygccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatyagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccckcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgaytgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgcatttctgtctctggtttggttttgtccctcctggaagcatcactacactttggtggcagggaagctgagctatgtggggcacgtgtgttcacgcatgttgcctggaagcgttctccagaaaagcattgcctcttctctgacagctgagctttctcagcatgcaaattgccagtaaagacgacagggaagctatctgtttctccctccattaaatcatctggaaagaaatttgaatacataaattacgaaactctgtactgcagttccgactgatttgtagacttttttcctataccttccactaacaacagtcaggccaaggcaagtctgatctgcatgaccccaaggcagaggacttcagttcttcacatttcccatgtgctttttggtctttcacagctgacatgcccacctcggggggatgctggtgagaacccagtgggcctcacgcagaatgtgggtcactggaggagctccaaagtcctagttactttctagctgctgctcagtgatctctgtctgcccctagggaccctacaatgtaaacattatttttgtcaggggaaatggcatgtatggcaaggtgtgttctagaatcagactaaggattcagacacatcaggcagagaagctggtcatttccttcaactttatcatgggaaattatgctccaatagcaaaatcgggccagtagaagaagagctgtccagcaatgtataggtagaagtaaaccgaagaccatggttacttcagacctgttgagcctcagaagtgtttgcacctaaaagcaaaggcctttctgaaaggggactctcagctggggtgcggtggctcacgcatgtaatcccagcactttgggaggctgaggtgggtggatcacatgaggtcaggagttcaagaccagcctggctaacatggtaaaaccccatctctactaaaaatacaaaaaattagtgggacatggtggcgggtgcctgtaatcccagctacttgggagggtgaggcaggagaatctcttgaactcaggaggcagaagctgcagtgagccaagattgtgccactgtactgcagcctgggtgacagagtaggactctgtctcaaaaagggtactcaagcttggcattgcttcagggttactgctcagtgttgtcaccgagtgcctggcactcaggggatcttcattaggtgactgatgatgaggaggtctcaattctgaggctggaaagcccaacagggcctcctccttccctggtcaggtagatgctgcccttccaggttgccacagtgcagtctgcacttggcctgcccagccagaaggagcagcaatatctaaggatgaaggtgctgggtcttcagaagcattagaacctttcccctccaggccatttcttaagactgcaagccctcaagagctatttctgcatttaccccccaagtccaggtatgagtccatactcactcagatgtgtgatttttgtagtgttctaatgttgctaaaaagaccttcacatccattctctcaccagatgttcacaatcaccctgcaaaggaaggattttaattactcttacagatgagcaaacatacaggcatgctcaagacccctcccccgcccccccacctccccaccagctaccaactcaggactcagcctctcagccttttctgctgtggttctcaatctggcttcagcactgccagaactaagcaggctctgtgcatactgacaagggatgctgggtgaagtacacagcccaggtgtgaatgagacttctggggttctccctggagaacttcaggggccacagcggggggaaatgatggggaagttcttgaagagggagctctgggcctcccaactggataatatctaaaaatttaaaaaatgttatggcatgctgccaggcagtctgaaatataacactggagcccagtcctgggggccccttgcttgccagtgtcctgggacagaattgcccatagcacagacagatctccacattagcaaccatgcagccagacctgtgcacaccgcccagcaccacctccccccatcccccaatatgtgggctttgatctgttttctagcaaatgatccaggtgtacttgcaaagggagtcccctaaaggctactccaaatgcaaaaagcgtgctggcggccttgactgcttcctttggttttcttgtgggtttttgtttgtttttttttttttttttttttgagacacagttttgttcttattgaccaggctggagtgcaatagtgcaatctcggctcactgcaacctccgcctcctgggttcaagcgattcccctgcctcggcctcccaagtagctgggattataggcacccaccaccacacccggctaatgtttttgtaattgtagtagagactgggtttcacatgttggtcaggctggtcttgaactcctggcctcaagtgatccgcccacctcagcctcccaaagtgctgggattataggtgtgagccactgcgcctggcctggttcctttgttaggaagctgcaaatgcttttcttaatagtgaatgaatccaaacactaactgatgaattttttaaatgtagtcaagtgaaaaatggtagttgtaagcacaccaacgtaacaagaaatttcccagagctcacctaccttcactcacttcctccaaaaaaaaaaaaaaaagcgatgttaccaatgggactcccaaaggaaatctgcccctagaaaacactgaacaggtagaatcttgctgggagaagcttggcacaagacccggtgctgtgtcataaaagcaaaacaaaacatgaaacagaaaggagattctgcttttaaaaagggaagacaccatggagagaagctaagcccggctattaacctgcgccttcaaaccaaacactaccagtgtgactgtaaaatggtgcagcccctgtgcaaaacaaaatggcagttccttaaaaaattaaacacagaattagcattgaatccaggaattcacctctggagattgacctgaaagcaaggactcggatacatatttgcacgccagtgtttgtagcagcatgatttgcaagaaccaaaaggagcaagtaacgtaagtgttcatctacagctgaatggatgaaatgtggtccatacatacactggaatattattcagccttcaacagaatgaaatcctgtcccatgctacaacatggatgaacctggaggacatgaggctgaaataatacgccagatgtagaaggaccagcgccgcatgactccctcatatgagctacctacagtcagattcatagggatggagggtggagtggtgagcaccaagtgctgggaggaagaaggaatagggagttaataggtacagagtttcagtttgggatgaggagaaagttctggagatggatggtggtgatggttgtacaacaaggaaatgtactgtatactactgaactgtatgcttgaaattattaaaatgagtagtaaaaggggcaaacacagagacagagaaatcatacagtagagcctcggtggcttcgaggctacccaggacctggacacacaagctcaaaggccaggaatggggtccctggagcagcggctgtctctgtgcttctgtaagcatctccaaaacaggtctgtggtccccacagtctgcgcaggatcacacagacccactgtgtagatttttggaagaaaacagatgactcggatttcattttattgtcatgaaaaccataactgaagctagttcatcccctgtgaaatgtccacctttcagagtgttctttctcctgacaataaaataaccctttgtgattttgttgggctaattcagagttttccaccctctttgtcttacaagcaatttttgaaaaagtttctcaatgcacagttgagtgctacatacaggattgaaacattcaattttctctagaggagcaatcccccggtcagttccctttggctggaaggaccatggttgagttttcttcgaactgggctctgtgcttgggctttcccacctcttccagcatttcctggatgatgactctcaaggctcttcccagcaggctggccgggagcccgcgcgatagtggagggacatggatgagtgccgcgcagccctttccatgatgcagagacaggtaataggtataatcacagacgtatctgcaaccacaggaaatgccacattaattctcggaccagcctctaacctcagtgaaacatacgcagaagtggcaatgcaacacccacaaagcctgaggagggagcactgccacccaagggagacttgtgttgtttcacctcagaaagaacatggtgccaggatgagctggggagagctggctcttggcctcatggcctcatgaccggcaagtggccaaggcagaaaggggtcagatattccacagcacctgcatcccagtgaatccctctcattcatgtcttcgttgagtcacttactcattcattcactggggaaaggggaaaaaccacctactggggatcggagtttggagaaacaaaggtaaatcaatctttatctggggctacatcaacacagttaactcacaacttcggtcaccccaaaaatcaaaatcagaaaacattcacgaaatgttagtggctcttgaagtctgccttcccatctcttctcctagatcaacacaccaaagaccgtgtttccacaggcaggtctcacaaacgagacctcaggcaaggtgtgagcaactgtgctggcctgcacacagcaaagaggggcaatctgggggcggcaccgcatggccaagtggccagctggacgatacaggatggcttcttggaggtcggggggacgctgacggccattgcttctctcctacctgctcagagtcctgacacccacagagcatacctgcctgcatctcgggaaaagatcacgtcgacaccctccacagctacgcgcttgcagactgccttcatgcagacccctgactccagcacgtctgggctgccaggtaggcacacgccgccctcgggccagaagctgcggatgtcggcgtcccggtagccttggttcttgccagactgttccagaatgatcgccttggcggcggtgtccatgcccacatgcacgacgagctgtgtgaacgggtaacagcagagagaacccaggaaaacgaggcccaccctgctcaccaaatgtgcagaaggggccactccttttgagagcccggctctgtgcaaaacatctcaaaccccaaatccactgggaaaccccaggatcccccaccagtgtctcctaattaatatggctggaaagaaaaacagctggattcttttagctgaataaaaactcatgctgcatttacatttaaatgctttttacttcaaattattcttacagggtaatgtattctctttttgtggggggagggttggagggaggagaggcaagctagtaagtggtgaggctaccacagcagagtcttcgtgttttggtggaatcctgaatctttttattttatattttatttatgtatttatttatttttatgagacagagtctggctgtatcacccaggctggagtgcaatggcaccatctcagctccctgcaacctctgcctcccgggttcaagtgattatcctgcctcagcctcccgagtagcggggactacaggtgcaccacgcccagctaatttttgtatttgtagtagagatgggatttcaccatgttggccaggctggtctcaaactcctgacctcaagtgatccgcctgcctcggcctcccaaagtgctgggattataggtgggagccaccgtgcccgcctcctgcatctttttttaaatgaaactttaataaaggaagttagtggccatccagtgaaatcttcttagaatttattcaagctgattatttttcctttttgaaaaatagctgcccaagtatgttatcaaaacatctggggcattgtctgaatggcttgatagtgtatgttttattaacctcatca

SEQ ID NO: 1701 - DNA, 12548 bp, Homo sapiens
caaaaataaaattaagtatgtataataataattattattatttcgagacagagtttcactcttgttgcccaggctggagtgcaatagcgtgatctcggctcactgcaacctctgcctcccgggttcaaccgattctcctgcctcagccacctgagtagctgggattaaaggcacgtgccaccatgccgagctaatttgtatttttagtagaggtggggtttctccatgttggttaggttggtctcaaactcctgacctcaggtgatccttctgcctctgtctcccaaagtgctgggattacaggcgtgagccactgcgactggccgcatgtatgatattttatgatctgtggatctgccaaaggattaagcattatttatactaccttggcacatcattttctgaagtgattgaaaagttcctctcatttcaatctattaggaagctacttttaaagcctggaagagttgactcatgaagagaccacataatttgtctaacatcacagaggaaatacaagatataatgaagtgataatattcagatatttaattacattaagataatactagctcataacttgaactgtgattacatttcttagtttaattgatgtttcagaataactgttttgaggtcaaaaatggttcaaggaagatctgcgacttgtcttgactaagagaaaaaaaatgatgggtaaatatatcttttcctatcactgctattccaaatggttattttcctattttgtttcaaagtttctggcttatgaggaaactgggacatgcattaactttatttttccctctcctaaccccctctttcaaactccaaatctgttttctactccttaaaggccttgttttcaggtagcaaggaaacaagcaactagcctttcacatttttgctgatagtggtttagtgaactaaccctgccaggaactttggcattttaaaagtagacccaaagctttcaaattcaaagacattttaaatttcaattcaaagacattcaaattcaaagacattttaagaggtgtatgacagccagaggggtgtggtcaaggttaggaagttccttccggaacttcatcattgcactcgaacagtttgacagttatatttctccactgccctcgatatgaaggaaaatttattccttaaacatacaggatgaaaaagtaacctctttccattcccttgcccaaattatctcctttagtatagagccagaaagaataacagtgctaagtggcaaactgagatgtcctacaatgtcaccaagaagcagggtaaattcttagaaatcaaccttatattttaagactatacacagtaatcatgcaacctgctgactgtgggagttgagcatatacagacctggtacattcctactcagggtatttccctatttctctacctccctcatatctaccttctccttacctgtggcaaactgcgaaggacttctcaccccacgtttttgctaatctgaactcttctcagaaggtcagataatctgactcaatatgtcatatccacacataatcctcccagatgagtccacaaattaaagtggtttttttttaatagtgacatagttaaaaccaagcaatgaatttattttctaaaatcaatgaagtggaataaaaatgcttcctaaacagatattgaatccaactgaactgaacttacacaatctagtttaaatcctgactggagggtttaaaatctccacttaatggattcaattcctttatatctaaaaaatcgcagtaggaaaaaaaattcatggcactgtcccacaaaagattttcaagttgagaacagcctggccactggaacagttgaaggtatggcaatgactctgagaaagcctacgctgtaggattaaggcagtggaagataacacggctccccactcccggacagggacactcagcccacctacacgcaccagcatgagcctttctttgccttcgcctctgcatccttttagtgaagtccctacttgggctttgtagctccacactgcagtgggcagagtggcttgccagtccagtgtgcagtttggggcccagagaaggtgggagaagtcctctccaacaatcctcagcccccggggcccacgcacacaagcctcttcaccccatcaccccgtgtgctgttaccagtaacttcccatcaccaagacaccgcttgcagaggcctcctctttggcatattcagtccaagtcccttactttcttaagcaggagacacttcacaacaatatgtatcaacaattcacgcgaagaatttaaaatttattatttggatggtgcacagttaattatatgtttttccacttactccctactagcaaataggtgggttattaggagatatctgaacctttcaagccactaaaacactattttttggtgagtgcttgttgaaagagacccatttttaatgacaagcacaagtcactatttagtcttttaagttgtgacactaaactgtcttctgatctgatggatcctaggcctcattataaaacgaacttgctcctggggaatatacgttaagaattcacaaggtgtgccataaagatatgcaaagactagagctttatcaaatcaaagcgcacaatctgtgccttctagatgcatcggatgtataatattaacataagaggggctacacaggactcgcaaagctggaataaaaataattactatgctgatttttgtccaaagtcatcagggaatggaaaatacaattttaaattgaatgataataaaatattcccagaaacagtttataaattgatcaccacatgagaagcatcatcttcaatcttaacaatctcaaagttattgaggtttgaactacagtgaactattaacattggtaaaagagttagctatgacatagatattcatgaaggttcttttcagaatatcagctcaattaaattcagggtcatggtcacatcatttaaagtacatgggtttgctcataaagccttaaaatcatagcaaaagagcaagcaataataactgcaacactttctccgtttcaaagatgacaaaattgagagaaaggataaggtacttgcctaagccataataattgaaacagttgaaaatgtaaacagtcatactctgaatgaaattctcggcattaaaatattgatgtgtacttattgttgaagagaaattttaaaaatatgtaaatctgtttttacaaaataatttaaacatatactattattgatgacagatattatctaaacatctacaaaagttttccccaaaacatggcctattgcatctgaatagattttatcccaagaacctactttaagtgcattaaataaaatttaaaacatgacattttagttaaataacagctttaaaacatatactatattactcccccaatctacctctgtattttgagaaaacgcaaacagtaagtaagaacttccaagaagatttcaaataatcttaaatctaaatttttgatttagaacgctatgaaactaactgaagttgatacgctggggatatctacacttgcaagatggttgttcacaactcttactattcttttgtggagtcaaattagatccgtttcaaaggacctttgtaagcaattaaaatcactgcgctttttgttgctttgggatattaagagagagtaagcaaagtggagatctaccaggaaaaataagcaaattagaaattcagttgtggggggtgcatatgtttacgcttacacactagtgacttcaccaagttttctctattagtgagtttttaaaaatcctctacagctaatatttatttagtggaatcctatgagaccaaaaacttcttccagtacatttgccacacctaatgacatactgtatttccaagtccaagtgacaacgaatccagcagaaagacacccacaattagaatgaccaactctgtcctatgcattgggaatatatagatgctaggaaagaagtgaaagtgtgggccagaatgtgtgaaacattcagaaaatgtcattttaacatattttcctacttcatgaaagcctcttgttattaataacgattttataacctgaaaactaaatgaaatgtattattaatacttgtatatgttccacggttgtgccttttacacagctttcatgcacataattatcttgataattaaggttagtggctaacatccttattgtcagaaaattacagaagaaaaaagtatttgtttatatttatataacactgattaaaaacaattcactacgaccattagtaatccacttctaattcatattcctcatgtcacaccttttctcttgtacacattttaaatgtcataggaatttagaaatattgcaatttaaagcataatctagaatttttttaaaagtagttctgaaacatacaaaaaaatgaacatttaggaaactagtccttcaaagaaaatattatattttatcattaaaaatatcaatcgcaaaaatattttcaaagcacttaagttcaataaagaatatgaggccggtggacattttagttttaattttaaaaagaaattatattctttttaatgtaaagaaatgagaaaacgacatccaaaaagtcttcagcctgggattctacaaaactttatacctcactgatgccatggttttacagcagttattgtttaagaactagaaacaaacttgtaaatatgaaaaaagtttttgattttaaaaaaaaccatcattagtgtttctcttttccttcaagtgagttttaaaagactgagatggccaccagttgattcaaagatctcttaagacataattattagcaagttaactatcaaatatcatataatttaaatcagggagaaaaattatgtgaagtacacaagaagacaaaaatggacagttttgtaatacacttcactttttggctgagacattacctttaaagtttcgtatattaaagtgaatattcaaatacactttatttggaatcaaataaagtgtatttgattccaaagtgaatctgattgaaaatatactacacaaaacttactttaaaacttgaacagaatgttttgatatattactccaaatgctaactggtagcatctatgagtgtcttctgtcaaactcccctaggagtgaaaggtatttctttaagagaaaagccacagtgaatgtccatgccagtccctataccagaaaggttttctaaatcatctagcaccatcagttggttctgttctcagtcagcaatcgatcacttagcaatagacagaaagactgccataaaatacctgaaacctgtcgaagatttgcccaggtccttttaaagagttaagttattcattgttctcttaataaatccagttaacaatttgtctcacgaatgacagaaacagttggggttaaaataatgtacttcaaaatcagaggttttccaggaataggtattatacaactcagtttatcattgtctggttttatatccaaatgataatttacacaaataaactttacattttgtccctaatcttgcaaggaaaagaagaaaaattttagtttcttcatggcagacgactatttttgacttgatttcttttataacaatgacactatttttacaaccgttagcctatgacccaagtgaattggattcttcttataaaacaagagcactgcaaaaaaaaatgatataaggataatacaataattttgcaaatttcggacctatcaccaacacattccaacaaaatgcaatgagagtgagccaactcacctaaggaaagggaattaagcagaatgcagaaatgcaggcttctggtcaccagcagaggttaaggccccttccttacctaccactgaccttatataaaagccgcagctcggttactccccgtttctgactccttaccttaggctcctccctaaacaccgaggcgtaaagtaccacgactacacacccaccttccaccaagggacctgagatttctgttaacctytgctgcctctacccccctcagttaggctcccaggaggagtggtcagcgcctggcacttgcaggagcccacaaagcagcgacttcgcctttccagccccccggggtgcggctgggggtcctggctgcgcgctccatccgcggaggcacggaggcacccagtccccgtccccagcccctccgccgggcgtagggccagcacaacgcgtcagggcacagggcctggccagctacaagcgcgcccctcgctgaacggtcccccggtccccamgcggcggtcgcccctgggctctggacagcgaacgggacctcctcctcagcaggggtgccgcgcggcctcaggacggacgcacgcggatcttcgcttccccgggtccagacaccctgctccaaagttcccccggagcggctcccgacgcttgcgcacctccgccggggacgcggaggtccccgtgtccccggctccgcgcccacccggcgctctcccgaggggggctgtcctggaagccgggacgcaccggctcgcgtccactcgagtcggcaccggccgcggctctctgtgcccgcgccctccgcccctagtgcgcgctccggtagacgcgaccctcagcccgggtgccctcagcccaagaccccttcacccggtcacccgtgagccgcccgcccgcgacccgtcagtccgggtcctgccggaccatgaccctgcctcagccccggacccctcagccgagacccccttctccccagctctcatccgtctgggaccccgtcagttcccgtttcctcggccctagcccccagaccctcggccccagccctccgcgccccctccctgagcactccccgcccagccagcagccggttcccgagcgccgcgggcacccgtactctgacctgcggccacggcggcgtggcgcccctctccggtgtcctcgaggccgacccaagcgccccaggcggcggctgcggctcgggctcgggctccgagtgcgctgggccccgcctgcccgcggcggagccgggtcgggccgagccgggcccggcgcgggggcgggcgcgggcgccggctgggggtgggggtgggggtgggggtgggggcgggggcgggggcgggggcgggggcggcggcgcgcgactgggagggagcggcccgggctcggccgccgcccgcgcacagtagggcccacggcgggagccaccggctttcccgcgtccactgtctgccccgcggcagctacctggtgtcgtttgctcctcgccaccaccgctgggaggcggcccagagagggtcccatttccgaggagggatccgaagtttagggggatgcccccggccagggccggtctggggagaccgaggtgtggggctccctctcggccagagtggcttgcccttcacacggcgatcggccaggccgtcttcccaagatgttctttccagtgacattttaaaagaaaatttaattaaagcatatttcgggtcccttggttttctcttctgatcggtggtgctgcacactttcagagttccttgcgtttgtaagttacatggttattcacaagtcactgacttttaatcattaaaaacatttcttaaactcattaacagaatttcttaaatttcttagcagtgtttctgacaccgagggactcagacaacatgggtggggacggagtggggacgtgaggcacgagaaacagtttctcatgtgttgggtagacagtgaccttttcttttcctgccacgctgtccatcgtgacctgtccaaagtgggttggcaggtgcgcgttcagaaagccgctggtctcctggacttgaggcccctctttccctttttccagtcttatttctggagcatactgttctgggcctgatcctctttggggaggcagcgatgcctgaggccccccacttcaggaagcttatggactgtatgctggggtgctctgcatttcttcctagcttcattgtggttattgcccctctggtacagaaggtcctcgtttgtggttgaagcaaagttttgcgaggatgggtatcacaagggaaaatattcagcgcttaaatcaacataatcatgtccttcctccacagcccctaagataagaagctgagagccacggatcttacagggactgaccactgaaagaccatttattggcctgtgatttaggtagtcaggttgacccggatccacagtctccactcaggcggaagtgctccgtgcgtcctacttcttgttaattccagagttccaatctgctttttttttttctttcttcctttcttttctttctttcttccatgagacagggtgttgctgtgtcgcccaggctggagtgctgtggcgcaatcacggctcacttcagcctcgacttcccgggctcaaggaatcctcccaccccaggctcccaagtagctgggactacaggtgcacaccaccatgcctggctaatttttttttttaattttaattgtttagtagagactgtgtcttgacatgttgcctagactagtctgaaactcctgggctcaagtgatcctcctgcctcagctttccaaagtgctgggattataggcaccagccactgcgcctagcctgctttttaaaatcacagctttattgaggaataattaatataatctaaaatgtaaataccatagaagtaaaatgtacaattcaggccgggtatggcagctcacgcctgtaatcccagcactttgggaggccgaggcaggtggatcacttgaggccgggagttcaagaccagcctggccaacatggtgaaactccatctctactaagaaatacaaaaattagctgggcgtggtggcacgtgcctgtaatctcagctactcggggggctgaggcagtagaatcgcttgaccctgggaggcagaggttacaagccgagattgcgccactgcacttcagccccagagcaagactccatctcaaaaataaataaataaaatgtacagttcaatgagttttagtttattgacagagttgtgccatcatcaccaaatctacccttagaacattttcatcactccaaaaaggaaccccctctccattaacagtcattccaccaactctagatagagatattctttctctatagatttacctattctggacaattcatataaatagaatcatagaatatgaagtcctttgtgactttcttctttcacttagcatagtatttgtgaggctcatccatgttatagcttatattaatatttcattcctttttatggtcaatattccattatacacatataccacattttgtttattcatcccatgaattgatgaatatttaggttgtttctacttttatgggctattatgaataatgctgctgtgagcattcatgtacaaggttacttgtggacatatatttttatttctcttgagtatatacctagggacagaactgcaggatcataaggtaactcggtgtttttgaggaactgccagtctgttttccaaagtgggcacaccattttacaatcccaccagcaatgtgtcagggttccagtttttccacatccttgtcaacacttgttatagtcttttttattttagccaacctaaagggtatgaagtgatatctcatggggttttgtttgtttgtttgttttgagacaaggtattgctctctcacccaggctggagtgcagtggtgcaatcatagttcactgcagcctcgaattcctgggctaaagcaatcctcccacctcagcctcccaagtggctgggacaacaggtgcatgccaccacaccagctaatttttgtattcttttgtagagatgggatctcactatgttgcccgagccggtgtctcatggttttgatttgcattgccttggtgactatcccgttgagcatcttttcatgtgttcattggccatttatcttttttgaagaaagtctgcttaaatcctttccctgtttttaaattggattatttttctttctattgttgagttgtgagagttatttatttatatagtctatatccgagtctcttatcagatacatgatttgccaatatattattccaggctgtaagttgtctttttacattttaaaataattatttatttatttatttatttattatttatttatttatttaaagacgaggtcttgctatgttgcctaggctggtcttgaactttagggctcaagtgatcctcctgcctcagccttctgaatagctggaattacaggcagatgccaccatgcttggttctttttactttcttgatgttgtcatttgagtttttaattttgatgaagtccagtttacctgttttttcttttggtgtcgtgtcagtgactaacccaaagtcatgaaatttgctcctaatgtttattttaagagttttataggtttagttcttacctttaggttttaaattcatgttgagttaaattttgtatatgatgtgagatgggggccaatctgtttttttggtcggaaaattcccataattcaacaacagtgactaaggggaaccccacaacagtgaattcgtaagtggtgcaaaactttagagttgagctgaatattttctaaattccctctggatcaaaaattttgtgatttttttttttaaggagacttatgggtagtgaagtgtataaatgtaagaggttaagtaatgtaaactgaaataatatgtctgtttttcaaattgcaaggcttgatttagtaggttatgaaatcaatttattcagtcataatcagtattttttagtcaagcaaaaaggacagaaataatcagaacatgcctactgtattaaagaaagtgctgcttcgtaacttttgtgtaatgcatgtgtgtgtgtatctgagtgtaccaggagttggtataaaatgtggtttttactgtgggccatatcttttaaagttggaaaaacactgtataaactatagctgtagaattctttctttccacaaacattttattgagtgcttattttgtgccaggccctctgctaagtgcggggaataaaatgataaacagcacatggtccccaccctgcaactttgcacataggcagtgccatccatatggggttcctagagacgaaagactatgcccgtttcaatttttccaaaccacaaggactccttccaaatattggtgtttggtcccatggtcccatggtcccatgggacttcttttttttttttttttttgcaattaatgcttagttgattatctcatttgagatttgcatacatatttgcttttctttcaataaagaggactttgttcccaggtttataattacatactatgtttattatattaagaagagagtgcaagtctagaaatagaagtttaccataactgaattgttttccattttactccagctatatttaaactggtctcactggacagacctcagatattttatagtagtgttatgctacttcttaaaggaaaaatttaaaattgtagcaaaactttttcattatcatccgagtgttcggcaaaactgggcattgagaatagtgacatgtaaaccattttgcagactgagtttaggaaagttagtgtgctgtatttgaagtcaagcaatcaagccactcatttatagcagctgtgtatcatcatagcgctgacatttgctccttctctttatctgagacaccatttatcaatctctaagccttataaattcccaggaggtttagaagatcttaatttaaaatttcaaaaatcataaccagttgaacatgccaggcaggttaaacatacacatatgcacacacacacacttccacaaatgtatctactttttgaatgactctgacatgttcccacttgtgatttttatgtctagttatgaaattttacccacaacctcccaattttactttgaatttcattaaggtccttttctcctcctctgtttattctgcctcctccgatgttgcccttcacaaaataacttgctcatctcttacaaggtcttaaggaccaaagccagatttacagccttttcttctaacttaaaattgcttgatcttctcatatactgtatccctctgcttcactcagcattctatttctattttgaatggttgcctataaataaataaaaatttctgggacattttaatggaaatattaatcttgattatattcaagtcaagaatataatatagctatgtattggttcgaaaaacccactgagaggccaggcgcagtggctcacgcctataatcccagcactaggccaaggtggccggatcacttgaggtcaggagtttgtgaacagtctggccaacatggtgaaaccccatctctctactaaaaatacaaaaattagctgggtgtggtggtgtgtgcctgtaatcccagctatttgggaggctgaagcaggagaatcacttgaacctgggaagttgctgtgagccaagatcgcaccactgcactccagcctgggggacagaggtgcgatagcaccaaaaaaaaaaaaaaaaaaaaaaaa

SEQ ID NO: 1702 - DNA, 20082 bp, Homo sapiens
ttaaaagtttactggaaaccacatacctttcttcctttacgacaacctgtcattcatcacagctaaaacatccacccattaaatgatatttttacaagattaaagaatggttttaaaaagaaagaaatctccttagttaaaaatgaaccaaacaaaggtacctaatcactgatcagcatcaaagttttgttccacacatgaaaataattcatcaggccaggtgtggcggctcacacctagaatcccagcactttgggaggccaaggtgggtggatcacctgaggtcaggagttcgagacctgcctggccaacatggtgaaaccccatctctactaaaaatacaaaaaattagccgggcatggtgacagatgcctgtaatcccagctactcaggaggctgaggcaggagaattgcctgaacccgggaggcggaagttgcagtgagccaagatcacaccattgcactccagccggggtgacaagagcaagactctatctcaaaaaaaaaaaaaaaaaaaaaaaatcatcaatgtaaaaatgaattctgcctaaggaggggaatttaaaaagtcagagaaaagcaaggaattaaaattcagaaacaagctgttttataattaagcatctgcaatttaactatactatgtcactctgattttcatctttcctttctcataagagtcatagatgttctccgctcatataaaggtggtaggaagggagggagggcgccatgctaatagaacccacatcatgtttactaagaactaggcagatgtggacaaaaactccaaagatttaaaagtttcttgactagagcaagacatcttcaagaactcatccaacatggtgcctagccttcttcagagcaagacaagccactaagtcatccctgggtgtgtgttcagcagcagcccactaggaagtattaggtgagctacgatgggagagtaatgggcaggaaaatcataggaaagcaggtctggatttgggctggctgcttagctgcatggcaccttgcacaagttataatcaggtctcttgcctccatttcctcttccacaaaaaatggaacagtaatatccatatccaccctacagactgtgcaaagattaaagaatactggcgaggtgcctggcacctagtcattgttcagtgaatgccagtcatgatcacgaacacagtccttgctaagagggtgatatgatttggctgtgtccccgcccaaatctcaacttgaattgtgtctcccagaattttcatgtgttatgggaaggacccaggtgaggtaattgaatcatgagggctggtctttcctgtgctattctcatgatagtgaataagtctgacgagatctgatgggtttatcagggtttccacttttgcttcttccacattttctcttgctgccaccatgtaagaagtaccttttgcctcctgccatgattctgaggcctccccagccatgtggaattgtaagtccaattaaaacctctttttcttcacagtcttgggtacgtctttatcagcagcatgaaaacagactaatacagagggtaatcaccacaggaatccagacggggagtggggtcagttcactggtacaaggatcttcatcaaaggaactcatttcccacctgatccctattcactccagggtccacatctaggagtcccaaagaccggcatgcatgggttgggtcaacaggctgcctggaggtttacctcattccaggagttggagaagcactgtgggaggaactggggttcaaatctgcaaacctccaaaacataggagggatcttctaaaagtttctgagagttctaaccacagattaggggaaaaaaaagatgccctttcatcaacatgggatgaaatgctaggatttagacatggtttttttgtgtgtttttgtttttgtttttttccaattcagaaaacactaaatcatgtaaaaatcttggaagaggagatacagattctgacctaataagatgctactgctctgattccaccatcagaatacctttaggttggcaccacttgcaatgtattagtgcagcaaactgcacgaatcccctcattagatccagggcccctgagagtagaaaggggagtggggcagtaaatggccagggaacaggagacagtgggctggagggtgtcccaggttctaaccccagctgggccttcagagccctggtgtggtctgggctaacctctcaatccttttccaagtcttaagtttccttccaactcactgtgattcttccagagaattacacagggcaggtgaaattatttcctagaaaatgcccatggagtacagaggttctcactgaacttctctattccagggccgatgcctttgttttaatggcagcgcatcatcgactaaccaaatccacaggtactgcacaggtctgaaggatccggctctgagggataccgaggcatccggggctccctctgtcttctttctgtgtacacaaggtaccttcagtgactgcaaggaaaatcctcttgctttctacatcagagcacgttccataagggcaaagtgctccagtcatcacctcctgttttctctagccagacctgctctgagctggagacccactgcagtcaagcaaacttttagacacaagaaaaaatgacaacgtgtctattacagaggtctcagcttaatcagaaaatggcactgtgggccagagaaaagctgacggtgatggctcctaccccagtgcaataggcagatccatgagagctctcactggggctgctggagaactggctgctctctcccactttagtaacccctgcttcataactgtctgtgccagaaagccacagtgagcccccagtggcccctgtattacccacccagagagacaagctctcccctccatgaaactcatttctgggacccacacctaaactttaacacaaatcagaaaagttgagactccttaaaaatgcgttttgcaagctcacaggttcttggttcataagtgatactatggaacaatctggttgggaagggtggcacacaatagaaaaagttaatgattatctggtgtagtttgctttagtctgtgagttcaaaagtctcctcatttacaataaccttaaaggataacaaaataaagtcctagaagaaatgtaaatttaattatttccattttctcaaaatattaattgctgatacaattaaatggattggcctaaactgctccaaagcttttcctatctgctaattaaatttgccctcgctgccataatacaaattctgggaaaccttctggcttctgggcacactatgtaggatgagagaatcaaatccattcagtcctaatctactgccccacttaataaacaaaaaatgttaagaacatgcattttaaaaaaaatctaaatgccttcataatatagatacagcaagtcttcccataatgctaatgaaggcttctcacaagagtttaatgagctagtatccagtatcttccaggcccggggatgttagcttctcctcccttagtacagaggttgctcagacagcaatcagcatcatgatccatactaaatgcaacggccctactctttatctttatagtctgtaatccaagtcactctattaacaggcagaaaaatcccagctagcttcaaaactccctcatctttccattatttcaaatgacaaccttttcccactactttatctttgcattaagtaccaggagctgaaagatgcaatcaatttaatatttccctctgcccatttacatgacttatttgtttcggcagatcttctttgccacaaatccttcatttgcccattcatgtctgcatacttaacatagatttaatatttctccaggccaaagatcatatgcagagtttttctttgactggaggacagaagagacaaggagagaaggagaacgtctggaattcctttgttcttggagacaactccagagaacaattctcaataagaaaagttataaaaagcttcaatcagcaccctcacgtttctgatttaaagttggggtgggggagcgtggaataaaaagagagggaactaaacatgtacgaaactcattctagcgtgagacgttgtcaggtactttgctgacattttatcataaaactctctctcggtggccacgggttacagcagggaacctaaaacctagacttgggaccccaagtcctcgcttcacaaaaatcatgacatgggtgttgaaccagtttctgttcagccacacagaaactcattcaagtccttcaagaggaagaatcccaccttcaactccacacctcctccagcaccaggcggagatgctcctgattccactgagaatcctcctgcccacacaggcaggaaactcggggcactcagtgcctgctctctcacccactgcatgcccacagacctctgcaaaggcagctcctttattcccccaatcctgaacatctgttaagtgctaaggcctcagagggggctttttaaacaggcacaaagtagaaactaccagctttccaccactcctacctcatccatcagaaaacagagccaccagccttccagggtagggttcatcaagccttttcctccccatggaactaagctgtacacagtagtcagagataaataatgtctaagccaaaccggcttgagggcacatatggaggtggggggcagagggacactggcctgggacctaaaccaccattcagacctcatctttacaaaatagtatactccacattccaaatgcctggcaaagttttgcattacaactcattcacgagtcgagggccttgtatacagtgttcggcaaacagtactgagcaagtgtggacatttctcatgaaaggcctcgatttcaaccagacccaaatattcttttaatccaaagttccaaatgtggaacttaccctcctctgagctcctagcacttgttgcctctatttctcttctggcaaaagtcgtagagtgtctcgtcacaccgcataagttgtctctctcttttaaatgtcaagtgtttttatcttatctcacaacagaatcctagtttgtgtcatctcatactgcctagcatgagacttgcacaaaacgggggcaccttaattgtgcagctgagggacacgatggaaactctggccaaggaactagcaaggaaacctgcaaagacacatccagacctaacctaggtgcgacttataactcaaacctcttccccagtctccctctctatgggagtgatatgtacacaatgtgttcgcttccacttccttaatgatggtggactgacatgaataagaatgatggggaggaccataggaccccaaataattcacaagtcagcaaagtgaagaactcacctaggccatacatgtgcacacattctctagcacacacacttactctcacactctactgttatttagtttgtttattcattccagctagaaccagggaccaatttggtcatccaaaaatgttttgtaaatctctttataaaattcctgcacctctcagggccagcaccagagcaaggcaagattggtgtccaggatacaaaatgtaaacaggtgctccctctcatggtgcactaccctgagagaagacctcttttgtctctggtccaagatttctcactctggtccaagatgccaccactgctgccactgccatcgccacctcctcctccttcccttcctcctcccccaagagaactatgaggaccaaaccactcagacactaagtggggtcaagcccacatgggagatggatttttacagagtatctcctccacgggcttcccattagctgtgaggttggagaatcaaacattataaacaaagcatgagtcctaacccacaagtggtttctcaactgtttggggagagagatgaatgaggagtaaacaaggtcctctgaacctactgataaaaagtacagagaaaccatcatcactgaccaaataacccagcaatggatgagcacaaaagcaacctggaagcaagagtcctcagtaaggaagatttggggggcttcatggaagatcaagtgggtgatggttaaggagaaaccacgaagagcgtagcctcagtaggtaacgtctgctccagctagagctcaccatgcatgcacaccaaacccagatgccgaaaaccaaaaaatacagcagaacgcacccaactcccaaaccactgagaaagtattttaattttgctttgatcactccagctgcgcttcagagtccccagcatttcagcagcatcatagaagaagacatcaatcactggccatggcacaaggaaactcctgcttggctatcgggctgctcagattctggatgagggaaagcttactttagtggaaaagaatgacttaaatgaatttaaattcattccacataatcgagttacatcagcatttctcatatgcacttatgaataattcactttggtaacagcaaaagccagaccagagaaagtcacttcaaagatctaagacttaacatcaatcctacctgaatttcctgctctcaactccttccctaaccactttatttccttctgccctatcactgaggtgctttgccagcctcctgtcctacatccgttatccctcagtaagctctctggaacttcccaattgcagccacctcctaatgtccacagcctcctcttctagatctagtttcgtaggcagtccctaagggtagggcccatcctaaaaagttcgactgcttcataccattccaagtctagaacatgtcctcagtctctagtagtgtttactgaaagccacggccaacagatctatccgaggtccccaacaaccttgtcttcaaaactgaatctcagagctggaaggaaagtcagtagaagaggccagatcgtgctttctgcaatagacaatggtgcttaagtgtacacaattttcatgcaaattcccccgatcatgaagctgggctgctccctatacttcttgtcatttgattctccaggccacctgcctctccagcccagctttataatggtaaggcactgatgagtttgcatttatttagatacactggagggattttgcgactggagttacaggaggctgaggagctggcatctgaaagtccatgcttcacgcttttcaaatgcactatgtataaccaagctcrtttccaaaaacagaatctgaactagctcataataaaccattcaccttttattttttgctgaaggggtcagagcatcatcccaattaccatttctctctaatgaccacttactcccttcttacacattttcatcagctctttattctacactgagtatttccaagaattaggataacactacygcccaataagatagagttggggttacccaaataagcaacagaagctttccagtgggaccgagtcaagtcaagggtctcaagtccccccaccctaaagcactgaacacgaagttcagggagcctgtgtctgaggcctaagcacttgccctgcatcacaatgagcagaagacacaggaggcacgacagccgtcatcactgcacagccaccagtacacctcgaagccaattaatcctgcaaaacaaattcctctcaaaatggcagtctgttaggtcaagtttggctgttttrttaatygcctatcaacagaaacagctttgctaggcacacccagaagttcatctctcctmatcacccacctttggcacccagtgacttttccaaggaggatctttttcccccctcagcaaacaagaaatatttggtgagctaaagaagcattcttctgagaaaattatacattctcagaattccattcataaasgactactggtcacaaaagaatggccagggrtaaggcaggggtgggargaggaagggcaggagayccaacggatggtgctgcctggacagtccctgaagtgataaagagttagaaccagayacacacttctgcattcagctgctgtctttccttgtgagtggaaaaacacactcagtacattctctgcaaycctgcttaaaacctcttctaaagcttctttgacacagttattcaaaagcttctaaaagtagtatcgacgtattacaaaataatccaatcatttcaagttcactgaggaagagaacaaaaatatatccttacatcctatctgaagaatagtctaagcacctaataatatcatctacttagcaaagcagaaggggccattcagaggtcaagaaataggaacggaaacgttgtactaggttaccaccccaggaacaaagctggtcttttctaggacccaaggatctgactagtttccatttgtctctgcattacaactaatacctctgggaggtgggggtgggggtgatcctaattcaaacagtaaggctgcccaggaagtayttctaataatatcaaccttcgtctttccttttttgtactgtaggctctttgtctcctgatcttcttttattttgttccccctttttactactaagcccaactcctggtctcagcagctgctaaaacacgtccaagcactttgcatctatccggaaatccagaatggcagcctgggttcacagatctgctgccaagggcagatgtatscgcactgcagctgggccctcctccccaggggccccatgggcacaagcagctcagggtgggccagcgagcctcagtcacactggctgccctcagccccaccttctgcatgaagggtggctaagctccatgggccactctgcattaaccccaggaacggcaacctcactaacttcatccaggtcccttcattaggacttgcaaaaacaaatcagatgcagctacacgttggggcagtgggtgcagcttctctaaacaaggccatgggtatcaagcaaccgacagtccctaaatacgctgcctctgttcccatcccacatggattctgggaaaaatggcaggaagaaagaagagaggactgggcgcttgtttgtgaccaaggcaaagaaacaaaaagcgacttctgttcaataatgagatgaaacagaagcccggcttcgggcagaggcctggcattcctgcacaacattttcccacccacctgatccccttgaacggaaggaagacctaagggaggacagagagccagtgtttgtttcctgcaatgggggtgagaggaggaaaatgaaactaaacaaaacaggagaagaggctgggtgggagaataaagtggtacgcacatacacaaacacacacgcacacgtgcacgtgtgcacacatatacctagcgttaccaaagaagaggataaacaggcacatgcttcatcctggagcagatggttggctacctatgtgagacctaaagttgtcataaaaatgcacatctttgtaatctttaccaataactgtgcccactctaaccactttaatgttatccatgcaaacagacagaggcatttaaaaaatatggtatttaatgatttaatgtcagtatcatacaagaatctatggatatttcttaaatgctcccaaayaccaaacttgcaaacaaaataaattcagtttcggaaccaaataaatagagtttacatatgactagggtgactccactggcaccccgatatagacatatgtacctcgctgaatgttctgtaaagatacagtttatctggacagacacaagaatttgaacagtacgaatcaaattagcaagaaccacacctacagtatggcccgctatttacaataattgaaattctacaatttagaaaagcaatacagaaggaccatttagttatggtagtgaacatatatagtcaacacagcttaagactcagaattttagatggtctyagaatgcaactcttagatagtttaatttaaaaaaaaaatagcagcagctgccaccatttaccaaaaacctatgtgcttggaaacatgttagatgcttttcaaatactgtcctattcctgtctcactgaaggaaggtgaggtctggcagctttgtcctagcaccacatacctgaggcaaacagatggcactatctcaaggcatcaacggtccttaaacctttgcatatgataccacttgtccacacaggaacgtagtttaaaagaaatacatcctgttctgtacaaaatgatgtattcttgcagatctcgctgttaatatgccatggggaaaacaagcaggggaaagctgtacatccgcatgtggagccacctaaacatcctgaagaccagtcacactgagagtgagggcaggcacaggatggtagcttctgcccccacggactccacaatattgtaaggaacagatgctcagggatatcaggggtgaggcctggccagccccatgacatcctgaaaacctaacagcggccaagctgaccccgcagaagaagtgatctaacctggatggtcacccttccctgcctaagactcaccctttccaccsgccccagaagcccttattcctccttgacttgaaaagacaactgtcccccataagccctcacacctcctaccaagctccaaggactgttctgttcttctgcctactcccgcaatgcagttcaaacgtttaccagggctctrcagtgagctacttttccaaagacagaaaagcaaggctatgtgcaatcagacgaaactccagctctcattgtaacatccagcttaaagccatatgttagccagtggcaggtacagattagaacccagaatggtctagattttgggtttctacttggggttccttcttccatataaatgatctctaaatttcttaaaccctgattcccaaattatacatgatgatcagtgtgccatttgatgagttatgaacattttaaatgctgcataccttgcctgtatgtactaggatcaaagaggagagagagagagacagagagagagaccaagcaacacgaacacacaggcagatcaggaagcaagaaatcttctcagagcagaccacggaaaccctcagtaacttactcaattttagagtttgaggaaacggcacaggtagtccgatgcaagccccccgagttcaaagaaaggaaatggaagtacagggcagacaggtgacgtggcaaccgtccctaggaaaggcactgctggacccagctgtccctgtccctcaccagcctcacatgccsaagtcccatgtacccctggggctgccatgctggctgctgagccatgggcgctggtttggagrtgaacttcttcgaggaaagcagcttcttatcccccagaagttctgcagatcatctgtgcactttggtttttacttaaaatgtgatttaaacagcctgctctacttaatactgcctgtgccacagacagaaaaatcccatctcccacccaccagcctccctggaacaaacaccttggctgtctctcgctacctccragtcaggggaacattccaacyaggatggtgctcagagaccccaccttttatagccagagtccctgattcacaccatatgcccaaaggaggcgtgtttctaagtgatgcttccaacttcaccaccagccaaacttaacttttgaaccaccctatacacgcaagttgagcaaggcaattcaggacaagattaaccacgggcccacacgctccacgtcatccccactctgccgagaatgtcacactggcatacacatgaggaaagcaagacagaggtattaacgcaacaaagaaagaggcttttcaagcacaggaagaaaccagaacaawtgtacaaataggtttaactggtgagagctgaaggggctccagatattttccaaatacttggcatgcaaaaatcaccacaagtcagtggttctgaaagctttttggtctcttagacgagatccctattaaaaacttctgaaggaggcccaggatggtgacaccatcactaatgacaattagccaaaagcaaagtctttgaggcacaaggcacacgccccaagaaatgaggtgggctaagccaggtcccagggaacctgcacacaaactgcttcaccatctcggcaacaagcgtcggcaatcaggcagaagagaatgtgagctccacgcctgactataaaaggcatagcaatgaggcctgggggcatgtgacccccttctaaataaagatcacccccacactgggagcagctgaccagagcagaggccttccagggcaaccgagacaagttcctaccaacaacacaaagccagatgcccctctcctggctgccttctcctccagggtccacaagcccctcccaagagtccacctgaaaatgcaagcctgtgtcatgatcgtcttagcagtctggggaacagtggcctgcagaagaccagcagcagaccacacagtgcttaacagaaacatctcagctcttcacaagtagcttaagtttaaaaaaaaaatgttaagatgaaatactgcacatcacatgagtgaagtctcactacaaagacaatgtgcccctcttccccccatccagcaggtgatttacacattctttttttattattattttcctttctcaaagctagccataaaacttagttacaaaatctttttttttttttctcagacaggatttcattatgtcgcccaggctgaagtgcagtggcacaaccacggctcactgtaacctccatctccccaggctcaggcggatcctcccatctcagcctcccaaagtgctgggactataggcacgtgcctccacaaccagctaattatttaaatttttttatatgaacaaggtctcaccatgttgcccaggccagtcttgagctcctggactcaagcgatcctcctgcctcagcctccccaaatgctaggattacaggtgttagccactgcgcccagccttcaatttacacattcttaaacaggtcctccactttgatctagcaggtcagccacaccaacctatagaggaaaacgagggaaggagagcgcctctactccgcaagacaacactgcccttgtgagcagtggctgacaaacaaggatataagaacgtggcggtggaaaaatgtagacttttttttttttactacaacctgccttcattttaagtcagtgagatgccatcagtgagatggcagtaaaatgttttccttttgtcaataaaaacagccatttactgccttctcgaaggctccaatctgctattttcctggtttctcattttgagggcaataggaaatgcaacaaactccaggactgctgctcccagtcaatgcccttttaattgaaataaggctgccccaccagctaagccagcttccaacacagcccggccctgccttcctggatttcctggcaaagcccaggccttctcacacgcactcagggtgatctgagcagaccacaggctgttcatcccawtrggttaaaaagtacttggaracttagttgcagtaaggtcttaggttttgttggggttttttttgtgggaaagtgaaggcatctgcacctgaaatgaaataccagaaagcctccacagcaagcaaacaacaggcacttaggtaaattcagcaggaagtaagaaaaccacaggtactcaggaggattcacctccgtccctcccagggcagaactggccttcagcaaaactgccttacaaagtcatgaatggcttcacgtgccaagcttcaacctttcagatgatttccatacttctccatcatctttggcctggaatcatccccacaatggcaggaaagaaaagagctacccgccatagtggtcctctctgccaactaagagttgcagatgattctggtcagtactcctcagtagcaatgacagcaacaatgacacagtaaacatctgcatttcataatcctggtacaactggctcaccgaagactgccaggatacgcyactctctgctcaaggggaaaatgtatcttccgaacaataaatccttcactaagcagatgcagtgcttgcccttggggtgacagcatacagtggaggatacacccagaatttacagtggggcaaaaagtgtcccatcaggtgctgggagacaggcctcccgaaatctgcagagcctttacatccttgagaggaaaaggcaaggctagagttcggccaggtgagccgtgccggctggtcagcacgggagagcaccactggggccaaggacacagcaggcaggcgggagggagtggcacatggagtgtggcatgttgtcacggggtagctgttgaccactcaggagcttcacactgtaccacatgcctatcctatagggacttgctacaggatttcaggtaggggagctcatcagtccaaagtgcacactagatggccgggcgcagtggctcatgcctgtaatcccagcacattgggaggccaagaccggtggatcgcctgaggtcgggagttcgagaccagcctggttaacatggtgaaaccccgtctctactaaaaatacaaaaattagctgggtgtggtggtgcgggcctgtaatcccagctactcaggcggctgaggcagtagaatcacttgaacctgggagcccggaggttgcaatgagccaagatcgcaccactgcactccagcctgggtgacagagtaagactctttctccaaaaaaaaaaaagtgcatactgaaaagctccccagtgctcggtggagccacaggacacaatagcaggagagaggctatgtcactgctgtaagggggaggagcagaggaacacagctgaagcagcatttccattccattcgggagggaaagggcctggtatccaactggagaaggaagtgtccaaaggacacccacattcctgacataagaaccaggggaacaaaagtgtggcccacttaagagggaatagaaaagaaaaaaaataggcaaaagtgaggaaacagggaagaccatcagaggctgtagtgaaatgctcgtggtggtctgatatgaatgacaagtcctgggttcaaaagggttctgggatggatatgaatgacaggtcctggactcaaaagggttctgggctggagatacttggaagtttaggtggagacaggaggcaatgcagttaccagtggatgagatgagaacaaggaaagtgaaaagagagcccaggacagaactccagccatgctatgatctgaatgtttatgtcccctcaaaattcttatgttgaaacctaatccccagtatgatggctctgggaggtgattaggccatgagggtggagccctcacaaatgggattagtgcccttataaaaaagacgccagaaaaaaaatccctcgccccttccaacatgtgaagacagtgaaaaggtgcttctgtgaaccagagtgtgggccctccccagacagttaatctggtaagcaccttgaacttggacttccagcctccagaactgtgagcagtatttctgttgtgtgtaagccactcagggtatgggattttgttacagcagcctgaatggactatgtcaggagaccaccgttaaaagccagactgagggaagggagacagagaagcggcacctgtgggggtaggaagagactcataagagggtggcgttggaagacaaggaagaagaatcaaccacaccacatgtcagggggtgccacacaactatgttcttactgaaaggaaaccactgtacacagttctttaagggtcaatcgctctttaggaatgactcaaaaatgtataaaatccactcctaaatccaaaaagaaccgagaaatacagaagtgtgcagagaacccacagagggatcacgtccatagagggagtagagtctactacgctgccagacactgcagagtcacggcacagaaggagtttaaaggacagtgccaagtgaaaaccgcgcaacagcacgacaaaatcgagtaggctcaacgatttcacacacacccttgacgtgtttctccagatgttctccgtagttctacagccagccaacagaagattacctgaatgggattcttctgtgcttaatgttttcgaatggccatcttaatgcttatgttgaactcaaggtagccattctgcctggactcaatgcccttcatggagctccccaaatgattcctaagggttctggctggagaggtacatgcggggctatgagcgctgcagtgacgactcagccaaaaagatgatgaggggaagaactcctggtgttaaaagaaatgctctaaagcagcttaccaacacagaatgcaagccacatctgtaattttaaattttcaagtagccacattaagaattaaaaagagtcgggcatggtggctcacacctgtaatcctaacactttgggaggctgaggcgggcggatcatctgaggtcaggagtttgagaccagcctggccaacatggtggtgaaaccccgtctccagttaaaatacaaaaattagacgggcatggtggcacatgcttgtaattccagctacttgggaggctgaggcaagagaatcgcttgaacccaggagacggaggttgcagtgagctgagatcgcgccgctgcactccagcctgggtgatgagagcgaaactccgcctcaaaaaaaaaaaaaaaagaataaaaaggaaacaggcaggtgaaatttaagaacacattttacttaatctaatatatccaaaatgttatatttcaacatgttatcaacatagtaattattaatgaaatggtgtacagagtttttgctatactatgtcttggaaatctagtgtatattttacacctaaagcagtcccaattcggacaagccacagttcaagtactcaataagccacgtggcttactcaataagcggctaccacactggacaatgcaggtctaaatggaatctacgcaaaccaagaggaagttctgattcaactagaaaatctccaagaaatatgcccatgcctgagttttcaggacaaggggaagggaagtcaatttcccggaaagcagttaccaattttatataagtactccattgtgaaatcacaaggaacatcagcagggctgggatggtcaaggagaaggctgcagggcgtggccttggggaagcaggtgaccaaccaacaggtgatatcaaggctctgtctgtcaccagcagagcccaccttctaaccatcgttaacattttcacggtgcttttccttcctccttttcatcttccaacagccctatgaggaaggcaggctttaccccattccacatatgaagaaaccaaggcccaggcaatttaaataacttgctcatttctagtcgccactcttagacttggacccagaatgcaggcctcacccctaccccaggggtcttcaatcagtagctcatcagaaacagccaaaaacctatggcaagaccaaagtaactacctacctagttcgtgaacaactctccacttaatgacgtttcatatggcacctcccttctctaaagagcttatgagttttcaaaacatcctcatgcccatatatgatcaccactaagggatgtactggactgccctagaaatatcctaaaaaagcccaactacagcccagaagggctggcccatccaaggtcattcctggccctcatcaccacattcaacatctcttttctactccatgctgcctcccttgataacaccttttacttttcagataaaatttttaaatgtcaaggttatttaaaaaatatattttgttgttttctcaaaccagtgggtaacttaatgatagggcagttttaatcaaccacacaagtgactttagcataagatctccctccaactccagccaaccttaaagtggcctgactgcattctcagagctctacaaggtactggctgcagccagtgggacccctgccctcactaatcaatgttcacatacgcactgatccaattctgcagaatagaaaagtgcgtggcagatcagggtacacagatccttttcctgcctcaggactggttgaacgggaactgaagggctacctgggaggtctgtcctttatttactttacacacttcacccctgtggggtctcgccttttatttattttaggcaagtctaacaatttggggtttcttggttcttcataactagagaacatgggttccttacatctttaactgggccaacacttaaataatagctatttatagctaacacactgacttcaaaccagtgaggaaaagcttcctagccaatatacataactattgctgaatgcaataaggtgaaggctcagagtcacattttaataccaaacagcctggttcttaaggaactgatcacatgaaggcaagagctcagttattctcaagggaaaataagcatattgcagataaatatacaagaagcttcaaaataccaccatctgacccccagaacagtaaatactttccaaagttccttcactcgtgaaatcttaagattttcacaactgttcagtaaacaggtataaaagaacgaaaacagaatcccagaggtttaaaaatgcaccctgctacacagctacctgcaagtacagcctgaacctgggacttgcagaaatgggtccagaggtctcccacctgggccaggtgctctgtcataaccaggacacctgagtatcataacatcatcactaggacctaaggaccactttcacaggatatgagttagtgctttaccttccctttatttaaccatattccaagtccattcaaactaaggaagtcctgcagaacaaaaaatatcacttcgcacaaaggatgaaagagctgacacataagcagcccccagctgccaaggctcagggacttccaagcacaccaggtcacctttctcatcaggaattcaaagctgaaggtcagcaagtgtctagcccaggagtgtgctggattatttctaacatgtgatttgaacagtcttgacagcagccatgatggcctccagccacgccacagtcccgcaatccaagagtcccagatgcaaaggaaagccaaccaagacccccactgggaaccacttccgcacagcaggcatgccacgtcctaaatgcaacacgactgcaccctgcccagcggaactcgtgcactcagaagagaagggaggtcaaggaggaggagaggagagagagaggcagagagaaagcagcagtcagcatcattcttacttttctggcagcggtttgtggtccagcagcggtagttgtactcattgttgatggtggtcttctcacacatcggcttctcctccatggtccctggacacaggtccccacattcctttgggggcttattccccacaatgtagttattggacaccgcatccaggatcagggaccagtccacagtggagaggtaacagaggtcagcatttttctcaatcctgatggccccccgagtaatgttcctcaggttgtaaagcccaatatccttgagattggtcatctcgaagatgaccagggcgtagttgtagaagagtttccagccgcggatgaccgtgaggttggggaagaggtctccgaggctctcgaggccagccactcggaacagcagcaagtactcggtaatgaccgtgagcttggggaagcggtagctgcggtagtcctcggccttggagatgagcaggatgtggaggtagccctcgatcaccgtgcagttctccaggcgcttcagctgctgatagtcgttgcggatgtcgatgcctggcccgcagactgaagggagacaagagggtaaacgtctcagttagaaggaaataatttttaaactattttccaaacaataatacagttggttttcaggaatcctgtattattattaaagaaatgaggttcaattgttcactgcagagctgtgggttgcagactgacagtttaggtggctaaccagttagctggcatttatacagtgccaacactggaccagacgctgtgcaacacactccaaccgaccatgggagaggccatccccgttaaccgtgcaaactaaagcttacagcccagaggcacacagaggcagaggcgaaagttaaatctgcaacccaggccagccggactccaccaccgcacactcctggtccgttctgcagagcgtcagttgccaaggcctgaacgacagctcag

SEQ ID NO: 1703 - DNA, 14902 bp, Homo sapiens
gaaaaaagttagaaagataaagaaaaattatatgtgttaaaatcaggagaaaattatacataaataaacaacacattgttagctttgatttggagggtgggaaatggcaattgaagccttgggtaagtggcaggggaagaacaaatgagattctttttaaaagaaaggtttctatagtaccaataggagatacaacattgaactagtatacaattatacccagggaggtataactatgtggagaaatgtatgaaaggatgatcacaaacatgttcatattttcaccaggatggtgaaattttagtattttctccctaattttatgcttttctgtattgtttactttttaaacccaaaagaactcctattcttgtatttattcaagaaaattaaatttaaagaaaaatctcctttgactgtgaaaaagccactaacaagcttctcagtgatgctggtaaccctctcatctcaccagcacattccttattattttcataaacagaatgttctctgggcccttggagtagcatagtcacccagtgggttttctagccttacatagcatttttattctagtgtgctctatctcttttttcaccatctgccacattcgctctgacatttctagctcagatggtgcaggccatgctttctccaagcttccaaaaactaccctaacagcatgtttgtaccacctctcaaggaactaactagaatgttaaattctgtagcatgggtgagtgcacctcctttggggtatagtccctttcctttgttaacatgcccagcacttccacagccagcttatgttgtgactaccctaggttattggcttgaaggccaggaggggaggtgggaatagatcctgagggctaactacaggacatgccattacagaactgagctctctgataccaatggagatgttaagatccctgtatagagaagccaggcgggagggcttaaccaccagtaacaagttgggcacagttattacaatgagcagtaaggtcggagtggcagccagaggaccatgacccttagaaaattgtggagtcggttaggagaacacagagttcttaggggcaagatagagaagcagccaacaaaaggattgctcaatctttacaataaaaataaatcaaagctggataatgagagaggctgaggacagctatcctaatcaaaagtcataatccattgcccttttccagatctgagctgttcttagacccagaatttcttgcctgaaggaggaatcaggtccccacaaggaaagaccctgcaactgtataaaaaaagaatctaaaaagatcatgactccttcagtcctttcccaaagagacctatggaaatttcctcaggtaagtctgcaccctggggaaagggtaatactcaaatattttcaggtgtgttggatgcagggtcactatccaagttgattttgaaacttgggtatctggagccctagcctaagactagctcatagcgggtgcaccatgttaatggattcccccatcattatttccctggtcaccaaatgtataattgacatgaacatactaggtagttggcagaacctccacattgtttccttgactgtaagaccagagctatcatagtgggaaaagccaaaaggaaacctctgaaattgcccaacctcccagccaagatatcaaaattaaaaaaaaaaaattcatccttgaggggaaatgacaaatatcagtaccacccttaaagacctaaaagatgcagggatgatagatcccatcaaaaccacatttaatttgccatctggatcccacaaaaaccagatggatcctggaaaacgacagcaaacaatcaaactcaaccaagcaacaatctcaattgcagccatagtgcttgatgtggcatctttgccggggtagagtctcaggcatatggtattcagctattgcgctggatatgtcagtcggaaaaagcatcagaacagttaacatccacttgggacagacaccagtgcatatttacagtcttgcctcagctttaattaactttctcactctccagctgcaagatgtgtacttgatataagcccccagctactgtgctctgaaatctgtccctgtgttagtgctaataccacatttcccactggcttcttgcagctaataactgagtatggtggggatactaagggaggctctttctacaaaactggaaactcttctgatgtgtgactctgcctataggactttttttttttttttttttttttgagacagagttttgctcttgtcacccaggctggagtgcaatggagcaatcttggctcactacaattctgcctcgtgggttcaagtgattctcctgcctcagcctctcgagtaactgggattacaggcacgcaccaccacacctggctaatttttgtatttttagtaaaaacggggattcaccatattggtaaggctggtctcgaactcctgacctcaggtaatccacacacctcggcctctcaaagtgctgggattacaggtgtgagccaccgtgcctggccaggactcttggttggttttgccaaaactttcttagaactgcactacgacctgaaatgttccctacctgcttccttcctttcctctctcctccacaggggttaagcttgcattgcagtctcatggctctcccagcctcctccagccctctccccatttcttgcacccaagcattttcctcaacacacctcttgcacagctaatcccatcttggtgtctgcttctcagaggatcataactgacacaagtaggaagaggaagtctgatacatggacagtcaagttgatagtgcatgggtacaagtaaaaaatgaagtgggctgggcacggtggctcacgcttgtaatcccagcactttgggaggccgaggtgggtggatcacctgaggtcaggagttcgagacgagcctggccaatatggtgaaatcccatctctactaaaaatacaaaaaattagctgggcatggtggcgggcacctgtaatgccagctacttgggaggctgaggcaggagaattgcttgaacccaggaggcagaggttgtagtgagctaatatcgcaccactgcactctagcctgggcgacagagggagactccatctcaaaaaagaaaaaaaaaagtgaagtggtgctgcattatggactcactcgggtgaccgaaagagagcagagagggaaatcgtcccaaataggcagagcttcagtgttgcatctcatcatacaccttgggtggaaaaggtgtttccagtgttagaatatgcaggaattcatggagagtggcaagtgacatgactggaaaacccctcaagaacctggaagaagaaatcttgacagattggagacaaagagattggagaaagggggatgtgaatggaactatgagagtgggcagaaagtgtgaagatctttgtatcatttattaatgcctaaccaggagcacccacaacagaatagacattaaacagctgcataaacaaatgactcagccagttgatgtcagtcagcctgtgtcaacagccaccccaatgctggcacaaaaggcactagaacagaatagcctgatggcagagatgaagtgtgcatggctccagcagcacggactcctctcattaaggctgatctagctactgttgctgccccatgtctaacttgccagcaacggagaccaaagttgagccccggaatcagcaccattcctcatagagaccagctagtcactgggtggtaagttgactacatctgtcctcttccactctgggtatgggtttatctcgcctgcctgtagggcctcaggcaagcatcaccatacaagggcttacggagtgtttgaccactgataaaacatctcacataacatcctatcagatcatgggctccactttacaacaagggaattgcagaaatgggtccattaccatggaatccacttagcctctcacataccagaatacctagttgctgctatcctgttactgaaataaaaatggtttgttgaaggatcaattgaggtgctaacttggaaggcaacatcctccagtgcacactttaaatcaatactcatgtggtgctgtgtccctactaggtagtatacatggttccaggaaccaagttggagtgtttccatataccgtcactccaagtaacccactcggagaattagtactttaaatctacaaatatggactctgtacttataaaaattccggtttccagagagcataggaagagttcctttaaactgaaagctgttgttactgtccagtcatttcagtttcctcatgctgattgattatcaggaaggcgaggagttaccatgggttttctagccatgcaggaagggtaattgactccaataatcagaaggacattgagggctgcacttacatactgaatgtggcagggaagaatatgtttggaatccagcttaggcgttctgtaatattcccttgtccaaatttgatgtatacagacaattgcagcagccatggcccaagagggcccagtgattatgactcagatccttgaggattgagggtctgggttgtctcaccaggtaaaccacctagattagaagaggtgctagcaaagggcacctctttggggaaaacagaacgggtaggggagaagaggaatgacaagtattggttatggcctcgagactagctgtagctgtgaaggttgtagtttatttcactaacgttcctcttgtatatttcctttaggaagagggaccaagcaaaaccccagaagagttgatctcaaagcttattttatgaagaaaattgacctgagtgacacaaagggttggactgtagtagatgtcacgttttgctgcctagatctccatccagggatgaactcttatttcctcagcttctttgtctcctcagcttctgggagggttggcagctgatattctcacctgagtccctttctaggacttgcccttgcctgaagagagctgtgctgcccaacatgatgcctcctccaaggtacaatccacacccagtgactaataaacaggggttacaaaggcatgcctgcttgccccagtttgggacaactttaccaggccaacccagcctcaaggctctccacaggaacaggtgaggccatagttgtgattacatcacaggtcagtttctcctctgcccaagccttcttccttcattcctccacagatgctgatcctgagattcctttccagtaaacttcctccatgcaatcttcatctcaggagtctgtttcctggggaaactaacctgcaactgatacaaatgcctattctgtgagataaaacactaaaagtacaatgcgagtggtataaatattctgctacaggaatacaaagtcaggtatcatttttgacttaggtagtcagagaatggagatattctgagttggacttctgagatactaggattcaataggtgaagggaagatgagatggtataagactaacataggcagaattttgctaaacgaattggagatgaaacatcataagtgcaggtgcacaagtagaaaagtaaaatcagagctcaaggaaggagaagtgatccagctgggcagaaatatggggcctatatagagatataccaggaaataaagccaggacgaatggcagggtaggacctgattgttaagggtcttaaatgctggggtcaagattgtggcccttacttaaaagttggttgggcatgattttgggagttgtagcaaaagatgtggcaaactcaaagcttccttttcatgtaaagtatagagaagtggaggttcatatcattaaatcactgtaatttcagtgtgaacttctaacaatttgagctaaccatgagataggacaccttatcaagcaatgagctcttcattatctaaagagatgctgaatttcaagtccatgtagaggaagtcttgtgttgactagagcataatatgtctggggggacttttcttcttttttactgatatttagtaacttggatattgtgctaagtgctttacaggtattcttatttaatcctcacaaggcagtatggtagataatctattatattgaaaataatgggccaggcacagtggctcacgcctgtaatcccagcactttgggaggccgaggtgggtggatcacctgaggtcaggagttcaagaccagcctgaccaacatggtgaaaccctgtctttactaaaaatacaaaaataagcgtggcatagtagctcacacctgtagtcccagctactcagaaggctgaagcacgagaatcacttgaacccacgaggtggaggttacagtgagccaaaatcacaccactggactccagcctgggtaagagagcatgactaggtctcaaaagaaagaaagaaaataatgaacaaaaaatgttgagtgggcagtattaaattaaaaaaaaacctaatgtattaaagaaggagaaaagtataaaaattagtcaacaagcagagaaagaaagaaaatataaaggtaaaaatgtatgttatccaaatgagacctcttaagaagaaaaaataaaggaaattcaaaaaataagttaggaaatagtgagtaaaattatgaagttaaaaattcaccaaaaatttattgatatgtccaagttcagcttgtagtgaacagactcttcttatgcagaatttgagcaaagtgctaacacaacagagttaggtaatgggatgagggtcagtcagatcactctatttttggaaactggtttcatgactgcttccccttacttagtcataaacaggctatataaaaagctgtcagagtggaaagagggagaggatttgtgaatttttttttttagcatgtttttatggttctgtaagtcaccaccctcccaaagggatgaagtttcggggtgcactccccttacctcagcctagtagggggacttccaggagataatgagagagttggatgtttcctcaaatttacagacacaaagactggtgcctggcttctcctgataaagctaaacctgcatgtggctggtctctagttggctagatagtagtagttaaaatgaaaagaaacacttaatgttagatgccatccaatagggccmcctaaagggatggaargttctcaacaacaagagcccagaggtagaagcaagactcttagcggggaaggatggagtcgcaagtgaaaacctagacaaagaagcatctgtcctggtccagaggcttccccaataaagatgtctcacacaactctaagaagttagaactcgagaaaaagactaacaagaaaaagagtaaggtgtgtttgtggaagaggtgaggcagttgttttcctataaataatgttaaattaaactaaatttggtctgaggatgcctcgtaacttgagtcgctacataacaaactgcaacctaacttaggagtattttttttttgtactaacgaggtgagtctcagccaatcacagcagccaagctacagccaatcccatgtggccaactgakcagcctatgcccagtaagacaactgctcacctgtaactactcaagctgcttctggacctcatttccatttgctgtttataagtgctgcctgcccactttgctgagcagaactctctgaacttctttcgtttttgagggttacttgattagaaaattgttctttgttcaattaaattttgctaaatataattcttttaaagattttcttttaacaacaaagatggggatatttgaacaataccttggttggaggtgacattctaatttctaaattgaggctatttgtatttttagcaggacccaaggactgtcacttaaaagcaggctaaaaagccttgaaattttctaactttccatgcgagagcagtgatagataaccccactacgcaaaatgtcatggggcaatgggagacaaaaactaaagctgtgtttcaactgcgtctctgaatgatacgattatagcacttacacaataaccacttgagaaaaaagaacagccttgcaccaaaaatcgaatgagaagtacaagcacagtgaagtaacaggtcactttacaaaaaaagtaaaggctgaaaggggacgagcaaattgcccaagtctgcatgggtgataagtagcagatctggggctcgaatccagatcctgagcttttaatacctatgcaacacttcctctgttccttcccttctgagaatgtcattatgttcattggggtgtatcccctgctatggtttacaggggagggttcacactttcaccattctgaaagattattttgaatttaaaaagctggcaagatgtctctgaacaatggaacatagcccaaggctgcaattttgttgcacacattacagtgttttaaggccactggtggcctgttctttgagatgaaaacaatrcatcagtaggaacaaagtgaaagagagtaaactggtctccaggtacccaaacagtatgtgaagtcaacagaggaacacttcctgtggtctattaataattcagaagccctttatcctcaaccctcctccactctctaattcctaagtcttcttcctagtgtctcttacttcctctttccaaatagtctgggctggcaggctgcatttaggtaatcactgcacaatacaattactgattctgtttacaagattcttgctagtattttatttttaccctttatagtgtttggcttttaaaagcaaatgaatatggagtcatgattttttggctgcctttccctttggcatatgatatttatgcctttaaaacttgttgttgttccagggcatttcactgatgaaatttatcaaaatgaacctacaaatcagccactaagagactgcatgaataaaaactgttagtaggaaaatgattatgacaaaaaaaaaaaaaaaaaaacaaagaacagctttaagaaaaagccagactgttagtttttttttttttttttagaagggttgatattctgaaccccagcaacaatttatcaaagtctgttgccctgaatgaaattagatttcctttttagcttcaggaataggccattcctggaaaagtggagcacagaaacatttggtaaaaaaatttatttttactcacagaaagagtagtttgcaatgttatttccagtgaagggatgggaaccaggattcagatattcatctgtctacaatactgaggtcctcctacctcctctcctctgcaaagggaccctcgcagtatgcaaaagtattaaatatttttaatgtgatattctttggttaaaatatagtcacattctcattccttttttcaagcataagtatcagtcagatttcagagtataagctgaagcaacaaatagtaacaaagcccatgcatgaagatatgttctcactcatttttttactattttattgttggctacttcttctatttgcgttatatttagtgtcactaagctgctatacacgtactcatttgaagagatgtgctaaagcttttagtgtgttttgctattgattatcctatccaagagtttgggttactctacgatcaagatggcggtctgcagtgagcccacctgcccgccaacctctgcaacaaccagctgaggataattgcactgggctgacgccaaggccatgattagatctgctagtgggtgagaaccatgagactgaacctctaatcccgaacctctcttccaagctactttccaaaccaactgctgcctgcaactccctttgactaaatctgaccttccttcaaactggctctcttcctaatttccagattttatggaggcaatgctgtccagtgcatggagttgaaatgaggctaaagtgggtttgaatccaagctctacatttactgtttgatcttgggccaattatttattcttcctgaggctcagtttcctcctttgtaaaatgtcagtaaagattcctagcatgtaggattttatgcatttaaagagataacatttctaagtgactagttcagtgcctggcacaaacacaggcactaaataagcagaggtttcctccctttcccctaactgtcaatggtactgccactgtgtacagtagccaagttggacatgttgataccaatttttctcttctccccctttcccttaactgaagccaattatcaagttatggaatattagaactagcaagaaccttagaaatcctgaccatatgattcaccgataaaatacagagaaagacataagtcactgatcattgcagcaatcttgacccccacgtcaattaaataacaaaaataatatcattttatgatagaatttgttgctcgacattcgacaatcatgttgaacaaaagaagatcaatcaactataatcagttcagtgatcatgtacaaacacagcttcaggctcacaagtcaagatctattttccaaaccattgtcctatggttatttatgaccgtgaacatttttttggtggtagaatgttccttgtcactggtatattcctttgccctatgtctcttctttctttgtcatttactaacatgaggagagggatctgtctcaaagataattggaggagaaagcgatcatagaaccaaaacaaaggggaaaaaataagataattccaaaggaaacaatatcaatgttttaaagcctaaaaattgactacttaataaattacattacatataccctggaactattttctccatgcattgcatgtgctatagcatgaattcatttgtgttcttctagatagtttatcctaagggaatctactaagcaaaataagaatcagataatagttctttatcacacaactcttcttcctttcatattccatgctaaataatcatgcatgatccaaacctcctatttaacacttcaccctcttcttcctcctatgttccatgtacaaggggaaaataaatgatccatagttaactttttttatgtgaagacaggaagaatatgaatcatacatcaagttagagtataaatagttacgtttataaaagatttaatttcttgaatctccatagtcactggatatgcgtatcatccaaggttctcccaataataaaaccagagccaggaaagaaaaaagaccctgtctttagtgatagcccattgtgctaaagtctacttatttgtcagggcaacttggaaagttctgaaagacctggccttcaaagtttaccattttgtccaccagctcagtgcactgacttgacacgacatgaggcaaacaagtgaggagagtggcccaccacagtctaagattctattgggttacctctgaaacgcgaagacatgctgctcacagaagagaacaatgggtacaaggactgcaaggctgcaaagcttcatcccaacagcaattttctgtacaacaaatttctctgaagagaaaaacccagatcattgattgcataacagccttctttacacactggttaaaatataacggcatgttccctcttgttcctgtgggtcaatcaacttagcttccatttccactcccaaaaagagaaatattattggcttagttaggctgttgcttgataattaaacactcaaaaagagtatgatgagagttgctcttaatttagactatctagaaaatgtgtaactccttggggaaggtagggccaagaataaaagggtagtaatacagtaggatcttgtctggtttattgcagaacaatagctatagaatattgactaatggatatatagcccatgttgagggagatctaccgtgaagtactataaatgtcttcccttgcctctgactttttcaacattttaaatttatgaagacgtaaaaagtgagttcctcaaatctggctaatccaatccaatgttgaagtgcagtttgtaaggatgattacaggatctctgttcaaaaagatgtttccttgaccatatggaatgataggcccacccccaataggaatactatttcatggaagctggttcaagcagtaaagacatcaggttactttgaatctcatttatttaaaggtcaccataatagccatcaattaaatccaggcccatcccctatcatcttgaaagtagcatcaaataacattttgtctagtatgaggccatatcctaccctctgtaagtgagtggagccctcttcccctacattcccattggttaatgcacttgaatgttcttgaagtcagaattggcaaatttgcaaaataaatcagcctgcccacaattaacttctgagaagaaaatgattttttttcttttttcttttcttttttttttttttttgagacagagtctcactctgtagcccaagctggagtgcagaggcgtgatcttggctcactgcaaccttcacctctggggctcaagcaattctcctgcctcagcctcccaagtagctgggactagaggtgtgccccaccacacccggttaattttttttgtatttttagtagagacagggttgcaccatgttgccctggatggtctcaaactcctgagctcaggagatccacctgcctctgccttccaaagtgctgggaatacaggcgtgagccatcgtgcctggccagaagaaaatgattgagatttcaaacttttccttttgagatttaaaactattgaatgatatttaatgaattaaagtgacctccactgtaaccacttgttgtataagaaagaagaagaaataagaaaatatgtgtgtgtctgctcatatgtggagaaagaaacataagaaggatagattagaaatcaatgagactggttatccacgggaggtgagtggaaacacactggaaaagacagggtagaagagacagggagggacgcttctttgggtgaagtgttttgaatagttctgaactttagaactactctgaattttagaaccatgttcttttcacatatgtacttaaaacaagcaaacaaataaattttaaaaaataatacaaacaaaaacgaacctgtgtttcaaatgaataacataatcacactgaaggagagaaagaaaaactaacccaagtaacttttaccttatctttttaacataaaagttaactttaaaataaacagtcaaaatagttaaaatatgctaataaattctatcaatttttgtgctacttattttgtatctgtgtttcttctttattttatgtcctgtttcctctctggggaaacagaaacaggatacaaaagaaacagagtgcataaaaaacaataaattttaaattacatttcttattgctgaagcaatcttttaaaagttcctatagcaaaagtctacaggtgataaaatcttttatgctctgtatctttaacaataactttcttttgccttcactttcaagtactagtttagctgaatgtaatattcgagtgtgacggatgcgtcattgttgtttgacatttcctgttgcatggtaggaatctgctgcccaggtaattgttgttcccttgcagtttagctgtcctttctccttgataacttttaagggattatctttatccttggtgcttctcagatccattactctggtctagatgtggatttagtttttattatcttactcaatacacaggatgtacttttgatctgaggatttagacatttcttcagtcttggaaaatcattttattatttcttcagctatcgtatctctgctagtgccctgtaggggctcctgttggagcttcttgatctatctttcatgtcttgtaactgtcctttcatgttttaaaaactcatcatctttgtctctgtatgctgtattctgggtgagtttctcagcactatcttcaaatccactaatttattctttgagtctaatttagactacatagtccagttgaggtgttttaaataattacctcgatgactatataaatcatttacagctggttcttttgcgtgtttactgattttgtttttataccagtattttaaaatatcatttaagatttttttcaattttttagtcgatatgattcctttagatctctcattgagaatcctcaggatacttattttaaagtcagtgttgcactgctttatgaggttaattatgtttgggtgaattcatgttctgagtattgattttgttagctgcctttattggtatttgaattcttctgtgatttggaactctggtctgcaggctcattttgagtaggaagtcttccttcaagtaggaagtctttcatttctttctctcttcccctatgctcacttctctctgcttggcacatgcctccaagaagtccctgcgcttccattccagagccctgtcttacactggtttttggagcacatttcaaagatccagtcagcaaacagcaatgacttgacttaattattggcttagttactcctggtgtagttattctgtctcatactgactagcagctacttataaaccagtcctaggtaaaagtgagcagcatttttttcctttgtattaaggtacatgcagtgaaatgcacagatcgtaagtgtacagttagattttatatatatatatagaagtgtttgttcagatcatttgcctggttgttagttgggatagtttgtcttattactgatttgtaggagttattcacattttctagacatcagtcctttgtcagatatatgtattgtaaatatatcttcctttgagaagtgtctatcaaattcttttgaccattttggaaaatttagttgtcattttattattaacttgtgagagttatttatatattcaggatacaactcctttgtcagacatatacattgtcaatattttctgacactttgtggctctcccattttttattgatgtcttttgcagagcaaaagtttttaattttgctgagttcaatttatcaatttttctttagtggttagtgccttc

SEQ ID NO: 1704 - DNA, 12393 bp, Homo sapiens
ggtaaagacataaaagaaagagacattaaagacaaaatttcactagtaaaaccaaaaaagaaaagagagtgaaaaatcagagggcagagccttagtgaggaaatccactctcagtcaggaaggcaggcagcaaaaagagaagaaaaacagcacaaaggctagaaggtatctcacaggttacaaaagaaagacttgactgtgttgtgttttaagactaaattgtaaggtaaaaaaggagtacttagaatactaagcagaaaaggataaacatggaagcaaggttcctaagaaaactgggtaccaggtaggatttatgttgacaagcaacttattaacttggagtaacaaccaattctgtttcatttctaaatgatttcttaaccagctagcatttaatcatatcttaagaactctataaacaatagcaaaattaaatatataggtagataatgaactgccaaacaagaaatttcactggcagcattcctggtatgaagtaaagatactgtcttccaaattattcattcaaattcaatagaaagaaaagtaagtggccagccacggtggttcacgcctataatcctagcactttgggaggccgaggcgggcggattgcctgagctcaggagttcgagaccaggctggccaacatggtgaaaccccgtctctactaaaatacaaaagaacaattagcggggcgtggcggtgtgcgcctgtagtcccagctactcgggaggctgaggcaggagaattgctagaacccaggaggcaaaggtggcagtgagccgagattgcaccactgcactccagcatgggcaatagagcaagcctccatctcttaaaaaaaaaaaaaaaaagagaagaaagaaaaaaaaaaaaaaacagaaaaggaagcctaactttttttttctttttttttttttgagatgaagtatcactctgtcgcccaggatgcagtgcagttgtgcaatcttggctcattacaacctccacctcccgggttcaagtgattctcctgcctcaacctcccatgtagctgggattacaggccaccgccaccatgcccggctaatttttgtatttttagtagagacggggtttcactgtgttagtcaggctggtctcgaactcctgacctcaagtgatcctctcgcctcggcttcccaaagtgctgggattacaggcatgagccgcagcacccggactctgactttttatttttatttttgaacatggttcttgctctgtcacccagaatgaagcacagtgtcaaactcacagctcactgcagcctcaacctcctgggctcaagcaatcctcccacctcactcttcctcatagctgggactacagacatgcgccacaatccccagttaatttttgtatttttatagagagacaaggtctcactatgttgctcaagctggtcttgaactcctgggctcaagtgatccactagccttggcctcccacagtgctggaattacaggcatgagcctctggacccagccttagagcctgacttttttaagtcttggaattctatcagttgaactagtcaaagaaatatactaaatagggaaaaaaatacataggccagttgcaatatttacttcatcttttccaagaaaacttaatgtggacagttggtctaacaccaatgtggaccaaaatattagaaataggccaggcatggtggctcatgcctgtaatcccaacactttgggaggccgaggcgggaggagtgcttgaccagactgagaaacatggcaaaactctgtctttaccaaaaaaaatacaaaaattagccaggcatggtggtgcatgcctgtagtcccagctatttacaaggctgagcccaggaggtggaggttgcagtggggtaagactgcaccactccactccagcctgggtgacagagcgagcctctgtcttaaaaaaaaaaaaaaaaaaaattggaaacattaatgaaataaaaattaaaaagtggcggtgtgtttataatgcctaataaagaatacaacagacaataaatatatttacttattgaacctatcagtaacaaaacaaccatgattcaagaaaacaggttttgtgtgtggggggggtttttttttttgagatggagtctcgctctgtcacccaggctggagtgcagtggcaccatctcggctcactgcaacctccgcctcccaggttcaagtgattctcttgcctcagcctcccgagtagctgggattacaggaggctgccatcacgcctggctaatttttgtatttttaagtagagacggagtttcgccatcttggccaggctggtcttgaactcctgacctcgtgatccacctgcctcggcctcccaaagtgctgggattacaggtgtgagccaccatgcccagctgaaaaccgttttcctaagtctagcttataaaatatactaattgattatctttaaataactaagttggccaggcatggtgcctcacgcctgtaatcccagcacttttggaggtcaaggtgggcacatcacctgaggtcaggagtttgagactaggctggccaacactgtgaaaccccatatctactaaaaacacaaaaattagccgggcatggtagcacgtgcctgcagtcccagctactcaggaggctgaggcactagaattgcttgaacccgggaggcagaaattgcagtaagccgagattgcatcatttcactccagcctgggtgaccagagggaaactatatctcaaaaaattaaaaaaaaaaaattaattgaataaataaaataagttatttacagcctttttttttggaacattgaaagggcaactagctacaaatgagagaaattcagtgcaatacaggccctttatactataaatattttacagcagtgaaacgtaaagagagcgcaaaatgtttttgccattcagttcagtctacctctaacctttccgactcttttgtgagaactgataataaaacagagaattttgaaaagaaagaaaaaaaagctatttgccaaaaatatctcccttggaaatgcattatcctcagaacagcatccagcccatgccacaagactgaaggcattttctgctctagcgcagaactacttctccagatccccttcctcaagaaatgaagtctacttatttttgttccacctcaatagttgagagtactgaccccagaaactacaggaatcagcagtatgctagaatcaagatatgcacgaattttacctataaaattatcttcttttctgtgtgaagggcagaaatgaacagtgtaacctttatccattctcccagcttgagccaagatgatacttcagacacccgtggcaggcagcctagtttgttgttgttgttgttgttaagatctttgcaggaaatcagtttacaaccttgggatgtttttaactctaacatgcgcaaagtcatcttaaatgtctcacaagcttccgcttcaggaagtcatcttttttaaacttactaccactgaaaggctatttctcctaaaactgactttgcttgatacagcagcgatacctcattcttacacaatgacattaaaacttagggaaaaaggaaatacagctataaagtaaatgacaaaaacttgaacccacacacactaacaaaactggtttagggcctcattttaaggattctcacccttccttttgcccaagaatcttctaggcggtttactaaaaaagtggctgtcctttttcagacctcgattcaggattcagcttcagatacgtggaaactagacattcctaaagattctcaccaccacataaaactaaaacaagctctttactgctcaggattacagggcaatttccagcaattacagtcattcagggattctaggacctgcctgaactgcacgagacccttactacttcacactctccatctccccattggcttttgacattttccctgctcaagggccaagcagtatttgaaaggctgagggaaagatcgagacattaacttctcatggacagctctaattaaaaaagaaaatgaaaaacttgtagagtaagaaatccattttcctttaaaaactacaatttatgattagctgagcctcctcccatcaccaaaagttggcattccctccactctacccagacgttccctgttcataacactgtttcatcacgtcatattatcattgtgacttcttcctccactagaggacaagagctgttttgtaatcagcacccaccaccatctctattacatagtaggtgctttaaatatgttcactggcttttattcttgccctgtctcccaatggataattaatattctattggatctgtcctggcataggtaaaaagttatcttatagaaatcagttaccgggttatagatgatattctgtaggttgtttaaggacaacatcattcttttccagcttcttgtcgattggagtctcttctgtgtatgacctaagattttaggcaagtttcatttaaaggttacctggattgaaactgaggcactggccctgtgtaaagtaaaaatagaggaaaagaaaagtaagcatgtagcatttttcttcatatcctattttaaaatttaaattatatattatgttactgatatttaccaaataatagaatattattacaatcaacgatctgcctcccattcttaccagtgtgctcatatactaaataattttggattgtgagtgtaggaaatattgacttaaaaaatacatcagtagaaaatttctaacatggaatttattattaaaaatactaaaataggccaggcatggtggctcacacctgtaatcccagcactttgggaggccaaggcgggtggatcacctgaggttcaggagttagagaccagcctgaccaatatggtgaaatcccatccctactaaaaatacaaaaattagccagacgtagtggcatgcacctgtagtcccagctactcaggaggctgagacaggagaattgcttgaacctgggagacggaggttgaagtgagccgagattgtgccactgcactccagcctgggcaacagaacgagactccatctcaaaaaaaaaaaaaatttaattaattaatggtaaatactaatcaaacagtcccgtacaattaccagaggtattcatttagattttcatttccataaaatgagaattacagtattcacatcattggtttgttctgaggattgagttaataaaacagcgaaagagtaagcgctatgttagctattattattgtgaatagaaagaattgctcttcctcctccaatttaaacaaatcaaagtagggaaaaatccaatacttttaatactattaagatacggttttctctgttgcttaaaaaaataataatcacagggcaggggagtgttggaaagcatcagccacattttttaagataaaagcactcatggacactacactacatttaatagctccaggaaaaactcgactttaagcagaactaaaggggaaatgaaaccagagcttcctgtattttacttccagcaattctgtcattatactgcacaccaacaatacacaccgatcaaatctatcactttttctttattaagaaaaaaaactgtatccctcttggtttaccacctaaatatagccccatgtcattaacttaattcgttagtcaaaacctcaaaactctggctccgtgactcaattcaggaagtaagaacaagagcaaaaagaatggatgccgagttgccatacacatgtataataacaagccagtgacccaatttaagccatctgcttgcattaaatcacgcaacccccgaagtatccccagggacaggtcccgccagcatgaacacttcgtatgcatcacaagcagccatcacttaagtttcacgtacggtcaaaggaagtcacatgacttgcgctttgcaatgtttaacactgcagtcaaatgactcggcatcctaaagagcgtgttagaggcagggaacgcaatggaggtcactccacygtcactacaaattccgggaaggaaacttccccagattcctccacttggaggtggcgctcggcctcaggctaggagggaacaggtgagaaagcagcccaggtggggtgggtttgcagcgaggagacaccccagggcaaacagcctgaccccagccagggatgtccaagaaaggccgcgactcctgataatcccttatgccccggagygcctcgcctgcagaggcagcgtccccgccacccagccccggctctgccgcggtgaggaccggcgggtcggggtggactggacactgtcccacccatcaaatggtgatttaggagccgtgacatccgaatgccatcctccactggcgagaccctcagagcagccacgcctctagcgactgccccgccacccgaggccgggggtcgcgcgactcacccaaagactggtgtttcaggcgctccacggagcaggttgtttgtcagcagctaagtgccgtcagggttcccggctctggcgtccgtgggcggctacgggaagcgacaggagtcagtcctcgttcacttcccggctcgcgcgcctcactgctgtggtctccccaccctccccgcgccccgccttctgtgtctggggcgtccctggcggctctgctgggttttggacagggacccgccgctgatcgccacccagctcggcctcctgcacagcctctggagccttggaccgcgactggcttgctgtgggacgagcacagagggataaggacaaagaatgtgtcctgggtggatctggctgcctttgcccggaaggcggagtggggtgggaggtggtaggaaaatgggaaggaaagaaaagaaaggtgggccgacgtccacctggctgttccaggcctccaggtctaggagggagggcgctcggggctgggacttttcaggaccagggtggtcaccgcacaggccccgcctgcctggaccaagcgctggccttcccggggcgcccaggtccacggggtcaacgccagggttttctcagcttcctcgtctgcctcggatccaagtccagacagtgccagaagagacttggaggcgctgctttttgacagtacacacctctgtatgcaggtgaaacggtgggggaagggttcagtacgctggactgtgcccagcccaagctccccatccgttagtgataacttggactcgcagccactccgcgtcactcgccggttatcctgcgtgtgggtgttttctccaaattggacacttagggaacagtttaagcagtatggagcacaattctgtgcctattagatgctcttaaatacccgacttctcagggccctacactgactgatagtttgacctattggctgtaaacacaccagccagaaatacaaataaagttaaacaaagtcatgtcagccacttggaatggctggctgcttactgtttattttgtgttagggacctcaaagttctcatcttctctacttggcttttatccacatttgtttggaaagatatattttagtgtcattaacgtgggctttctcctccctggcttttgttttcattattttttgttttaattgaggaattcattacaagtcccataactgggaactcatgttctgattcactgttgcttttctctcctccttacccattttccaagcctgatgcacttctcaagatccaatctgaataggtgaatttacccttgacatacactgccttggatttatagctgtcttttggtatgtgttgtgtgttttatctatccaactcgactgtagtttgagaaaaggaacttgtcttatacagtctccagtgcatagtgtaatgctttgcataaaatagatatcaatgttaggttgaaatgttagattattgataaagtcaggagcaattgaatatcttcacaattctgcctgagtctccccccagccccgccactttgagacagggtttccctcaagtgatcctcccacctcagccccaggagtagctgggactatagacgcacaccactatgcccagctaatttaaaaatttttttttgtagagacagggtccactgtgttgcccgggctggtctcaaactcctgggctcacaatatcttcctgccttggcctcccacaatgctgaaattacaggcatgagacaccaagctgggccctgagtcaaccttgtacttctttacaaagctaaaataagttgaaataagtacacataaatgctgtgtttcttttgtaagtcatatttaggtgcaaacggggctgagtgaaagggccagagagcagagttaacaaagaaaatctggattaaaatgttcataaatcctaagaacttattcctagaaatatctccctcatttggcactgttgttcaattagcccagtgtgttattttaaataagcaaatattcactgaatgcctatcatggccaggcacagcagtaaagaatactagcatgcaaaggacctcatgggcccttctagatagagtcccacatctcttacattattactgcagtatcctaatcggtctccctatatttgcccttgcccctctgcaatgtagtctcaacacaacagccagagaagtcatgacaaaacataattcagatcatgttaatcccttactaaaacctacttttttttttttttgaggcagtctcactctgttgcccaggttggagtggagtacagtgttacattctcagctcactgcagcctctgcctaccgtgttcaagtgattcatgtgcctcagcctcctgagtagctgggactacaggtgcgcgccaccatgcccagctaagttttgtatttttagtagagatgaggtttcaccatgttgcccaggctagtcttgaactcctgacctcaagtgatccgcccgcctcggcctcctgtaacctgggattgcaggtgtgagccactgcatccggccaaccgtctactaatttttgctcattctttgagtaaagatccagttcttacacgagcacttcctgatctgcccgaatcctcacacactgtgatttcatctcctactactttccttctcactttttctgcagcagccacagcgactttgctattctcctagcaggcctgtcacactcccatcctaaaatctttactcaatatttccttttcccttttcaagtctactcaaatgtcagttctcagtggggcccttcctgaccaccaatatttaaaattgcaaacactctcccaaaacacactcatacacactccctagcaactcttccttgctttatttctggctaacatttgtcatgctaatatactatataaggtgcctttttattttatgttacttcacccatcataagactataaactccatgagggcaaggagttttgattgttcttgtttcgaggaagcttatactctagttgaggacacatacagtgatgtgttttagagaagattaaattgggagcacctgagtggcaaccttagttgggtgacaaggaaagtctctcagaggagtcaaagtttaagctgctggtgagtgaaagaaaggaaacagccatatgaagatggtggggaagagcattccagccttagcgagcagctgctgcaaagtccctgagggtcttgagaatgcattaaatgtgttcaggaaacaaaggccaccaaccagtatggctgaagcatgagggaagaatgatatgacatcatgagattggatggcaccacctaggagagtagtgggagaaaatcacctcggacagccctggggagataagacaacgccaataaatgagactgagaagggacaaccaggggaatttgctgagagtggtgtcacagatgccaaagaaagagaaacagcctgtgtgccaagtgtgctgagaggccaaggaggacggaagtaagcaatgggcttaggaacatggatgtcattgctgactctgactctgaagtgtgttgagaaatgggaggtgaagaactggtggaaaccatgactataaagatttcagaaaggtttgctgtgaggaggaatggagaagcagcattatagctgaggaaggagtggagcaaagggcagattcaggttttctcctgttgtttttttttttttttaaagagaagatactacattggtgacttttagacttcttttttttcaagtgacctgccataagaattacatttccattgagacttactacacacatacttaaaattacgaaaacaaaaattttgaccaggcacgttggctcactcctgtaatcccagcactttgggaagccgaggcaggtggatcacttgaggtcaggagtttgagaccagcctggccaatatggtgaaaccctgtttctactaaaaatacaataattagctgggccttgtggcgcatgcctgtaatttcagctactcgggaggctgaggcatgagaatcgcttgaacccagaaggccgaggttgcagtgagctgagattgtaccactgtactccagcctgggcaacagagtgaaactgtgtctaaaaaaaaaaaaaaaaaaaaaaaaaaattgtacaaaacaatactcctgttatgtgtaaaacaatctactttttcattttaaaaaaatgctgcttatagtccactaaaatgtttgcaagccccactaatgggctgtgagctgaagtttgaagaacactgggtagtatgttggtgttagctcatactggcttgtgacagccatttttgtacataacttccatgttgataccttgaagttatccagggcaactgctagaacttaggaactttttcccccaaagaacaagatcttaaacatttaccagcacgctactgactttactcatgtgaatgatccgtggagaggagaaactgatcatgcaggagaggggatggtgttcccaataaaagttgcgaaaaccagtttcagaacaatagatactgccaattatttgccacaactgcctgagagttatgcagataaaaggatcacttctggtaggatcaatttctttttcatctatattgtcctctttccttgcccaagaagccacatttatatggtataatatagccacacatttagaaatagtctttttttttttttgagacagagtctcactctattacccaggctggagtgttgtggtacaataatggctcactgcagcagtgacctcctgggctcaagtgatcctcccacctcagcctcccaagtagctgggactacaagtgcacaccaccatgcctgactaattttttttttttttggtagtgatggggtcccactgtgttgcccaggctggtcttgaactcctgggctcaagcagtcctcctgcctcaacctcctgaagtgctaggattacaggcatgagccaccatacccaggcaaaattaagtcttacaagcaaaatgttaaattatatatatagagcccacattttttaaaaaactagtaaaaaaatcatgattttagacatgaattgtaagctcttgctacttagcagggttaactgattaaacagaaatagatgccatattctatcgacgtgaaccgtattgtttcaagctaaggaatactctggcagtgattttgcttattgttttgttgctgtgttacttttgttaacatgattgtaaaatttttggaccccctctccaaccatccatgaaatagcggtgctaagtgctgggaaaatgtgctccaactcaataattttggaatacaagttagatatgataaaagagtatcaagaactttaaagaactgccttggtatgctgtgaatttagaaaccagaactccgtcacagaacctgtgacaataatgataaaaaaaaatatgtgaaagcaaaaatttgccacaatggattatacatttgtgagcgccgagaacacataccctgctattctcatgagaaaattaatcaaaatatgtaggttttaaattatgcaacatcttcaggaatgcattctttacaaaaccacaatactcacatccttatacatacatctgcttccccaggaagtgtcatggacggtgtcttctacctcttccgattatcttccccaatctaaaggaattcatttctcctttgaatcctcttgctttgacctaatctcccctacaccccaatactagccccatccatgagcaccaaactcttttttttcaccctccagaccccctatgatctgattcaccaggcttacctccgaagttctacaggatcatgtcccaaatccagtcttttcaggtgggagaaacaagcttctagaactatggttttgtcataaaataaaagaatcttagtgacgagagggatcttaggaggagtataaattaattcatctcaatagctcaaaggatgagatagcctattttgtgaaata

SEQ ID NO: 1705 - DNA, 32733 bp, Homo sapiens
gctggccgggcggggggggctgaccccaccacctccctcccagacggggcggctggccgggtggggggctgaccccccacctccctcccggacggggcggctggctgcgtggggggctgacccccccacctccctcccggacagggcggctggccgggcagaggggctcctcacttcccagtaggggtggctgggcaggggcgcccctcacctcccggacggggtggctggccgggcagggggctgacccccccacctccctcctggagggggcggctgccgggcggagatgctcctcacttctcagacggggcggctgccgggcggagggtctcctcccttctcagacggggaggctgggcagagaccctcctcacctcccagacggggtcgcggccgggcagaggcgctcctcacatcccagacggggcggcggggcaaaggcgctccccacatctcagacgatgagcggccgggcagagacgctcctcacttcctagatgggatggcggccgggcagagacgctcctcactttccagactgggcagccaggcagaggggctcctcacatcccagacgatgggcggccaggcagagacgcccctcacttcccagacggggtggcggccgggcagaggctgcactctgggcactttgggaggccaaggcaggcggctgggaggtggaggttgtagcaagccgagatcccgccactgcactccagcctgggcaccattgagcactgagtgaaccagacaccgtctgcaatcgcggcacctccggaggccgaggctggcggatcactcgcggttaggagctggagaccagcccggccaacacagcgaaaccccgtctccactaacaaaatacgaaaaccagtcaggcgtggcggcgcgcgcctgcaatcgcaggcactcggcaggctgaggcaggagagtcaggcagggaggttgcagtgagctgagatggcagcagtacagtccagcttcggctcggcatcagagggagaccgtggaaaggataattccactattacttgtcttttggggtttgtttttattctctctttgagttttgtttccttatgcgcccagttacttttgaaaatgttctgggcagatttgcctagattaataaatgccctccatgttccaattacttttttttttttgagacagtgtcttaccctgtcaccaagctggagtgcagtggtatgatcttggctcactgcaacctctgcctcctgagttcaagtgattctcctgcctcagcctcccaagtagctggcattacaggcacctgacaccacgcccagctaattttttttttttttttttttttgagacggagtctcgctctgtcacccaggctggagttcagtggcatgatcttggcttactgcaagctctgcctcctgggttcacccattctcccgcctcagcctcccgagtagctgggactacaggtgcccgccactatgcctggctaattgtttttttttttgtatttttagtagagatggggtttcaccgtgttagccaggatggtcttgatctccggacctcgtgatccacccgtctcagcctgccaaagtgctgggattacaggcatgagccaccgcatctggcctatttttgtatttttaatggagaccgggtttcatcatgttggccaggctggtcttgaacttgaacttctgacctcaagtgatccacccttagcgtcccaaagtgctgggattacaggcatgagccaccgtgcccggccccagttatttttatttttattttttgagttagagtctcactctgtcacccaggctggagcgcagtggcatgatctcggctcacagcaactttctgggttcaagcagttctcctgtgtcagcctcctgagtagctgggactacaggcacacatcaccacgcccggctaatttttgtagttttagtagagacggggttttaccatattggtcaggctgatattgaactcctgacctcaggtgatccacccacgtcagcctcccaaagtgccgggattacaggcttgagccatctcgcccggcctacttagatgttatattagtggtaattcctgttatcctgtgagctctttagtgtctaaacaattttttttaagagatggggtctcactgtgttgcccagttgcaatcatatcttactgcagcctcaaactcctgggtcaagtgatcctcttgccttagtctcccaagtagctaggaccataggtgtctgcccccacgcctggctgtttttacattttttgtagagatgtggcgggtgggggggtctcactgtgttgcccagactggtctcgaactcctgtcctcaattgatcctgctacctcagcctcccaaaatgctgaattacaggcatgagccactgtacctggtcttaaacaattttaaaataacatttttatccaggattttagttaattttcaacaggtggattagttcttgctgtattctcgtaaacagaagtcctggtttatttttatttgttttaaacattgaatcccatactcctccccaccttaccctacccagaatttagactgttaatgttttgaagccacagcctgcatcttaatcactattttatcttagtgcctggtcttagaaattatattgactctttgatagaccatatataaggcaggtggatgagaatgtgggtagctagttggaaaaggctgcttggtcatttgcttgattattttctcacacagtttttcctttactaagagaaaatgcccccatattggcaaacaaaatctccctgcctgagagcgcccagagtatagcagagcatcttaccctgatacgcctcttttcactctcttctctgtggagacagaaggagcttcaagagcagggggagatcagaatcgtccagctgggcttcgacttggatgcccatggaattatcttcactgaggactacaggaccagagtatgtgactgtgtgcgtcaggggtgctggggggagggcacaggttgggggagacagggaagttgggaaacagaaataaaaacaaaagaaagaatttccctgcccccacatcccatggagagggcacagggccctggtaaatagtaatatgagggagagagacaggagggaaagagggaggagtgagagggtaaagagggggggagaggagggggaggaggaggaaggaaggagggggaggaggagggggggaggaagagggggaggaggatgaagaggaggaggaagaagaagggtatgagaggtggaaggatctgagcaagaggtaagacaggaagagaaatgctgtcctgggggtggaggttggtagagagtgagggtggggatggaccatgtctctcatctctgcttgtaggtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttctttttaataaaatgacccaagtttgtattcctccccacaagagaggaggcctatcttacctgggccttagaaagagccctgaaatagaattcagttcttggtggcttatcaaaagcacacaggggcctggcaggaagtgtaaaagcttgatgttaatcatactgggactaagaggatagagaatggtaggagctgggatacccctaaacattcacattaaaacaaaaaaaacccaaagctaaaaaacaactgggcaggagctaaataaaaatctaattttgagaggctgtatctggctcaggcctcctactttgtaacccatggaatatgtgaaagcatttgaaaaactatagcactgatctcacatgggcagacacactctcagagagatgtggtgggagccatggcgcagtctgcctaggcagtggcaggagcgcagaagactctgattcctctcctcggtcctaagaccgaatgtgtgtcaggacatgtggtcagggaagagaagctatttaactgaaccagtaatagtagcaggaaaagaaaaagtggagggagggcagtccaggtagggggcctggaacaagcaactgcaccaacagaggcagttggtgcgagcacagaaccaccccaggctgggattttgttatccagtctctcttgcatggttgcccgtgtttctggagacttgtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaaggtatcccatctgcagctcaagcctgcagcccctcaccttttggtggctcctcaggcctctaggccttattcacctttcccctttcctgtgccacttctcctctagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactggtgagtctttccctggcctctggcagattatggagcaatgacccaaagtgggatttcctcccagctcatgcttagtttcctagtgaaggccagtggctctcattcttctctggaacccgggagcaccccttcccaagttctaagttctcctcacagcttgagcctaggcgtctggctccagccttgtctttctcctgcacagcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgatattttctggatgtcctttatttactgtgacgtgtgtttgggtgccttgtttaggggtagaggtgaagtctgagctttgcctcattcagagaggaaaggggtcaggggttcactctgacgttcaggccattctccctgtggagtggtgagggtgtacctaatctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggtcctggaggcgggatgctgggtgcttggattggggcagggctggcatcgggacccgattcaggagtgagggagagcaggggtggaggtgtcagagcgaagtctgactgctgawcctgtcykytctccccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtaaccagaccccatgccctcctgctgcttgtgggggcctcctgccctgttcccatctgtcttgtaagtgtcatcatcttcccactggcctcctcccctcctgtcttcccaccctggcattctccttccacgtttctcccttggtctctgtcctttttggtcagctgtctcttgctctgtgacccgctccctctccctctccctctcctgacaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcggggtgagtctcagccccagggcctcaacctttaaccccctccgagccctctcaggatgagtttggtgccccctaagtgagataacctgaaagaaagtgccacacagaaggggtgcttaggaaacatttgtcccctgctccctctgtggagtttgacccaccctccccttgcacatggacccctgctcacctctctcctcctccactcccagttcggtaccgggtctttgctctggatcagaagatgcgcccgagcactgacaccatcacagtcatggtggaggtgagtccccgacctctggmcttcctgatcctggccactgatgtgacctcctgcctgtgagcacttctccccttgcagaactctcacggcctccgcgtgcggaagaaggaggtgtacatgccctcgtccatcttccaggatgactttgtgatcccagacatctcagagtgagcgctcccaatgtgggggctgcccccaagctacaccaccccaattcctgttaggctctccacctcccacacagaggcacgtccccagatgccctgaccctcagcctcctgagcctctggttaacccccacagtcctcttcccagggaagcaggctgctggctctccgtgccccactgtacagatgggctgagccccttccttgtccattctcaggccagggacctggaagatctcagcccgattctcagatggcctggaatccaacagcagcacccagtttgaggtgaagaaatatggtgagagctggaaactggagggacaggcagctgctttcctgaaggaaataagggtggaaggagaggtactgggagcagctcagggcagggagatatgggtgccacagccctgagcagaggggagtctttgagctggagtctgacctgcctatcccttcaccctgggtcagtccttcccaactttgaggtgaagatcacccctggaaagccctacatcctgacggtgccaggccatcttgatgaaatgcagttagacatccaggccaggtaatacctccctccccacctctgcccaccagcaccgggtcctgctccctactcagtatgaatgggctcctgcttccctgccctcgggccattattccccccagcccttggcccaccctcttctctctgccacgacaggtacatctatgggaagccagtgcagggggtggcatatgtgcgctttgggctcctagatgaggatggtaagaagactttctttcgggggctggagagtcagaccaaggtaggaaggagaataggggctggggaggggaaggggcaagggaggtgaggtgggagactcagtctcaccctatgtcctgtttctttctatgccccagctggtgaatggacagagccacatttccctctcaaaggcagagttccaggacgccctggagaagctgaatatgggcattactgacctccaggggctgcgcctctaygttgctgcagccatcattgagtmtccaggtgggtgactttcccttattgtaaccccagacccttgcctctgacctctgagctaaccctctgtcctccrgcaccaacaccaccccacttctcacatctcatctcagactcaaaaccaggaaacacccaggagacctggtttctctccaactctgtctctgtgactcggcccttttccctggctgagtttatttatttctttgctcgttctgctcattccttcactcctccagtggacatgtgttgttcaatgccccgtgctaggcctcagcatgcacagacatgttggggaccagcctcaacgccacccgtagggttcctgaagtccattggtgacacaggaatgagaagagacaggttaagagttcataaagagtgggggccagggggccaattgcaaaatggaggctgcaaaaggctcagagctctggtctccacactattttttgmgtacagtcactcagatctaagaagcagatgttcagggagaaacagtgaaagggaggcagtgggtcataggcgtaatctatagcaatasagttttaaatgaatctcctttgtgctcaaacagcatgtctttaaattatcggagagtagctggtggaagtgggcttagctagragactgcatgtctgtccaatgcttcaaaggagggtctttctccttgaacacagtgtttacagataagacagggggtctcactctgagcatgggaacatgatggcaattaggaggcttttcttctcagaggcctcttgtggctttccacaayttattgtctcatatttttatggmcagtttatacaggcaccccacaagtccttttcccaacatgcccccctccstttttttttttttaaccgctattgctattatggcttatttgtggtgtttggtctgttttcagaagtgtcttttgcatctgtagactaaaagtaaacagcataaacagatacacattaaagtaaaatttgtaatagttgatcmtttaatggtcttaatctgtttaagaggatttatrtttgaaagtccgtcagtagctccaatgagaatgtcagtctcaggcaggagggttaaatgagcctgagatgctttaaaaacctgtttttttaaaatttggttatatttaatgttaaatttttatttttttcttttagatgatgtctaactttttaaaaatgatgtttagtagtattatacgaatggggagttatgtagaaattggaagtatttcaattacattgtacttctaattgatgttttaagtttattgtacgatcttccatttaaataacagtctgtctaagatcatttgtttgatttgtcaattgttggtctatttgggtctgagaattccacaattttgaggaattttttgttaactatttatatattttgtagtttgaacagaggagtgtaaagcaattccagcagccgcagcagtagctgtgactgcaataaggcccataagactgttataagggtaaaaataaatctctttgttttggtaaacacttttttttaaaacatttttgtgacaatatgaatggaaggagaggctttctaaggtctattgagggaaaccagtatccaaactcctttcttagtttttatcagtaacacagatgtttttacaccgaacgtggaattaatacaggtgaaaaggtgacagttttgacaagtaatagtttgagaattaggtcgaatgtcaatatttttgaccattaacataaaaggagggttgacacaactctgaatgggcactgttttgttggaagaaaactgatacgcaaattgaagtttttaaccttttttttttaaagataatatatttttttctaaacttaaatatgagattgggccattattaactttcataatttggagtgtttagggcctattattggattaattattttgggatgtgggccagctgtactaaaattggtccaaattatgggaaaatgagcacgtttttcagtgtaagtagtgttacctttttgatagtatagtttctgttttagttttgtcttgtatttattattttgatgggtacaattaactgtaaaggtcccctcaggggaccaattaatgacaatttcataggaattattttgtagtaccatagtgtgatcagagatgtaattttttttaattaatatttttaaattatttgaccattgttaaggttgttggcacctcttttttgggggcttaaactgttaattgaattgaactctgtgaatgatccgggctccatccagaaaataaatgataggatactggtctttgattatgacctggaattttaactagtcaatgttgtcggtagccttttaggcaaccgatagttggccttatgtaaagaggggggaactgataacctatggacacatttattaacttttttttttttcctttgggtgagagggcccatgagtatttgtaggcttagggatccaaacgctattattaacataaacttcaactgggggttttaaccatgtgacaggcctaattaaaggcaggaatgggacacatgcccaataggtataattttgggctgttgtagccacaggtttgttaggcgaggaggtcactgtttttattttggctttgtattctaggattagtaaataacagaagacaaacatgagtataattagtaacttttttttttagtaaaagagtgacctgtagtgttacttggcatcttagtttactatatgttattaatgaggaaccccactgggggtatgttaatttattctagctaagcagttatgttattagaagctgagaagggggtgtttgttaaagtaacagggcagaagaaaggcggatttaagatacgagcttaatacagtgtagcaggtataggtagtaggcaaagtgagagaattaaaaatgaataaattatttggcttagacttttgtttttttagtataatgtctgaggcctgtgttgtttgtggaagtcgcattgttgaggctgtagttcctgtagggtcttttttaggctggttcaaatgtttttttattttttaattttttatcctttgatgaggatgtagtctttaggctggtactggaaattttaggagtggcgtctgtgttaagagactttttacaatttttaaagagcaggttagtgttttaagaaaaacttgtgttttattttaatgtttagtttatagaaaactggatgatatctttttaactttagtaaataygtttacacacggaattttttacaattatcattttaaaacttgtttagatctttaaaacaaaattaaacaaccttttttrtataaattttttataactttttttatgacttttacagacaatttttaacatgtcttaactttttatgttttataatttttttactaaaggtacatttttataactttttaaatttttttacttttttgtatttttttgatttttgtcttagtcttttttttacttttatttttttaaatgtgtaataattagatgagtgttggtaacaatggatrtatgtacatattttagtttttaaaatttagggatgtgtttaacatctgtttgccagaactgactaggttccaattctttacggttaacacctattgaaggagggtatgtgcctgtgagctggtaatctgggcattgtgggataatttgtttagccagcctctgtgtaagttgaaattatttagataagtttctccaattttggtggaataatcgatgtgattgggtggcttggtcaagcagtgatgtcataacctgaaggtctgcttgattattgccgtaagccaatgggccaggcagagagctgtgggctcgaatgtgtgtaataaaagtaggatgtgtaccttggtctagtaattgttgaagttgaagaaaaagaccacacagagtgggctccagagcaaacttaaggctgtaatagtttttaaataaatacacagaataaccttagctctctgaatgttagtaaattcagatcaagtgattggattatgtggtctccaccagactgttgctttttcatgtttaccagacccaccagtaaaaacagctatggctccttccaaaggggcatcacaagtaatttttggaagaacctatgtagttaattttaagaattgaaaagtttttaggataatgattattaatacatccaacaaattttgttaaattaatctgtcatgtaactgagttaataaatgcctgtttaacctgatttttatttattggaactataatttttattgggctcagtgccacaaartttaataattcatatatgagcctgtccaattagaattgccatctgatttaagtayactgtaagtgcttttatggtattatgtggcaaaaaggaccatttaactaaatcatcattttgaacaataacccccattattgtgtggttagtgtgaagtagggaacacaatgaattataaaggcaagtctgagtcaatcctactgacctgggcttgctgaattttgttttcaattactgataactctttcatggcctcgggtgttagttctctgttactgcgtaagttggtatttcccctcaatattgagaagagattagacatagcataagtaggaattgctaaattgggccaaatccaattaatatcttctaacaatttttgaaaattatttaaggttttgaaagaatctcttctaatttgaaccttttgaggcttaatggctctatcctgtacttgtattttcaaatactgaaaaggagtggttgtttgaattttgtcaggtgctataagtaattcagcatttgtaattgtcttttgcaaagattaataatattgaataagttggtctctactttttgctgcacaaatctggaaactgatctctaacaggctggakagttctgcctacaaaagtttgacaaactgtgggactatttaacataccctggggcaaaactttccaatgatatttggctgcaggttttttgttattaacrgcaggaatggtaaaggcaaattttttgaaatctgcctctgctaaaggaattgtaaaaaagcagtcttttaaatctataataacaagcggtcagtctttagggagcacagtgggggatggragcccaggttgtaaggctcccatcggttgaattacagcgttgacgccatctaccggactttttcttaattacaaatactggggaattccaaggagagaaagtgggtgaaatatatcctttttttagtagtttattttataaagcacccccaacttttccttagggagcggccactgttcaacccagacggggcgccgggtcatccattttaagggaaattgctccttcactgtaataactgtagggtgaacctgaattgccccatctccataatgaactgtgggtcgggcaataatgggcacggtgagccaagtctcgggctccctccccctgcacccactcggctgaggaggaggtggccattctggacattyctctacaggaaccgtgggctgaacaattttttgagtaggtttagggagactggggagattggcataaatcatcttcagactctcctttttgttagtactcggtagaggtggttcagagttctgattatcaaactcctctctctcctcctctgactcagcctcattatctgtctgaaaaggctccagtgctgcatgcaccaatgaccaaagcgaccaaacaggcaaaggaatttcctttccttctctatatgctcttttaaggtcctttccaactccttcttaatgttttaatttcaaagtttcctgttttgggaaccaagggcaaaattgttccatagcatgaaacaaatccataagattttccgtatcaacttttaccccaccatgcatgcttgaagagctgccgtaggaagctcaaatacgtggtgtacttactttcagtttttcccattgtgtccctagctttctctgggcgccccgcttacctgtagaggttaaaacttttatgtccttgggagtcctttgttcgttggtcctctgtttcacatgcttgagcgtttcctcaccagattcttttgggccccacgttgggcgccagaatgttggggaccagcctcaacaccacctgtagggtacctgaagtctggtggtgacaaaggaatgagaagagacaggttaagagttcataaagagtggaggccagggggccaattgcaaaatggaggctgcaaaaggctcagagctctggtctccacactatttattgagtacaataacttagatctaagaagcagatgttcagggcaaaacagtgaaagggtagcagtgcgtcacaggcataatctacagcagaagygctttaaatgaatctcctttgtgctcaaacagcatatctttaacttrtcggagagtagctagtgggagtgggcttaactaggagcctgcacgtctgtccacattccaatgcttcaaaggagggtctttctccttgaatacagtgtttacagataagagagagcaggtctcgctctgagcatggcaattaggaggcttttctcctcagaggcctcttgtggctttccacaacttattgtcccatatttttatggccagtttatacaggcaccccacaagtccttttcccaacacagacaggaatacggcagcctgygccctgggagctcactgtcttgtgggagggaaccactcaagccactcccyacttgtcctcctgtccctctcttcttgggctctgtcccccacctctctctgtcctttgtcttgcaggtggggagatggaggaggcagagctcacatcctggtattttgtgtcatctcccttctccttggatcttagcaagaccaagcgacaccttgtgcctggggcccccttcctgctgcaggtttcttccagaggggaasgatgagtagggaggatgtggtagttaggagggctcagggtctgaccactctcttttgcctgmcctcctttacctgmctaggccttggtccgtgagatgtcaggctccccagcttctggcattcctgtcaaagtttctgccacggtgtcttctcctgggtctgttcctgaagtccaggacattcagcaaaacacagaygggagcggccaagtcagcattccaataattatccctcagaccatctcagagctgcagctctcagtaggaytcctcggmcccctgggagatggtgggggaaggggaggagggtgagctggggtcccaaggatccatggcctgacttggggggaaggtggggtacttggctctgagctactaccctattcgcacctgaccccctctccaggtatctgcaggctccccacatccagcgatagccaggctcactgtggcagccccaccttcaggaggccccgggtttctgtctattgagcggcyggattctcgacctcctcgtgttggggacactctgaacctgaacttgcgagccgtgggcagtggggccaccttttctcattactactacatggtgtgcatgagctggggagtcamggagggctggggtgcagggaagagccctctgggtggggctgggggggttcaaggctgaggctgtcccatgaagaggcaaccactcttgtccctcccattcttggcccagatcctatcccgagggcagatcgtgttcatgaatcgagagcccaagaggaccctgacctcggtctcggtgtttgtggaccatcacctggcaccctccttctactttgtggccttctactaccmtggagaccacccagtggccaactccctgcgagtggatgtccaggmtggggcctgcgagggcaaggtgaccggggtcaggagagatggcacttgtgccgagggggttgaggacagggtgattgccaacagggcatggatttagcttgggggcagtgaggataccgggactgaaggaagctctcccactctgaccgcccccacctgccgcccctgccagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtttgtccagaccctctccacagctctctcacccctccatggctcatccccctgcttccctgagccttgggcgcagcccctggatcccactgaggctccccacagtctcttccccacttggccctgtggtctccatctcctggctctgtatcctttcctatccccccatgtgctgccctctcacctgtgccgagtgctcagtcctgcccctcagccacacttggctcctagcattcctgcctttcttgcaggtctttgaagctatgaacagctatgacctcggctgtggtcctgggggtggggacagtgcccttcaggtgttccaggcagcgggcctggccttttctgatggagaccagtggaccttatccagaaagagtgagaacagagaaggaaggggagtgggtggcgggaagataaggaaggaggaagggcctgaggggaccagctggaagagtccgggcaggaagggctgggcaggggaaggggaggaggggaggaggccgagtgcctgacggctggactgcagcctttctctctaccaggactaagctgtcccaaggagaagacaacccggaaaaagagaaacgtgaacttccaaaaggcgattaatgagaaatgtgagttgcgggtgcctaggcagtagcttgggctctccacctgggatccgggttgggggtctkcctctctgcccctcrgctccttgctgaacccacgtgtggtatttggggccagagatccgaattccgggattacgagtggaaggtgggcagctctctccagcagcctctcttatgttgctggtctcaaggggtcggggcgggkgctgaggtgtatgtcctttttgtcctctcatgctcacccccacctggccctgcagtgggtcagtatgcttccccgacagccaagcgctgctgccaggatggggtgacacgtctgcccatgatgmgttcctgcgagcagcgggcagcccgcgtgcagcagcyggactgccgggagcccttcctgtcctgctgccaatttgctgagagtctgcgcaagaagagcagggacaagggccaggcgggcctccaacgaggtgaggggctgggtggggctagggcacaggtggcggcgcttggaaaggcagaacggtcccctcctcactcccgtccaccgtggtcccccagccctggagatcctgcaggaggaggacctgattgatgaggatgacattcccgtgcgcagcttcttcccagagaactggctctggagagtggaaacagtggaccgctttcaaatgtgagagtgtgtgccggcccggccttttctctgtgctgtgtctcggggccagccggggtagacgggccttctctgcctttccctacacagattgacactgtggctccccgactctctgaccacgtgggagatccatggcctgagcctgtccaaaaccaaaggtgatgtcaccctgtctgggcctcaggtgacccygmttccatttccctgtaccccagctccctgtyccctttgctcttagtgtaggaagagggtccagtgatctggggaggtctgtgycagcgtgcagmtggcgtgggccrgagggcagaggcrgactgagacagagctgggtcacccccacccctccctcctgtggccctgaagctttgatggcccctctratctctgcccctgtgcccrcgcttccyttccctcaggcctatgtgtggccaccccagtycagctccgggtgttccgcgagttccacctgcacctccgcctgcccatgtctgtccgccgctttgagcagctggagctgcggcctgtcctctataactacctggataaaaacctgactgtgaggccccatrggagcctgagcatacaggagttgggggagccagggcccagtgaggggtggggaggctaaccgggccaggactctggccatcctcgttttcctgccctcaggtgagcgtccacgtgtccccagyggaggggctgtgcctggctgggggcggaggkctggcccagcaggtgctggtgcctgcgggctctgcccggcctgttgccttctctgtggtgcccacggcagccrccgctgtgtctctgaaggtggtggctcgagggtccttcgaattccctgtgggagatgcggtgtccaaggttctgcagattgaggtgaatggagcacccctgaatataagtccccgggccccyagctttgtcctccaccctcagcactctctctgctrgccaggccaggggcccaacacccraaccaatgccttggtctgttcccatcttctacaattctgatccaactctgtccctggagttgaaactcaaagttctgggggagtctgygctagcagggcaggctgtagtcctgtgtgacctcacaaccatgttttccctgagacagaaggaaggggccatccatagagaggagctggtctatgaactcaaccccttgggtgagtgaccctctacctccagccattggtttcctaagtgggtacaggtggtgggggatgtggacagcaggacaggctgccaacttccccmatttccccagaccaccgaggccggaccttggamatacctggcaactctgatcccaatatgatccctgatggggactttaacagctacgtcagggttacaggtgggagtgccctttagtcccttcccagtggccaccttcggattcatgtgggacytgtggatccctgcttggtcccactccccgtgagcctctgacacagagtcctcagacctcyaccctctccctcccatgtagcctcagatccaytggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactkcctcccgagaccaaggaccacgccgtggatctgatccagaaaggttctgggtgcaagggcaagcaggagggggkccaggaaaggacagttactggaagatggacagcccaggaggctacagagggaaagaaagggggcccctgatgaggatggggagcatggccttgggctcaaacagcagaagggtgagtgtcacctgagcggccacctctcctctccaaggctacatgcggatccagcagtttcggaaggcggatggttcctatgcggcttggttgtcacgggrcagcagcacctggtgagcttgggagagtggttccagggttctgagggggtcagggctggggcaggggtgggacagagctggtatgatgggagggtggataaccaggcacctgggggcgtgggcataatgagaagcaagtccttatccccaaccctcctttcctgccctccaggctcacagcctttgtgttgaaggtcctgagtttggcccaggagcaggtaggaggmtcgcctgagaaactgcaggagacatctaactggcttctgtcccagcagcaggctgacggctcgttccaggaccyctstccagtgwtasayaggagcatgcaggtgcgggcatgctggggctggcccgagaagcgcctgtcggaggactctctttgccccttccccctcctgtttgacatcttttctccccttactaggggggtttggtgggcaatgatgagactgtggcactcacagcctttgtgaccatcgcccttcatcatgggctggccgtcttccaggatgagggtgcagagccattgaagcagagagtggtaagttcagtggcgtttctgccctctgctggcccccagctctctccctttttcctcaggaacccaggggtccaggcccaagaccctcctcccgttttcttccaggaagcctccatctcaaaggcaarctcatttttgggggagaaagcaagtgctgggctcctgggtgcccacgcagctgccatcacggcctatgccctgacactgaccaaggcscctgyggacctgcksggtgttgcccacaacaacctcatggcaatggcccaggagactggaggtgaggggtgaggsgctctggcagtgagcctgaggcccaggggaccttaggatccctgagtgtgcccagagggagaggctggatgaagactcagaggaggaatgaagttataagcaggggtgggttgggggagactcaggagagcccagcagggggtggctaagggccaggggaccaggctcttctccctgccttcctgtttactygtggtctcccttcactttcagataacctgtactggggctcagtcactggttctcagagcaatgccgtgtcgcccacsccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagtaggggccgtccccgggctctggsgggggtgggtagtcctcagaccaagggcttgcttgagtcctggctcaacctccctaggacacggtgattgccctggatgccctgtctgcctactggwttgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccamcctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtgctggtataaactttgtggaaatgtgaggtggggagaggaggtggggctgttttgaggaaggagataagttaytggagccgcaaaaacaggtttgcttgtgcccttctaacatcgccttcccttttctgttgctgaagttttccttgggcagcaagatcaatgtgaaggtgggaggaaacagcaaaggaaccctgaaggtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgctggtggctcygaatcccactcctcagmccaggsctcttccctgaaccatgggccccactcgtcccactcccacarcacctcagacgaggcatgtcccaaagcccttcttcattctgtgtctcttgtctggctggtgggagcccctcccagccaggagcccagccactactctagaggccgtgttagtggcccctctcccaagcctgtccttatgtccctagtgactcctcctctgctcccctgctgcctgtggcccttggtgctgcatcctagattctgtgctgagacggccttctccctacctggaacttctctctacctcctgtctcccctgtctgatccactgtccacacggsagtgacactgaccttccaaaagccccagccagatcagccttggggaaaagtcactccccgctgcccacggctcagatggctgggcctctgcccacccctccggccagacagctctccttgtctacacagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtctcgcctgacgcctgtggcgaatgtggtgccactcgtgtgtgtggactgtgcagtgacggggaggaaaaggggctgaaggcctcaaatccygtagcccagggagatgcccttaggtatggcaccagagaggtctgtggcctyacatgtcccacgtcctctccctgccccttgctgagccaggtccttcgtacctacaatgtcctggacatgaagaacacgacctgccaggacctacagatagaagtgacagtcaaaggccacgtcgagtacacgagtgagtgtgggggttgggaggccttggggccaggcaggggctggcgcagggagccgggtggccatcccagccctcctcacaatgcttccctgtgcagtggaascaaacgaggactatgaggactatgagtacgaygagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggtgggcgccgggagctgccctgggccaggggagggagggcaggacccaggctggggctgggcttctggagcccgcgcaggcagaacctggacgacagctcacacgtytccacaggcggaacggcaaggtggggctgtctggcatggccatcgcggacgtcaccctcctgagtggattccacgccctgcgtgctgacctggagaaggtgtggtcagccacccagggcaaccccctctgtcccaggtactgagccctgtcatgtgcagggcctgtgaccaactccccttttccacagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagtkgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgaggscctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtcyccacctcccgggagtgcgtgggctttgaggctgtgcaggaagtgccggtggggctggtgcagccggccagcgcaaccctgtacgactactacaaccccggtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccagagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggcygttttggtctctctgggtgtagcctgctcctcttacaggtcatgcacgcagcctgtttgctctgacaccaacttcctaccctctcagcctcaaagtaactcacctttcccccttctyctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacrtcatccccgcagccaaggatgtcaaggccgctgctaatcagatgcgcaacttcctggttcgagcctcctgccgccttcgcttggaacctgggaaagaatatttgatcatgggtctrgatggggccacctatgacctcgagggacagtgagtcatctggtcccctcagtctcttgtcctccccatgcctygccacctaggccttgcccctcagaagccagatgcctgtgctctccgtttccacctgccatcctcccgagccctgytgactgyccctttgccccctgcagcccccagtacctgctggactcgaatagctggatcgaggagatgccctctgaacgcctgtgccggagcacccgccagcgggcagcctgtgcccagctcaaygacttcctccaggagtatggcactcaggggtgccaggtgtgagggctgccctcccmcctccrctgggaggaacctgaacctgggaaccatgaagctggaagcactgctgtgtccgctttcatgaacmcagcctgggaccagggcatattaaaggcttttggcagcaaagtgtcagtgttggcagygaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgcctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatctttctcccagtagctgctcagcatggtggtggcataagcccattttccggagccagggattcagttgcagcaagacatggcccggtctgggaggtcaaccatgaagaaggcagtagctgtcattgcccaaccccagaaatcccaatcctgttttctccctctcagtcctgatcatggattcagcagcagcgaactcgccaatgtagtgggtggcacagccagggtcttgactctggctctgcagtagcacagtctggaaaagctctgaggggagagagacccccactggtccgagggtctggcacagagccagaaatgggggggaaggtatggggctgggtcgcctctgacctctcaggtaccatccaggaggccctggcctctcactgaacccggccactcctctttggcatggcctcttcccaaatccccaaactgcctccttacccacaaaagtggtctctgagtgtcagtccagtgggacccccaccccttatggcttcagttccccaaatagggctggacccttgatcctgatccagctgtggctatccagccccttcctggggactttggactttgaggggggcatgcccagttgtgctgggaatccatactttccctggctggagtagaacctgtggactgtagtcctgagggcagtcatgttctgcctgtgcctggaaacacaagaaacttgactgcagagagaagaaagaggagagaggaacagagcgaggaaaccgcccgtctccggggctttttctgttccctatccttgactttctaagaccagtggggtcccctcctctgcttctttttcctgagttctgtgaaattccccaattcttattttttatctcaaaccagctcaaggtgggctgttttcctttcaaccaaagaaaggtgctcctggtggctaaaggtacatattcgacagctagatttccaggctggaatcctgccctccacaacatgcgaacaatacccgtgttgcatatagagcatggctgtgaagagttgagtgagtgcccacaaagcacttagagcagtgtctggtacatgctattactccgcagcgggaaaccacttcctcctttgtcttctgggcacttttgtgagtgaaaggaggcactaataacaatcacactgggatacctgtatatactggaatgccccaggcaaaccaggcttaaactgtattactctatctgtagcttaaactaacaaacaaacccacacaaatcacattttgttcttcaggcgattcaggaaggcctattaggcagggactgccattttctctctgagacaaacatcatgccagtaaactggcccacggtggggtggcagagggagagggcccaggtcggggcggacacccttgcctgcacgggtgatgtggaaccagaaagctgactctggatgcaggaaaaaggtcagggttgcatttcccttccttgcttctcgatgggtgattaattttttttgaaatacggacgtcccaaggccaatgagactggtgtcattccagaaaagggccactctgtgggtgggtcggtgggaaggcacctgagggtggggtcaagggaggccccaaaacagtctacacagcaggagggatggctggggctcttgagctataagtggcacctcagggccctgacgggcgtcttgccatgctgctcctgggcctgctgctgctgctgcccctgctggctggcgcccgcctgctgtggaactggtggaagctccggagcctccacctcccgcctcttgccccgggcttcttgcacctgctgcagcccgacctccccatctatctgcttggcctgactcagaaattcgggcccatctacaggctccaccttgggctgcaaggtgagaggctgatctcgctctggccctcaccataggagggggcggaggtgacggagagggtcctctctccgctgacgctgctttggctgtctcccagatgtggtggtgctgaactccaagaggaccattgaggaagccatggtcaaaaagtgggcagactttgctggcagacctgagccacttacctgtaagggctgggggcattttttctttcttaaaaaaatttttttttaagagatgggttcttgctatgctgcccaggctggtcttaaattcctagtctcaaatgatcctcccacctcagcctcaagtgtgagccacctttggggcatccccaatccaggtccctggaagctcttgggggggcatatctggtggggagaaagcaggggttggggaggccgaagaaggtcaggccctcagctgccttcatcagttcccaccctccagcccccaactcctcctgcagacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgaggtaaggctgggctcctgaggccacctcgggtcagcctcgcctctcacagtagcccccgccctgcccgctgcacagcggcctgctgaactcacactgtttctccacagcgcatgagagcccagcccggcacccctgtggccattgaggaggaattctctctcctcacctgcagcatcatctgttacctcaccttcggagacaagatcaaggtgcctcacagcccctcaggcccacccccagcccctccctgagcctctccttgtcctgaactgaaagtactccctccttttctggcaggacgacaacttaatgcctgcctattacaaatgtatccaggaggtgttaaaaacctggagccactggtccatccaaattgtggacgtgattccctttctcagggtgaggacctggagcctagacacccctgggttgtaggggagaggctggggtggagggagaggctccttcccacagctgcattctcatgcttcctgccgcagttcttccccaatccaggtctccggaggctgaagcaggccatagagaagagggatcacatcgtggagatgcagctgaggcagcacaaggtggggactgtgtgtggacggcctcccctcggcccacagccagtgatgctaccggcctcagcattgctatgaggcgggttcttttgcataccccagttatgggcctgttgccactctgtactcctctccccaggccagccgctcagcccgctcctttcaccctctgcaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgaggtgcgtcctggggacaagcaaaaggctccttcccagcaacctggccagggcggtgggcaccctcactcagctctgagcactgtgcggctggggctgtgcttgcctcaccggcactcaggctcactgggttgctgagggagcggctggaggctgggcagctgtgggctgctggggcaggactccacccgatcattccccagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcaggtgactcccgagggttggggatgagtgaggaaagcccgagcccagggaggtcctggccagcctctaactccagcccccttcagcatctccggctacgacatccctgagggcacagtcatcattccgaacctccaaggcgcccacctggatgagacggtctgggagaggccacatgagttctggcctggtatgtggggggccgggggcctgccgtgaaaatgtggtggaggctggtccccgctgccgctgaacgcctccccacccacctgtccacccgcccgcagatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccgga

SEQ ID NO: 1706 - DNA, 34059 bp, Homo sapiens
  misc_feature (1)...(34059): n = A,T,C or G, or insertion/deletion polymorphism (see Tables 1-2)
gggggcctccgggatgttcgccaataggggtcctccccagctccaagcgtcctgaagcgctggagttgcagacctgggtctccagtctaacctcaactgacactcccgggccccacccacgaaccttgacctcttcccggctcccgcgactttcacctgctgagcgtcatcaccacccaccgccacaccctgcaaggcagaggctagcgcagcccactcgtacctgcccgagcctggccgccgcccccacttccctccccgcgtccgtggtggggacggggtgccccactttcttggagccaccccttcggcctcctgaggtttccacgcctttaccatatcccggcaaacctgtaattccagcagttctgctccccctcccccacaacccctaggagaccccatgttggagaagcgacccactgggccccgccccgacccccagcattgttttcggccctacggaggagcctcattaggaagaggacgcaaaagggaatcgctggcccccagtcttgaaaagcacttccttccccaagggcttggtacccgttgggtgggtagaatatcttcaatccgagggcaaggaaaggtaacacagggtcccttcaaggctgggacagagtcagaagagaaaaacagacctgtcctgctcttagtagcagggcggttaggattccagaaccctccagccttaagaggaagagcctcccccagcccctcaccacctgaagagccccaggttgcactgctttccttccaccttactccactccacctcttcagctggcagacagtcagcaagtcagagctgtttcctgcaggctgagagggaggattccagctacttcaaagaattaagttcataaaccaagaggtgccccaaccaaaccttctcaccaaaaagctgaggtcttcccttcattcttctacccccacctctccaaaggtttaaataataacactgatctcttaaattatatttattatatgaaatacaaaatgtggaaaatttggaaattacagaaaaaccaaagatgaaaattacagtgactttgttccaccatacaaagataaccactcaacattttttagtatgccttccgtcttttttatctgctctacgtatacaagcatacacccatattttaaaaaacaaaattgaaatcacataacatgcactatttttacaaccttttaatattcaaggagcatttttctttcagtcagatgttcttttacatgacttttaatgtctgcgcggtactccaccatctggatggagatacaataatttacttaagcaatcccctattgcaaactttcgttacagcagaaaaggaataaattcccaaccaaaccattgcttcccatttttctccattgcaatgctgggatgaacatcttatcactaactaaatccttaagtattttcttaggataaattcccaaagatagaattcgtaggtcaaatgacatggaggcttttaggccacatgacacatatcacccaactgtcatccaggaagcctgcaccgatgtatactcccacacgcaatgtatgggaatgttttttcagtagtctctttgccaatattgggtcttatttttttctgttatggtttgctaagggaaaaatgcttccagctctatttgcctttctttaattactaatgaagcatactttttttcatggttttatccattcagatttcttttatgaatttcctgtgtgtgtcctttcgcagatggttcttggtccttgaggctgcttatataaacattacaggctgggcggaggtggaagtagggcggtgaagccacagggcaccgcactatggtgccacatctcggaggcagaaagcctggagagaaatggtgatcaaagtaggagagggctggaggctcgccgtcaatggaggctggctgccctccctcctcttggggtgctcctggcctttaggggctcctctgctggatgcccaggtaggaccctgtgctctccaggcctggtccttcactggtctccatattcccaggctgcctctcctcacctctgctccatgatgggtgaagatggcagaggcacatagcgagggctggagggagatgctgtggccagtgaagcaaggagaaagtacggaggcagtgtccagggacagagtcacctttgttgcagcctatgagtctatcccctgcttctctaccactgtcccacacgcatcctgcccctcagcttggctgcagaagagcagggttccacggtctactcttctccacatccttgagtttttcacaagcggaggacaagatacagctccctgcacatctcctcccaccaaatcgaacagacacagcttcctgtagccgctaggtgagaatggatcagggctggaggtggcaggtttacactcactgcctgatatctggaaggaggtcacatcccacaacccacctcccctacttgctgcaggggagaatttcctgtctgcacaggcctgagctggggatcacataccaccttggaaagcaaagtgaggaaagaaacagagtagcagcagttagaatcccaccaaggggctgctgtcctgctttggatatcaggggaagccttgggccacccttgcatggggggaagtcacggagaggcgagctcttactagctcctcgcattggtctaactctaaccccctcctccagcttcccattccccacccagcttctgggtgatggtatcagggatgggggagggacaacagcttctgtgaaaaggtgttttgtttccacccacagcagggggagagcccgggttctgagtcaacccagatgggcttctgattccctcatgcacactcatctgtgtgactgcccatctcacaggtggagaaactgagacaggaggtctaagggtctcagatacaggtaagtgcccaggaatctagagtctgggccagcctaaggaaatgcagggaaaagtaagagcagaaggatgactcctcacgcctgggtttagtatcacttttccctgaagagtgagcttacttttggacctcatctggaaaggccagtggggaagaatgaaagatacggaaggagggtcaagaaggaagtcggggagacagagtgttctctccacttcttcccactgtcacacaaagaccaactaaccttgggttgtttgagccttctactcctcaatccagccagtgtctctaatctaaaaccgctccttgctgggccaatctgggcaaaggctctccaacttgcccaaaacgtatcatccaccctgctgttcggaccttcccagcccatttctgtcaccttccagatgatggggaaagcagctcctcctcctcctcgaagccaggggcagagggcaacagttcttcaactggcagctttagctgggtcaggacataaagcttgccactgaagaactactgcggctcagccaggtgagggcgtgagaggaacaggctcctaagggaaagggagggaaaatgggaaagatctgagcagggcatgttgctgcaacgctgacccactcgctggccatcagggtcctgccccagtagacctctgagattctaatgcagggctgcagctctgatctgggcccgcggaagctgttaacctcgctgagcagcaagaggtggctgtaaacagacttcccttgctcttctttccagaactggagtctagagaaacccagtcctgctctcaccctcccctgccctagcggcccctgggggcccagcctcctcagcattcagacagggcggggcccgggaccctggacacaccccaccagcacgcaggtactagaagtgtggtacctcaggtccagaaatgtgagttcagtgatcagcccaactgacttgttcccagggagttcagctggaaggagagttctgggggcctggattggggaagagtgaggaagggaggaggcctagcgtttgaaagaaggtcagcagaggcccccggggctgtgaggggcggacaggggaccacaggctggagaggagggaggtatcggcagggtggccggggctgtgaggggcgggcaggggaccacaggctggaggggagggaggtatgggcagggtggctgggcagcttccccaggactctcagatgccaggcattccgcttgcgcattccgggtacatctggtatgaattccaggctgtctgccggcccctccatgtctgaactttgttccaagttccaagccccgcccccacagttccaacgcatgaatcagcaggaaaagccgggccctgcagcatggcccagggagggggctgggggcgtggcaggctcgggggatgtgagctggggagggcgggtccgtgctgacactcagtccaagggcatggcccacgccaggctgaggggccaaggcggtcttgccttggaatttctatactcagagggtaagaaagattgggggatacggggtgcggttcaaattccgaaaccctcttgggaggcatgaactttgtgtatcttccttcccctgggtgaccagtccaactccgtccgaccttcctctgtctgagatagctctgttcaacccagaggactcagcagctgctgagagtctgtgccaagcaggtgcccttggctgcagggcggggtgggcccagggcactgaccctctgaccagctgctccatcaaccctctggcactctgacagctcctagcccaatctgacagccaggatgacaggccaaaggagttggaggctggaaccagggccggagggaggtgggggtgacagcctcgccggaggccatggggaggggccaagagttggccgagaggtggggagagaggcagcccagtgatgactaacccaggcgccccacccagccagccggcttcccaggcagtcagggccaggcctgggctaggggcctcacaatcggacaggctggggggaggtgcagaggtgaccttctctcggcccaagacggccagttagtctggggagcgggggttagagtttccaggccctcctcttgccctcttccccccgcccaaccacggtgaaaccctaacctttgggttgcataaggccccggcaccgccgccccctactcctctcccctccccccttacataacatcccctggagagaacgagaggaggggccggcccgcccagcgaccccttccctgccagggcgctgaactggccctgacccagtgaacgccggcagaggcaaagcacctcctcgccgcccgctcggggggtccagaccctccccaggctagatggccggcccctgtatcctcagaccgggggccgccgggtgagccgcccccggccctccggcccctcggctctccccccgccccccgccactccgccagcccttccgccacgactcccgtcccagactctttcctcatagctcctgacacactaacccggccagtccaggcccctctccccgaggcgcccctgcccccgccgccccttctcctcccggaagggctgggtgtggccgcccggaccccactttcaccctccatcccgttaccgcggctccccgctgcgtgaccgggtcgccagctcacacccacctggtgctgggtgtgggggttgctgcacgagggggagcaaatcactgcgtccgctccccacggccggcggcgctgtctcttctcggcacccagcacacaccggctccaggctccgatcagctggcggcgtcgtgacgcacgagctgcgaatgcacggcccggggccaatcaccgcccactgctgggcaacgtggccccgcccacccgggggccgacggggcctcgccctggtcccgcctctccgggcgccctggctctgattggcaaggaggccacccttttgccgggcggaattgcacgaagccacgcccacccactgaggagccggccaatagacggacaggtgtggcccagccctccgcgtcagcgacccgcttagaaaagcgctacgtcaaacgagagtcctaaagagcaggcgaaagccacggcgtctgcgtttgcaatgcatgctggtccgtgtagttctcagcctgacaccgtcgttcccagaacccagcgcgctctgtgagttggcatttttaaactgagctcggaatccagcccggggaagtccttaaagggcgacagcccctccttgttggagtcgtgagtgcttcttttagacattccccaaactgactcgccggcctctgcgggacgctatagctctttaaggaaaggtggagcggaccaaggagcaggagtgggcagagcgtcagcccccagggcagcagagactgccgttggagagctctccagggtttttggaggagggagggtgctcgcctcgcccagcccactcctcctgggggctcttcctaaccacaggaggctttttttcttggatgtctcttcccagtcccagaagagcccccagagcctcccaagaggtagctttctaacaaaagattcatagcacagtcctcaccttagggtagagggagggcttctggtcagaaattaggggatgggccatgccaaagtgcaaagggtcagcaatcgcatcctctgattaacccccattcagtcccgccctccaaagctcttcactgactcaggcctacttagggaagagattcgaaggtggagaccaatgagcaggctgctccttccccaggggccaatcagagtctagatgagcgggggatgggcaaaaagtgaaatgaacccagtgacttggcaaaagctgctggtcggcgtttttaaaggggcaagccggagacctgccctaccttatcaatccccgcaagtcccccaaagaggaacatgtggactgaaatccatgccttttccttcagctccaaataggggctgagggtaactaagcaggagagatgaggctggagggtgagatccttccttctgttaaatacgcactccatcaggtaattgataaggttcacttggagctccaaaattctgagcctgcgttcaggacattgcgcctttaaggaaacttcctgccttgcgccccagtaacagctgattgttggaaagtgtgacctctggggacgaatcagctgttaccacatcctcctccttgcttaccctcctccatccccttatccactcccatgggtggtgaaggaaagaacgtgggggatgtgattgtatgatctttcttttcccccatcactccaagactgtctcccccaaccccaaccccgctctgctccttagttcttcagaggctctgggcttggaaagagaggtatttcctgttagcacagtaaattcagactctgtggtctagaccctccctggtctaggggaaggccagtactggggaggtccagaatggtggctggcgctggggagggtacagtgaacccgaggaccaagcctggggaggaggaatggctatgggaagcaaacttggggttcagaacgctgcttctcaggccagccgccccctacttcctactcaagttgccctattcctccatggacaggtgtctgctgatgggatcctcctgcttttgcccatttactccacctccttatttattttttttttttctgtttttgagacagagtctcgctctgttgcccaggctggagtgcagtggcgcgatctcggctcactgcaacctccacctcccgggttcaagcgattctcctccttcagcctcctgagtagctgggattacaggcgtgcgctaccactcccagctaatttttgtatttttagtagagatggtgttttgccatgtgggccaggctggtctcgaactcctcacctcaggtgatccacccgcctcggtctcccaaagtgctaggattataggcgtgtgagccaccgcgcccggccgcattcactccacttctaactgttctcagctgccacctggtccctgggccgctccatttttggcttttggcggtgccctgcccacatggccaccccccatagcaagggtcctaattgctcaaggactgcaggtgggacacgttggccccagaagccagcgtctttggctgggaagtgctgggaagacccaggtaaatattttgcctcgatcctgagttgggagtcagggtcactccaggacaagcttagtgtgaagtcctaggactgacttggcaaggcgtggagaaattgagcagggccctggccaagcatggaaggaagtgaagcctcaccagtggcccctattctccattatcctgagcatagaaatcccatccctttcccactcacggcccttggggtgacccttttccattttgttctgaacactgaccccaccccctaggtcaaaagcacaggcttcgagtccagggtttcgccacctcagcacccactggcattttaagtagaataatttcttgtgggagggctaccgggtgcacaataggacatccacgtggtccctggcctctgtcctagatgtcagtggcaacacccacccacccccagctcccagttttgacaaccaaaagtatctccagacgttaccaaatgtctcctaggggccaaaatctcctccaactgagaactactgtgttaggcacacttagattcaaattccagctcttactagctgtgaacttgttaccgataatttcccctcatctacaacatacggtgaataaggaattcaagccttgttgtagggatttcaacatttaaaaatattttaaaagttaaaaatgtgcccgggcgcggtggctcatgcctgtaatcccagcactttgggaggctgaggcaggcggatcacgaggtcaggagatggagaacatcctggctaacactgtgaaaccccgtctctaataaacatacaaacaattagccgggcgtggtggcgggcgcctgtagtgcccagctacttgggaggctgaggcaggagagtggcgtgaacccaggaggcggagctttgcagtgagccaagattgggccactgcactccagcctgggtgacagagcaagactccgtctcaaaaaaacaaaacaaaaaaaaaaattaaaaatgtggccaggcacagtggctcatacctgtaatcccagcactttgggaggccgaagcaggtggatcactttgagcccaggagttcaagaccagcctgggcaacgtggcaagaccctctttaaaaaaaaaaaaaattaaaaaatggcctggcgaggtggctcacacctgtaattgtagcactttgggaggctgaggcaggcagattgcttgagctcaggagttcgagaccagcctgggcaacatgatgaaactctagctctacccaaaatacaaaacattagccaggtgtggtggtatctgtggtcccagctactcaggaggccgaggcagaggttgcagtgagccaagatggcgccactgcactccagcctaggtgacagaatgtgactccatctcagaaaaaaacgaaaaacaaatttaattagaaaacacctagcatagatttaattagaaaacacctagcgtagatttaattagaaaacacctagcgtagatttaattagaaaacacctagcatagtacctgccacactggtccgcagctggtgcactacttttctccctgccggattagcaagagctgaccccgctcaacatgggctgactggtggggcagctgcagcctctgtccctgactatccaagacatgacctcccggaaacccaatactgaggctggccaaggggagcggctaatttggtctgagattccccagagcccaaaggtgcttgcattgggattcagggaacacgcttactgggggcagtgagagggaaattccggaagagagctgttacagacgttacttctcaagacatagcctgaaggttgctgcatcagaattacctcgcgtacttgttaaacatttagatagctgtatctcactccagactcctgaattagaattatgccctaaagggccgggcatggtggctcacgcctgtaattccagcactttgggaggcggaggcgggcggatcatctgaggtcaggaatttgagaccagcctggccaacatggtgaaaccccatctctactaaaaatacaaaagttagccaggcgcctgtaatcccaggtactcgggaggctgaggcaggagaattgcttgaacctgggcggtgaaggttgcagtgagccgagatcgtgccacagcactccagcctgggcgacagagtcagactccgtatcaagaaaaaaaaaaaaaaaagaattatgccctaaaatttgaaaactactgccctagggctcagattgggccagggtttgaggccccaggaatcccagtgcgccagttcccaatattgctaggacatctctattctcgggaggaaaggagaatttcaagaggtaaaattaggtacactcaaggtcactgctgcagtgtaaccccagtaccgctagagggcagggcacacacagacttgcagacagaaaaagtagtacctgctcaatctaggtaaactgagaccagcgcaaagaacaggtggacccagccagctctattggtactaagaagcaagcactaccttctaaccatcaaaacatatcctctgatttcaggtatttatatcaaagttggggctgggcactgtggctcacgactgtaatcccagctctactaaaaatataaaatttagctaggcgtggtagcaggcacctataatcccagctactcgggatgctgaggcaggagaatcacttgaacccgggaggcggaggttgtggtgagtcaagatggtgccattgcactccagcctgggcaacaagagcgaaactttgtctcgaaaaaaaaaattagctgggcttggtgacgctgcctgtagtctcaactactcgggaggctgaggtgggaggatcacctgagcctggggaggtcgaggctgcagtcagctgtgacaaatcactgcactgcagcctgggtgacagagtgagaccctgtgtcaaaaaaaataaataaaaaatcactcgggcaccatggctcacacctgtaatcccagcattttgagaggccgagatgggccgattgcttgagcccaggagttcaagaccagcctgggaaacatggcaaaacctggttactacaaaaatacaaaaaattagctggatgtggtggcacattcctgtagtcccagctactcaggaggctgaggtgggaagttcacctgagcctggaaggtcgaggctgcagggagccaagatcacactactgcattctagcctgggcaacagagtgagactctgtcttaaaaaaaaaaaaaaaaatcaggccgggcacggtggctcacacctgtaatcccagcactttggaaggccaaggcaggcagatcacctgaggtcgggagtttgagaccagcctgaccaacatggagaaaccctgtctctactaaaatacaaaaattagccgggcatggtggcacatgactgtaatcccagctactagggaggctgaggcaggagaatcgcttgaacccgggaggcggagattgcggtgagctgagatcgcgccattgcactccagcctgggcaacaagagcgaaactctgtcttaaaaaaaaaaatcttcttaaaaggggtggtgaggattacacaaaacagggtatgcaaaatgcttaacagatgactagctcctggtaatgctccatacaagtttgttgtaagttactactgcccaggatcatatgaccaagcacatgagaggctccagctacccttcaaggaagaggagacagatgaaatcagatcatggctgagacattcctgttttctctctctttttttttttttttttgagatggagtctcactctgttgcccaggctggagtgcagtggcgctatcttggctcactgcaacctctgcctcctgggttcaagcgattctcctgcctcagcctcccaagtagctggaattagaggcgtccgccaccacacctggctaatttttgtattttagtagagatggggtttctccatgttggtcaggctggtcttgaactcctgacctcaggtgatctgcccatctcagcctcccaaagtgctgggttacaggcatgagccaccgcacccggccctcctattttctctcctatcaggcctagttttcttttcttttctttctttctttttttttttttttgagacggagtctcactctgccacccaggctggagtgcagtggtgtgatctcagctcactgcaacctccgcctcccaggttcaagcgattctcctgcctcagcctcctgagtagctgggattacaggcacccgctgccacacccggctaatttttttgtgtttttagtagagatggagtttccccaagttggccgggctggtcttgaactcctgacctcatgatccgcccaccttggcctcccaaagtgctgggattacaggtgtgaaccaccgtgaccggccaaggcctagttttcctaagtgtctttatgggaccctcacacctgtacaccaaactccttcaagaggcaaactctctcctaagagggagacaaaagaaacagggccagtggtttcactgtagacaatggtctatctgtcctgcagatgagtcagaactaagaccccttgaggaatcatgttgctttggtgccggctgtctggtttctattccatatcctgtgccgcacccttcccccagccacagtgacatctggaggctctgaccacagctggcaggctctgtggtaccgcagaggccaatcttcaacaggaagtcttgggggaacatttcttcccccaaaacaccaggcctctgggcctgggccacttctctccctcagacagcccagggtttcgttttatttttattttattttatttatttatttttatttatttatttggttttatttttatttatttatttttatttttatttatttatttatttatttatttatttatttattctttttgacggagtctcgctctgttgcccaggttggagtacagtggcgccatctcggctcactgcaagctctgcctcctgggttcatgccattctcctgcctcagcttcccaagtagctgggactacaggcgccccccaccacggccaggtaattttttgtgtttttagtagagacggggtttcaccgtgttagccaggatggtctcgatctcctgacctcgtgatccagctgcctcagcctcccaaagtgctgggattacaggcgtgagccactgcacccggccagttttgttttttaaaaagccgtgagagggctgtcaggaggcagtgctcctgggcagaaagaaggctggcaccagtttctaagtctccattccgccaggcggacaagcctctctggcggttgttggttatcacttgtaaaatataaacagtaataactgtcctccctacctcacagagtgtgttgcgagggccaaatggaatgtgactgttgaagtacttaggaaagttaaaaagctccttcctatggaaggtggcatggaggcgccggggggattccatgtcaaaagtcccagttctggccgggcgcggtggctcacgcctgtcatcccagcaccttgggaggccgagacgggtggatcacgaggccaggagttcgagatcagcctggccaacaaggcgaaaccccatctctactaaaaaatacaaaaattagccgggcgtggtggcgcgctcctgacgtcccagctactcgggaggccgaggcaagagaatcgcttgaacccgggaggcagaggttgcggtgagccgagatcgcgccactgcactccagcctgggcgacagagcaagactccgtctcaaaaatagacacaacagaagtcccagttctgcccctggttgtgcggtccgcacttaactaagaggctggcatctctgggaacagcctccgggacccgcgcgctggtgcgtgctggagggagtagggaggggtggggcggtcggcatcgccctccgccgggcccggctggagctggctggagaccctttcagccccgggaggaagcggagcccagaccgagccagagcggagcagcgggagggagggcggggaggccgccgggcaggaagcggggtcccgcccgggcctctggagccacgtgcgcttgtttccgtgctggggcgatcacgtgacccgcgtcagctgacccgtcacggtggagcccggtgctcgcgcccggcagcctctgccccgccgcgcccggagcgcaggacccgcggaggggtaagcgcgccccccgtccgcctcttcgccgccgccggcttcctgcggccgcctccgccccagcccctgtcccgcgcccatcccagccccgccggcctggcaccccggaagccgtcgccagcagggccgtggctgggctcagccccgcgctgcccccgggcggcctggaggagatggcccagggcagcggggggcgggaaggcgctctcagaaccccggccgggggctggcattccccgccaagcccagacatgcaggagctgctccggagcgtggagagggacctgagcatcgatcccaggcagctggctccggccccggggggcacccacgtggtggccctagtgcctgcgcgctggctggccagcctccgcgatcgccggctgcccctgggaccctgtccccgcgcagagggcctgggagaagcggaagtcaggactctcctgcagcgctctgtgcaaaggctgcctgccggctggacgcgcgtggaggtgcatgggctgcggaagcggagactgtcctaccctctgggcgggggcctgccctttgaggacgggtcctgcggccctgagaccctcactcgcttcatgcaggaggttgccgcccagaattatcgcaacctgtggcgccatgcataccacacttacggccagccgtacagtcacagccctgccccctcagctgtccctgccttggactcagtacggcaggctctgcagagggtctatggttgctccttcctgccagtgggtgaaactacccaatgcccttcatatgccagagaaggcccctgcccccctcggggcagccctgcttgccctagtcttttacgggctgaggccttgctggagtcgccggagatgctgtatgtggtacacccttacgtacagttctccctacatgacgtggtcaccttcagccctgccaagctgaccaacagccaggccaaggtgctgttcattctcttccgcgtgctgagggctatggacgcctgtcaccgccaggggctggcgtgtggggccctgtctttgtatcacatcgcagtggatgagaagctttgcagcgagctgcgactggacctgagtgcttatgagaggcccgaggaggacgagaatgaggaggcccctgtggcaagggatgaggcgggcattgtgtctcaagaggagcagggagggcaacctgggcaacccactggccaggaggaacttcggagcctcgtgctagattgggtccacggccgcatcagcaacttccactacctcatgcagctgaatcggttggcaggtcggcggcagggggaccccaactaccaccccgtgctgccctgggtggtggacttcactacgccccatgggcgcttccgagacctgcgcaagtccaagttccgcctcaacaagggggataagcaactggacttcacgtatgagatgacacggcaggcattcgtagcaggcggggcgggcggcggggaaccccctcatgttccccaccacatctcagacgtgctctccgacatcacgtactatgtgtacaaggctcggcgcacgcctcggtcggtgctctgcggacacgtccgcgcgcagtgggagccccatgagtatccggccagcatggagcggatgcagaactggaccccggatgagtgcattccggagttctacaccgatccctctatcttccgctccatccaccccgacatgcctgacctggatgtgccagcctggtgcagctccagccaggagttcgtagctgcccaccgagccctgctggagagccgcgaggtatcccgggacctgcaccattggatcgacctcacgtttggctataaactccagggtaaggaggctgtcaaggaaaagaatgtgtgtctgcacctggtggacgcccacactcacctggccagctacggggtggtgcagctcttcgatcagccacacccccagcgcctggctggggctcctgcccttgcccccgagcctcccctcatccccaagctgttggtccagaccatccaggagaccacaggccgggaggacttcacggaaaacccgggacagcttccaaatggagtgggccggccagttttagaggccactccctgtgaggctagctggaccagagacaggccggtggcaggagaagacgacttggaacaggccacagaagctctggattccatttcccttgctgggaaagcaggtgaccagctgggctcctccagtcaagcgtcccctggacttctctctttctcagtggcctcagcctcccgtccaggccgcaggaataaagctgctggggcagaccctggggagggtgaggaggggaggattcttcttcccgagggcttcaatcccatgcaggccctggaggagctggagaaaacgggcaacttcttggccaaaggcctagggggcctgttggaggtgcctgagcagccccgggtccagccggctgtgccactgcagtgcctactccacagggacatgcaggcgctgggtgtcctattggcagagatggtgtttgccaccagggtgcggacgctgcagcccgatgcacctttgtgggtacgcttccaggctgtccgagggctctgcacgcgccaccccaaggaggtccctgtgtctttgcagcccgtgctggacacactcctgcagatgagtggccccgaagtccccatgggagcagagaggggcaagctggaccaactgtttgagtacaggcctgtctcccagggcctgcccccaccctgcccaagccagcttctcagccccttcagctccgtggttcccttcccaccctacttcccggcactgcacagattcatcctcctgtaccaggcaaggcgtgtggaggacgaggcccaggggcgcgagctggtgtttgctctgtggcagcagctgggcgcggtgctaaaggacatcacccctgagggcctggagatcctgctgcccttcgtgctctcactcatgtccgaggagcacacagctgtgtacacggcctggtatctgtttgagcctgttgccaaggcactgggccccaaaaatgccaataagtacctcctgaagccgctcattggtgcctacgagagcccctgccagctacacggccgcttctacctgtacacggactgctttgtggcccagctgatggtgcggctgggcctgcaggcatttctcactcacctgctgccccatgtcctgcaggtgctggcgggcgcagaggcctcccaggaggagagcaaggacctggcaggggctgctgaggaggaggagagcgggctgcccggggccgggcctggctcctgtgcttttggggaggagattcccatggatggggagcctcctgcctcctcgggcctggggctcccagactacacgtctggcgtcagcttccacgaccaggctgacctccctgagacagaggacttccaagccgggctctatgtgactgagtctccccagccccaggaggctgaggctgtgagcctgggccggctgagtgacaagagcagcaccagcgagacctccctgggtgaggagcgggctccagacgaggggggtgcccccgtggacaagagcagccttcgatcaggtgacagcagccaggacttgaagcaaagcgagggctccgaggaggaagaggaggaggaggacagctgcgtggtgctagaggaggaggagggggagcaggaggaggtcaccggggcatctgagctcactctgtctgacacggtgctgtccatggagacggttgtggccggcggcagtgggggagatggagaagaagaggaggaggcactgcctgagcagtcagaaggcaaagaacagaagatcctccttggtaagttcccaggtctgggaggtgttggtcaaaaacacctcctgctggccgagcacagtggttcacgcctgtattcccagcactttgggaggctgaggcgggcggatcacaaggtcaggagatcgagaccatcctaataacaaggtgaaaccccgtctctactaaaaatacaaaaaaatagccgggcgtgggggcaggcacctgtagtcccagctactcggaaggctgaggcaggagaatggcgtgaacccgggaggcggagcttgcagtgagccgagatcgcaccactgcactccagcctgggcgacagagcgagactccatctcaaaaaaacaaaacaaaacaaaaaaacagctcctgcttctccctgcacactggcagagcacctactctgtgccaagcagtggatcgagccaggaccaccggcaacacaaatgtaggcctgccttcacagagctcacacccagcagacgagatgccgcagtgcagacagtcttaagcaagtgtattatgttagtgcgataaagaacatggctgcattcctaggagggagtgcaacatggagcttttcggccgggcgccgtggctcacgcctctaatcccagcactttgggaggccgaggcaggaggatcacttgaggttaggagttcgagaccagcctggccaacatggtgaaaccccatctctactaaaaatacaaaaattagccaggcgtggtggcgggcacctgtaatcccagctattcaggaggctgaggcaggagaattacttgaacccaggaggtggaggttgcagtgagctgagatcacaccactgcactgcagcttgggcaacagagcgggactccgtctcaaaaaagaaaaaaaaaatggtgcttttacatctagttttcaagggtcagagcaggcttccttaaaaggagagacagttgaggttcaaggaggagtaggaagaaggtagacaaaaatgggcaaaaagaaagtctgaaggctgagggaacagcatgtgtgaggctctgaggctgtcatgttccattaaagaagagaagcgggggaccgggcgcggtgcttcacgcctgtaatcccagcactttgggaggctgaggcggatggatcacaaggtcaggagattgagaccatcctggccaatatggtgaaaccccatctctactaaaaatacaaaaacttagctgggcatggtggagggtgcctgtaatctcagctatttggaaggctgaggcaggagaatcgcttgaacccggaggttcaaggaggagagtcagggcggtggaaggtggaggttgcaatgaactgagattgtgccattgcactccagcctgggcaacagtgcgagactctgtctcaaaaaaaaaaaaaaagaagaagaagaagaagaagagaagcagggaaaggccgttatggcgagaccgagggagtggagggaagagaggccagagggaaggtggccagggccgggccaggccttgttaaggagtttcagaagacccacgggcaggctaacttcctgcgggtcgtgcctgtggagaggaacctgcggcagccagagtcccacaggccagggcctgggcacctctgccgctgttacgtggagggggtggtgtgggacagccggcccgggctgggctcttggcagagctgcagccgcaggtggttgagtggggtgccgtggggtggggtgggaggggtgatgagcccctgttatctgaggagctcagggcctgctcccaccccgcagatacagcctgcaagatggtccgctggctgtctgccaagctcggccccacagtggcctctcgccacgtggcccggaacctgctccgcctgctgacgtcttgttatgttggtaaggaggcctgcggtcagtgctggagatgaggctttctcccaggccctctgcctagcttcagcgctctccggcggggatccttcccacccctccctcaaaccaccccccggccaggtgctgggtcccagtctaagtgccagccttgggtagggccaggctgggcccccagctagagtgagctcaagcggccagcacagccctgcagggccargctacccccggccctccactggcgactcagggctgctggcccttccgtggcaggacccactcggcagcagttcacagtgagcagtggcgagagcccaccgctgagcgcyggcaacatctaccagaagaggccggtcctgggcgacatcgtgtcagggcctgtgctcagctgcctcctccacatcgcccgcctgtatggggagcctgtcctcacctaccagtacctgccctacatcagctacctggtcagtcgctggtttggcaggcccggggctgggaaggctgaggacctgagggccggcccrggctctcttggtgccagggggtctgtggggctgcccggccctcatctgctcggtggctctaggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggtaggcctctgccccagctgatgtagggggaccggcccagcggaggggctgcccaggagggggtgggaagctcaggggagaggacgtaacactggactgggtgtcaagagtcctggttttgatcccggctgtgtgaccctgagcaaaccacacccttttcctgtgcctcagtttcctcatctggtttggaccagttggtcttggagctctttcatttaaagcttttgatatgtccgggcacggtggctcatgcctgtaatcccagcactttgagaggctgaggcgggaagattgcttgagcccaggagttcaagaccagcctgggcaacaaaatgagaccccctctctaaaaatatatataaaggccgagcgtggtgtctcacccctgtaatcccagcactttggggggccaaggcgggtggatcacgaggtcaggagtttgagacccrcctggccaacatggtgaaaccccgtctccactaaaaatacaaaatcttcgctgggcatggcagcaggtgcctgcaatcccaggttctcgggaggctgcaatcccaggttctcaggaggctgaggcgggagaattgcttgaacccaggaagcggaggttgcagtgagctgagatcacgccattgtactgcagcctaggcgacagagcaagactctgtctcaaaaaaaaaaaaaagtatatatatawgctgggtgctgtggctcatgcctgtaatcccagcactttgggaggccaaggtgggtggatcgcttgaggtcaggagttcgagaccagcctggccaatatggcaaaaccctgtctctactaaaaatacaaaaaaaattagccgggtrtggtggctcatgcctgtagtcccagctactcgggagactgaggcaggagaatcgcttgaacccgggaggcagaggttgcagtgagccgagatcgcaccactgcactccagcctggatgacagagcaagactccatctcaataaaaataaaaataaataaagattttgctagattctggtcaagtcctgcagaacggcgggctggagctcatgagctctgtttccaggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggtgggcagatctgctgggccagggcgggctggggcgggggctgtggacctgggtgaccccctgggcatcttgctcataggatctgaagctggactccgygggccgtggcgaggaccagggtgggccagggtgggagctgtggacccggctgaccccctgggtgtcttgctcataggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtactgccccatcacgttccccatcacagtcttcgtggctgtctcctcccttggraggccccattctctgcccttgccccagagtcagcagtgggttctaagagccagcaggatgggtgagagcaaagggatttggcctcagacccctacccccaaggtgacacacaaacaaggactgagcagtagccagcaagagaggcccagaagctggcctgtagtgtccctggggaaggcaggagagtcagggaggtggactggcggtccgcaggagctggcgagagggaaggagtggcctcctgtttacgaagcttcccctctgggccctgcacggtgctgtgctgatcgtttcagcgtgtcatctccctggagaggacagacagccttgtggttacacctgttatcatcctgccactgaaatctaagcttgggaggccagggcaccacctgtcttgttccatattctattcctagtgcccagcacggcacggcacatatagaagatgctcatgtgtacatcacaacggaatgaatccacatttcactgaggaggaaactgaggctcagagacagagttacttgcccagagttgcagagccagttcctgccccatcttctgtggctcccgagtccttggatgggtgatagcagccgcctgccatcttccctgtctcaggacctctcccactcctatccaggtgacatcatccggaaaatcatccccaaccacgagctggttggggagctggcggcgctgtacttggagagcatcagccccagcagtcgcaaccctgccagcgtggagcccaccrtgcccggcaccgggcmcgagtgggacccccatggtgggggctgccctcaggatgacggccactcagggacctttgggagcgtcctggtggggaaccgcattcagatccccaatgactctcggcctgagaaccccggaccrctgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctragcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccrcagcacgtggtgagctgtgacggggctgtgcacgtctgggaccccttcacaggtgagcgggcccaggtgaggcctgttctcttcctgctcctgcgccccaccaggcctccaggaagggggcccgagggtggggctgtaatgctgcggagtttggggagacccagcgaggccgcctaggagaacagttagggcttcgaatctgttagacttgagtctgaattggctccaccggcttacttgctgagtgaccttgagcaagttcctgctgctggaagcgtctcctttcccatctataaactgagaatcagaaaaactggcgtagaagataacacacagccgggcgcagtggctcacgcctgtaatcccagcactttgggaggctgaggcgggtggatcacgaggtcaggagatcgagatcatcctggctaacatggtgaaaccccgtctctactaaaaatacaaaaattagccgggcgtggtggcgggtgcctgtactcccaactacacaggaggctgaggcaggagaatctctcaaactcaggtggcagaggttgccgtgagccgagatcgcaccactgcactccagcccgggcaacagagcgagactctgtctcaaaaaaaaaaaaaagaagaagataacacatgtagggttttggcttcatgtgtagcagatatttggtcaatggttgcttattttttggcgtcaccatagggagaaatatggttaaaagggggaaagggatggtgtcggggaagacagagggaggtggcattgggtcagcagcactgtgcagagagaggaggttgctttggggatgggagcctggccgggccatggaagcaggaaggtgggagagtcaagaaacatctttaggccgatgcagtggctcacgcctgtaatctcagcactctgggaggccaggagttggagaccagactggctgacatggtgaaaccccatctctactaagaatacaaaaaaaggccggacgcggtggctcacgcctgtaatcccagcactttgggaggccaaagtgggtggatcatgaggtcaggagatcgagaccatccaggctaacatggtaaaaccccgtctctaccaaaaatacaaaaaattagccaggcgtggtggcggacgcctgtagtcccagctattcgggaggctgaggcaagagaattgcttgaacctgggaggtggaggttgcagtgagccgagattgcaccactgcactccagcctgggcgacaaagcgagactccrtctcaaaaaaagagaaacatctttagcattttctaaggatccctgggggacgggaggcaggtgtgcggtgagttgggggattagaagctcccagggctcttccgtcagctgctgggaccccagatccactgtgactttccttcccagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcaggtcaggggggtccagttccctgagcactcgcctggttctctggggacctggcaaggaggagagactccccaaaaacagaaagccaggatgttgttctggggccctagttagtttctctttggtgctagatcacccacagccacacatcctgcggggcaggactctggcctgtgatgggggtggggttctgggcttttcatgccccctgatgagggtcagaggctcaggccttcctgctgtgtgggcttgggtggtgggcagggccttggggagtgtgagatgggaaggtggtgcctcagctcagccgccctctccctgcagcacgagttccgactgggcggtgggctgaaccctgggcttgtccgtgccctggccatcagccccagtggccgtagtgtcgtggccggcttctcctcaggcttcatggtgctcctggacacccgcacrggcctggttctgcgaggctggccagcccacgagggggacattctgcagatcaaggtgacgggccgggtctccctccccttgctgcccaacccccgcccctgtccagccatcacccctgcttagggtctgcctgcccgggttcaggctcgaactggtctgtcttatatacctggtccaggactaactgggcagggagggtagccctctcggtccaccttgggagccagttgcactgcaggggtctcagcaggaggcaggccatgggggcgggagccacggggcagtggggcgggagctatggggcagggctgaccctgttgctcatggcgatgttctaatgagtaacccttgtccatatttgtcttgcttggaggatcaggggtcaggccctgtccgtgacctagttcaggttaaataaagctgagctgggaggctgtttactgcctgtagaccgctgagcagagtccatggccctgccgggctgccctggctgggggcaggagcacrcctgggcatggggatcctgyccccgtctccttcccctccccctccctccattctcagtcacaggcctcrgggagctgctcagggaggcccaggaggggaggaacagggcttcgtgtgggaggatttctgcaggcagctgggactttcctccccagcttggctggaggccaggagtcttgcattgccctgctgacagcaggctgtcgctggctccctccagagccccagggaaccctcagctcaaggtgcccccaaattctaactttccaagaaagtgtcaggagggctctggggtcagcctgggtgttaatcccagctctgctgcttgctggccccatgaccttggtatggttacttcacttctctgagcctcrcttttcctgtttgtgaaatggggacaatggcagcatccaccgcatagggttgttacgaaggtcaaggtcgtcacgtgcacgcctggcaccatgcctgtgcgtagttctcaagttagagtgacgactgggttacggatgctgagcgtattaaaatgaaccaacgtgaatatggtgtgtgtgggagggtggcggcttgtcacccacccaggacggcctgtctccctggagagaaactgcggagggaactgggaaggccttggggcccaagggtatgcagaaggacccaggctcctgctgaggctctcctctcccgggacaggcggtggagggcagcgtcctggtcagctcctcctctgaccattccttgacygtctggaaggagctggagcagaagcccacccatcactacaagtcagcatccgaccccatccacacctttgacctgtacggcagygaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccrctcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctcygccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaagggktgagaagaatcatctctgcacctcgggtctctgccagaggaagacttaagcatccctgcgacctcacattctagacagagatgaggtccargggttggcccctgctgccttctcacaatttgcaatagatgtaaataggaccaataaatcctttggaagagccatggggtgaactgaggcttgtctttttttttttttttcaatagagatggagtctgactatgttgcccaagctggtctccaactcctggggctcaagcgatcctcctgcctcggcctcccaaagtgttgggattacaggcatgagccaccacgcccagcctgaggcttatcttgctggtggtgtcagggtggggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggagtgaggagcagcacagtgagggtgggaggcggcctgatgcagggagtgaggagccggacagtgagggtgggaggcggcctgatgcagggagtgaggagcaggacagtgagggtgggaagtggcccgatgcagggagtgaggcgcaggacagtgagggtgggaaggagcctgatgcagggagtgaggagccggacagtgagggtgggaaggagcctgatgcagggagtgaggagccggacagtgagggtgggaaggagcctgatgcagggagtgaggagcaggtgtgagggcgggaagcggcctgatgcagggagtgaggagcaggacagtgagggtgggaaggagcctgatgcagggagtgaggagcaggtgtgagggtgggaaggagcctgatgcagggagtgaggagcaggatagtgagggtgggaggcggcctgatgcagggagtgaggagcaggtgtgagggtgggaagcggcctgatgcagggagtgaggagccggacagtgagggtgggaaggagcccgatgtagggagtgaggagcaagtgtgagggcgggaagcggcctgatgcagggagtgaggagcaggacagtgagggtgggaaggagcctgatgcagggagtgaggagccggacagtgagggtgggaagcagcctgatctttgcacgggctgccaggcttctggttcatacagccccaggtcagtttccagaaccctcgctcttgggtaggggaaagagacattgctctggagtggcaggacggtgggagaagttgagtccctctcatttctcctccctcaccccctgccttccatcccagtctgaaggcagccaacctgatcctgggcttggaaggttgggggtgggcttcctatcctgggctctctgcataggctcttgtggcttcccctttcctcccctcaggagcgggaggcagctctctgggagaagaaaggacattgggagtgagaatctggatgtgcctcagcccagctctgtgtccttgggcaggtcacatggcctctctgagcctggctgaaccagggataatccacacctcgtggggtctctggaaggcttaacacagtgctaggttcctgtgctttctggatccgccctcttggctagccagatccagtctcttcaactctctcctcctgaactttctctttccaggctcggggggggggacccaaatatagggggttctgcgtggctgcctcagggttagatgccctggtgggaaaggggcttctggcttcaagatcaatgtttaactggatgtgcaagtcaatatttaccagaagagaaagcaatctgaacaggggttggctgagagtaaaggtcctggtgggaggggaggggtgggctgggccagctggagcctgggcagagagtgaggagcacccaagtggggccagaggaacgttgtgtgtggcagcaaggagcccgcagaggtatgaggggaggggctgctcggcctgctccttgggtaggagaggaggagggagctgcctccctggctgaggggtctgggatttattcaggaggcctgtcactccccagcctcttctgggacttgaaaaactggagcctgttcttggcaagaagattctaatgcccaggtcggagtcggggccctggccaagggctcttgtgtgggatgggggtggggccggggggaccaaaggatcctccagaagggttggccccaagatgggggtgggctggaggtagctgagacctgctctgacttatcctcctgagaccaacacctgcccttcccagagccagcctggagcagaggcctgtgatgctcctaagtgcagaggtggctctggccagagtcattcactgggctctgctgctgggtcaaaaggcagctctctggctgccttgccacccatggtgagacctcagggcctcacaggtatgtccagccttgtgggcaagacctgaccagcctgagaaagacgggttggggccaggcgtggtggctcatgcctgtcatcccagcactttgggaggctgaggcaggtggatcacctgaggtcaggagttcgagaccagcctgaccaacatggagaaaccctgtctctactaaaaatacaaaattagccaggcatggtggcacatgcctgtaatcccagctactcgggaggctgaggcaggagaatcgctttaacccaggaggtggaggttgcagtgagccgagatcgtgccattgcactccagcctgcatgataagaatgaaactccatctcaaaaaaaaaaaaaaaaaaaaaaaagacaggctaaatggatgcagcaggctgggtaggagctctgtgttggagctctgcggtggaggcttcagggcaggcttcccagaagaggtggccttgagccaagctgaccccagccatcgggggagtgccaagcattgtactcagggtttacaaagatggtcttatttatttttttgagacagagtcttgctctgtcgcccaggctggagtgcagtggcgtgatctcggctcactgcaacctccgcctcccgggttcaagcagttctctgcctcagcctcccgagtagctgggattacaggggcccaccaccacgcctggctaattttgtattttcagtagagatggggttttaccatgttggccaggctggtcttgaactcccgacctcaggtgatccacctgcccctggcctcccaaagtgctgggattacaggcttgagccaccgtgcctggtcacaaagatgggtttttgcgacgcgcaaaggctcccgaccggagcacacgccggctgacctgactcgaggaagaggagccttcacgtgcgtcctgcacccttggccctgcgagactaccgtgaaccccgagaagggatcaggcgccgatctgaccaaccggaggcgggataagccactccctaatannnnnnnnnnnnnnnnnnnnactgctgactctggggcaagggcagagaatggggcctcccaagggaggagacagccacaaagactgtgatggggaacgtgatggggcagtacccaacaggcaggagaagggcacgta

SEQ ID NO: 1707 - DNA, 13242 bp, Homo sapiens
aggaccatcccagtcagtgaggaccatcccagggagtgaggaccatcccaggcagtgaggaccatcccagggagtgacgaccatcccaggcagtgaggaccatctcaggcagggaggaccatcccaggcagggaggaccatctcaggcagggaggaccatcccagggagtgaggaccatcccaggcagtgaggaccatctcaggcagggaggaccatctcaggcagggaggatcatctcaggcagggaggatcatcccaggcagggaggatcatctcaggcagggaggaccatcccaggcagggaggatcatctcaggcagggaggaccatcccaggcagggaggaccatctcaggcagggaggactatctcaggcagggagggccgtcccaggcagggagggccgtcccaggcagtgaggaccatctcaggcagggaggaccatcccaggcagggaggaccatcccatggaagtaagggccatctcaggcaatgaggaccatcccagggtggtgaggataattctggggcagtgaggattattccagggcagtgaggaccatcctggaccagtgagtactatcccagggcagtgagaatcattcgagagcagtgaggagtatcccagggcagtgaggactatcccggagcagtgaggaccattctagagctgtgaggactatcccagggcagtgaggattatcctggggcagtagggactatcctatgacaatgaggaccatcccagtgctgtgaggaccatcctggggcagtaaggaccatctcagtcagtgaggatcatttcagtcagtgaggatcatcctgtggctgggaggaccaccctggggccgtgagactcataaaatacctgtgaagatcattgcaggaaaggaagaaaccattctgtgacaggtggaggggtccctgggataaagtggagcgatgggtcccaggagtggtgagggcagggcaggccttccaagcatcctggctgtgctcatgcaggcaggagatgtcacagcactgcttctcctcccccagaagtctagctcagaacttggcctccggcctgggcactgcctcatacctgccagaattgatctcaatggagctgcacaatgagaggttttgcatgttgtctagaggactttggttgagttcagagctgagcacacttgccttcagactctcctgggactcccaggtaactgattcaatgcttttgatactgggctcggggccgtaggtaagtgatgggagcacattgacaatggcccaggcttggaagttgggggttggaacacttaaatgggcagtctcggttgttgacaggtagttttggtcatgatctttgttgctggggataattgatgattagtcagggggtgagagccttggatactgaagcagcgagtttggaaaattggtgaagcacctcgcatactgaaatcgtggctgtaggtaatggctggtgtttctgggatactgatctgttgactgctgatagctggtgtagggtcttggatactgacctggtgattgtgaataattggcaaggggtcttggatactgaccaggcgattgctgctggctggtggaggctgttggatactgaccccgtgactgttcctggctggtggagggtcttggatactgacccgggaattgtaggtaattggcaccaccgtgcctggctaatttttttgtaattttagcacagatggggtttcaccatgttggtcaggcgggtctcgaactcttaacctcaggtgatccacctgcctcagcctcccaaagttctgggattacaggcataagccactgcgcctggcccttattattattttttaaggtatagaaatctagaatttttttttttttttctgagacaaagtctggctctatcacccaggctggagtgcagtggcatgagatctcggctcactgcaacctccgcctcccaggttcaagccatcctctcacctctgcctcccacgtagttgggactacaggggagtgctactattcctagctataattttgtattttttggtagaggtagagttttgccatgtttcccaggctggtctcgaacttgtaagctcaagcaatctgcccaccccagcctcccaaagagctgggattacaggcatgagccactgtgcccagccttagaatttttaggtagtttaatttcttcacctttgtctctgtgactttattaattgcttcttggcttcgggaggttctccctccagatttttgatgaacattcagttctgtttttttaaattctcattacttatttttaggttttgattgtgattttggagttggtatgcagggaacattgaattctgtgctccctgctgtcctaaggaagggacttgaattagtcaggagtttttgggtcacaagtgacacaaactctttttttttaaattttttttattttttacttttttaaatttgagatggagtttcactctttcacccaggctggagtgcagtggcgtgatcttggttcactgcaaccttcaccccccgggtttgagcgattctcctgcctcagcctccggagtagctgggattacaggcgcccgctgccatgcccggctaacttttatctttttagtagagacggagtttcaccatgttggccaggctggtctcaaactcctgacctcaggtgatccacctgcctcggcctcccaaagtgctgggattacaggtgtgagccatcgtgcccagccacaagtgacacaaactctaacttgaactagcttgagtgaactagttgtattagcttgagtgaactaacttgaactagctaggggatcctttatgggatcacctgagtgaaaaatggtaatggtaggaatgccttcaggcatgggtggatccaggggcccaagtgatagtatcagatattactgttttttggctatgggattggcttcattctcaaggctctgtgtagtggcaagtcagaatccagtaaggaaaataaatcattccagattcttcagaaggaagtaaatacagggaatttgttcgtgagtaacagaggagctgagaagccaataggaaatagtgaggcaaaccaggagttaggaactacaggatgctgctacttggccagaaggacaaagggaggaggtggtattactacagtccagaaactgcagccctctggaacgcataggttcatggttggattgctcagaagtggctagaatcagagaatagatacaactactacggaagacccaccacatgcagagatagagaggctaataaataccctggcttgccctctcctcccagaaccagtcttctgccagtgcctcccattagtcaaacacagtgataagatggtgagcaaaggaggctgggaaatgtggtccttgcagtgcagaacaggacagggcgggaaatggatctgagagcagacagacaaaaaactggcagagttgttagcaacttggcagagttggtaataactgccgagtccggtagaaaaaagttatcaacagttcttgcaagaatcctgtgtggcttggggcacatgagcaccccgagccaattatatggccagtggagtacagttggctgattggcttaagactggggctgagaatggggaatgggcaggaggtgaaatgcatggtggggaggtaagctgcaaatatccactcattctgaccaaatcacagagtgggctgctctctgggatgacgagagccagggacttcagtgtcagctcaatgctctttcgcttgtctgttttccttcttagttttactctccccatgaagctaggtccaaggcttaggcagcttcaggcttgtaatccttgaggagagactgcttttccttgacagcttcctaataaaaagtcttggggcagagcttgattggttgggctttggtcatgtgtccatctttgggccaattgcagggtctgcagctggggtactgtgattggctcagccagaatcacatgattacctctgtggcccagaggccagcatatgccaggagaatccctcatccagggttatgtgagttgggtggagggtgtccccaagagatgtcaggctgctgttctgggcagaccaaattcaccattcaaggtcttggtttctggcttggtgccttctccctgacctctgcttcttgactcttcaatgagcagaaagaactaagggaactggctgggcatggtggctcacacgtgtaatcccagcactttgagaggccaaggagggaggattgcttgagctcagtaatctgagaccagcctgggtaacagtgagaccccatctctatgaacaaaacaaaacaaaaacaaaaaaccaaggggtctgatatttcccccacttcccagagtgctgttgctcttctgtatatatgatgatcctttatctttcttgttgggtattagagatgtgcagtttgccagaaacaaagcagatgaggtcttggcctatttggctaaaacaattttgcactgttgaaaagtagacaaagtagaaaaagggctaaaaggaggagatgtagcatctcggaaacaggtaaacctctcttctgctggaagtctaagttggataaatatccactgtaaactggaactaagcttttgggcacattggttttagagtatttgacttgaaagtttttcttgtgtgcaaatctgtatgtgttttgtgggggctctcaggtgtgaacaagagatgacattaggatgtctgaggagattctcggcatgtgaatggggccactaggggaccttggggggtgactagcagagactagagcagaagtagggtgactttggagaggactggggtgaccgtggtgtcttggataactttgagggtgctgttgagggtgtctgggagtgaaactgaggatactaacatgagttgttatgagacaccttttaggagttcaagtagggtgaccaggggtgtctgtgggggtggttctagaaatgatcgaggctgggctcagtggctcacgcttgtaatcccagcactttgggaagccgatcacctgaggtcaggagtttgagaccagcctggccaacatggtgaaaccatgtctctactaaaaatacaaaaattaggctggcgtggcagcagctgcgtgtagtatcagctaatcgggaggctgaggcaggagaattgcttgagcccaaaggcagaggttggagtgagccgagatcacaccactgcactccagcctgggcaacagagcaagactccatcttaaaaaaaaaaaaaaaaaaagaagaagaaagaaagaaatgattgaggtgattctgtggggtaaccttgaggatgagtgggatgacctttggggggtcctctgtggggtgaccttggggggtgtgtgggattatgagagtgtctgagaattgagttttaggttaagtaggggtgatttgggacaactctaagggtgtgactgggggatgactttaggggtccctgggggtgaccttgtgagtgagattggagtttctttggggtttctaggaggtgactttggggaggtgagtaggggtgattttgaggatgtgccagactttggggttgtctgttgggctgcttgtgggtatcagcagagatgactttggagggtgaccaagaggggtatctggggttgactctggggcccctgtccccctctccccagttctcatccatatgagcaagggcttcatgttactggccgtggccctgtgctgagtcctcctcccgcccatggccctctcctcctggccagtggtcctccgcctgaacatggccgactttgtcttcagtttcctctgcctcggcattggtaggtgttggcttggggggcgggggccctccctaaccccagccctgctctctggctttctggaggtgtatctagacttccgtgctgctcccctcggggcctctgtcttagcatgtctctggggagctctgactcagttctactctatctgtgggatgtctctctcccccactctctgtttccctttctttttttgtcccctctctccaggtatctttctgtctgttgtgagggcgtgtgtgtgtgtgtgtgtgtgtgtgtgtgtgtgtgtctgcttgtcacggagggtgggagaggatgtctcagtccctcttttcttactgggggtcatagggctcactgtccagccttctgtctctggccccaccccattgcagggctcctgatttctcttcagcctgacgctcttttcagttaacggcaaggcggtgcacccaagtccggtggtgtcctacctggtgacctcctacctgtgctgggacgccagcgacttgatgctgcactccggtgagggcggggcctcgggaggagggcggggcctcgggaagcgggtggggcctagggtgggactcggagtacagcggcccacctagccatctcccaggagccgtgtcctacctaagcccagtgggcatgtgaagcagagggcagcccttgaatgcgcggcggctgagctaccgcgggtgggccgtgcagcagggcgcagcgaggcggacatccaaacagcggaactcagacgctgactccgagcgcaccccgggccttcccatttcatacacccwcgaggatgagacccaagcacctccaaggaatagcacccgaggtcttcaggacaccgaccggtagccatggccagatgcccggccaaccccttcagcgtggccacgccctggatattcgacctcccctgaggccccaccccctgatatcaggccacgccctccgaggggaccggtggcaaactccagccctcgctctagggcccgccctttgcggctttgtccctgcccactgggtcctcacagtgcctccaccccagaggcccagcatcccctcccgttctgcagacacttgtccagcgtcccgctgagctcggcagtgtggctagtttgtgtggccctgcccctggtgcccagccttcgcaggccacaccctgaagccactctccacccgctcagccagggtgctccgatgtccacccttgtcccggagttccggcctcagctccgatgtccacccttgtccccaggtggacacagcaccgcccagcatttggtgcaactccacccttctgcagaacgggcccctccctgggaaggcatggcttgcaataacatccctctgtaccttttctggcttccccgccacaataaaacctctcagcctcagaccttccattgccccccacctccccaccagggcagggtccatcctagtgtgagtgaactgttctggcgtccctgactcgccctttgggatctgagcctttccctgcctgtttgtctgcacctgtcacagccccttcctttccccacctgctggtgacctcagacttccaggcatgagattgacacagctggggtggccccagcctcagccgagtgggtccaggtgcaccacatctggaaagataggtgatggcagaacgtgacacacattggatgcacatttgattttactgggggtaggggacagggctgggcgttcaggagttctccgctatggtgtcctcgatccacttcacataagacagcactctgacggcgacagaaggcttattgggggtgccacaagggacgtagccccatgatgtgacaccttggagcacaccatcacacatcagcgggccccctgaatcaccctgggagcacaaggtgggaggggagagtgagaaaggtctacggggcccaagttctgcctggggagccccagctcgcagacagggcctccagtgcccactcccagaggaaggtgggcagggattcccacagaggggacagggtctccagtcctggccaagggggaagggacctcagggtccagctcctgcacatggggcagggtccaggtggacagtgcctgcagacaggttagggggaggaggggcaggaccatctgcaggacgctgcccctgcgggcacatcgcagaggccacctctccaggactactctctgactcgacggtaacaacacattaccacgaggaacggtgaactctggtgtggggggtgagatgcagttgtccctggatgggcgggggaaggagggggagctggggcactgatggggcgagtggctacagctagctgggaagcagtgaagcagatgcctggttagctctcagaagccagttcagaggctgagtcccctccctcagcccttccagaccctgggggcagggctgcctcaccacacaggtgtctttgccaccttccaggtgtccgacacacagcatgaagtctgtcaccttctggacgtgggcttttttgcactcatcattaggcaggattttgaggtccacacactggagatcatctggaaatgagactacgaacccgggagaaaaagggctgcagcccgacctcacctgcttccctggccctttctcccttggacgcaggagtccccatccccgccttgggctacacagtctgcccccacatacaattctctggttcgatgctgccccagccggaagccaaacaggtgctccccacttcgggttcctcggtgggcaactccacgaccttcacagcgtctgtgatggtatcagcaggctctgtcaggcggagcagcatgaggtcgtggctgtagtcctcgtctgcttggcgggtgtggttctccaggaggctcatgttgaagccagggtgtgggaagctctcactgacatgaacaaactgggctgtgttttcgtcgtcaaacaagttgtggcgacccagccagagctggtaattgctggggaaagatgggaatggagggatgagaagacgggaaggggaaaaggggatggggcaggggagcatgggggagggtccccaaagagagaaagggaaagagaaaaatgtgggtgggcggagacagaggaagaaagatatagttatggagaaatacagacagcgaatgggaagatgaaagagtttgagagtgcaaaaggcaaatgaagagacagagcaaaaaagagctcaaaaggacagaggggtgagaaaggcggaggggagggcagtgagaaacagggtgagcaaaaaagaggcagatgagaaggataaaagacagggacagcgagaaacaggcccagggaagagggaggaagagggaacagaacacggaagggagcgagaagcagacaaatgaaaaaggacgcgggacgtcagagtgagaactagaaacagaggcagagaggaagcaggagtgaccgagtgtgggagagaaaagggagggaggccctgggggagggtgggggcaggtggggagggtgggggcaggtagggaggaggggaggcctgagagcggctcagctgcagctggggctgtggtgcgggctccccaggggcaggtggcctggcctgaagtccaaggtcgaggcccccttcccttcccagcaccctcccgcgcgtttctcgccccgcctcctccttcctcctccctcagttgccccacccagctcccgctgaaaccagcccttccctgtgtctctccagagtggagggatatcctgtggggcggggagctggacagagggagaggcgccccctcccaggcacacaagttggggataaagcccttcctttactctggggcctcccttaggtccatctgggtgtgtgtttagtagggatgagggagcggtgaggtagagacccagagagagagagatgggtagagagatggagggtgagacacagtgacagagatgccgcagagagactcagagacagacagagacaggggagatgcagagacaaggagacagaggagagagaggaagacagagaccagaacacagtcacacagagacacaagcagaaccagatcccaagagacccaggcagccttggagaggggtgtccagcccagctctgccctgccaggcgacctgcgccagagccttcctctctgcctcagccccccagtcttgcctgaggttatccaaggggaatgccactggcctgtcaatcctgtggcagcatagatgccctcctcccagaccccaggcccctactcactcgctgatgcaatgagcagctgtgagcacccactggcggtgcaccaggatgcccccacactggaaagtgctgaaatggtacagagccgcctgccagggctgggaatgctgctcacactcccagcctcccacaatccgggactgaatcgggggcgcagcacctgcagaggcggtgctgggtcaggaagggcagggttggcaggagaggccagggacaaggctaggagagggagctgggctgtgggtctgaagggacattgcgggtagaggaccagggctggaggttggggacatgggcaaggggtgttgggaaggggtgggactctggactgttccctgggcttttggagtggtggctggacctggtggggagattttgtgctctgacagtagagcagcctccagggatcagggtaggagacaggagacagtgtctggagcagacactgcatctgggcgtcaggtcatttggggtctggggctgggggatgggaggtggtgggttaggggagtggaaagggattctggaaaccagggatcaaggcgccaagggtgggacaggatcagaggctcactgaggaagaatctggagggctaaggggctcctaggctagggaaacaggacctgggttgggcttttgaggttcaggaaaggatgcagctttagggaaccaggtctgagaggtaaagaagagcatctggactgaagagtttgggggtgacttggggtccctacattggggttggaaggggccagcttggctgggacagttagatttcagggcttcctggttaaagggtaaaagaaagggctatggttaaggctagaggtgggcttccgagaggttttggggtccttcctgtgaaccaggaatggcaatctgaggggaggttggggccctgagaacacagttgcggtcaggactgggacggggctcaggaggagggaggcgtgagtggcagtccttctcggacagggtgaaggatgggatcttcgtttctcatggggatggggttcatggtctgagggtactggaaggatatggggtcctcttggaggcaatcctaggaagaggattggagaagtggtgagaacaggcgccaagcagctgtgggaatgcaatgcaggacccacttgatgtgaggttgtagaatcacatactgacttgggggaggccagggcagaagcgctggctgagaaggcattcaggatccttggcgtggggttccagaaaaccagagctgtgtaggaacaattcaggcagagaagggctggggcctggggcgggatggaacttccccaaggaaaggagcatgtggtgggagggtgtggtgtttttcctgggagagctgggggtgctgggtgggaagggacatttgcagacccccccccataccagatgggggatcccacatgccagtttgggaagcagggttttctggtgaaatttgggggaccctggaaggactggggagaccagatgtcagggtctggaggacacagttgagagcggacagctggatggaaaaagtcactggagtgtggtgggatttgtagactcaggagccaaataggtggccgcagggaactagggggcaggaggggatgatcagagtcctgtggggtgggggaagcccatgggagggttggggtcctccagagagagacagagatggcccagaatctgcccctttggtaaagcggtgggacagggcgttggctagggaagaggagaaagtactgaggcttcctgggaggagcaggaatctggtgtgggagtgagcactatgacaacatggaggagcgggggtggaagtttagggtggggccgcgcaagatagataagagccggggcaccccggactaggatagactgtgggccagagggatgagggtggggtgttggaggggaaggtcttatcggggggggatgtgaggccagcaagagaatcagggcccgttccccctcccacatccccccactgtctcaccagtcccccccagggacagggcgaggcacagaaccaggaaccacatggtgacagaggtgtccaggggccagcaggtggaggaactggggaacctccctggggaggcttttaaaagcccttatcccctcagagccccacccctgccctgctggcacccagatgttggccaaggcccttcccctgttgcctgggggctggacaattgcccccccccctccgatccccagagctgtagacggggagggagaaccagcacctgttctgcaggccctggatcacgctggacgcattcctggggttgaagccaggtggggcagggcctgtggctctggggctttgctctggggagcagccagtgaggcaaggggggactgaggggaagcagaaacaggaagacggaggaatcagtgacccctggtacaaagccccatatacctcagtctcaattaaggccctgcacccccagacctggtgccctcaaacaccagcagttagggctctgattccctgcaccactcggagccaagatactagcatctcagctgccagttccccctgaaatataagccttggccttcagaatgccctggttcttgcactcccagacccaggacctaggtccccaaagctactgttcctttcataataaaattttggggtacacatcaccacattcctagtgcctccagatccaggaatgtgaagtttcaggggtctcccagggtaagttctttagcattacaaaatccagtgtccctcccaaacaatgctggggtctcaatgagcctcccacttcttgctcccagttatgggtgctcaacgtcctgtcctccaaagtcccagagatctggacaaccttccctcccaggtcaagatcaggctaaccacagattccaatgacccttcccccccaccaccagtacaatatttaggtctcacgagccaggttcatgtacttcaacattcagcgaccttgaacatcacattttgtggtctctgaagataattaggaactagattcctgcagcctcaatggtaaacccataggcttccaacaggttgtcttggctttttggtaaaatcaaagcagctcagagttccagcctctgctgtatatcagggacctggctaaggaaaggacagtatttgcctttttgccatggctaccaggaagccca

SEQ ID NO: 1708 - DNA, 19532 bp, Homo sapiens
  misc_feature (1)...(19532): n = A,T,C or G, or insertion/deletion polymorphism (see Tables 1-2)
tctaaggtatatagatcacatatatatcatatgtgatctatatatagatcatatatatatatatgtgatctatatatatatatatatatatagatctatatatatatagatcacatatatatatatcacatatatatatatcacattttcttcattcacccattaactgatgggcatttggggtggttccatatttttgcaattgtgaatcatggtgctgtaaacatgtgtgtgcaagtgtctttttcatacaatggcttttttcctccagtagtgggattgctggatcaaatggtagatctatttctagttctttaaggcatcgctgtactgttttccataggttgtactagtttaatttcccaccagtagcatagaagtgttctcttttcatcacacctaccccaacgtctatttttttttttatttttaaattatgaccattgttacaggagtaagttggtatcacatagtggttttgatttgcatttccctgataattagtgatgtagagcattttttcatatgtttgtcaaccatttgtatattttcttttgagaattgtctgttcctctgcttagcccactttttgatgggagtatttgtttatttcttgctgatttgtttgagttttttgtagattctggatattagtccttttttgtatgtatagcttgcgaatattttctcccactctgtgggctgtttactctgatgattatttcttttcctttgaagaaactttttagtttaattaggtcccatctatttatcttgtttcttttgcatttgcttttgggttcttggtcatgaactctttgcctatgccaatgtctagaagagtttttccaatgttctagaatttttatggtttcaggtcttagatttaagtctttgatctaccttgagttgatttttgtataaggtgagagatgaggatccagtttaattcttctgcatgtggactgccaatttccccagtaccatctgttgaatacgctgtcctttccccactttatgtttttgtttgatcagttggctgtaagtatttggttttatttctgggacttctattctgttcaatttgtctatgtgcctgtttttataccattcccatgctgttttggtgactatagccttgcagtatattttgaagtcaggtaatgtgatgctccagatttattcgttttgcttaatcttactttggctatgtgggctcttttgtagttccatatgaattttaggattgtttttttctagctctgtaaagaatgatgatggcattttgatggggattgcattgaatttgtagattgcttttggcagtatggtcattttcacaatgttgattctacccttccatgagcatgggacgtggttctacttgttagtgtcatctataatttctttcggcagtgtttttaattttcctcgtacaggtgtttaacctctattgcgggaagtcagggaccctgaatggagggaccggctgaagccacagtggaagaacataaattgtgaagatttcatggacatttatcacttccccaatcaatactcttataacttcctatgcctgtctttactttaatctcttaatcctgtcatctttgtaagctgaagatgtatgtcacctcaggaccctgtgatgattgcgttaactgcataaattgtttgtaaagcatgtgtgtttgaacaatatgaaaactgggcaccttgaaaagaacaggataacagcaattttcagggaacaagggagataaccataaggtctgactgcctgcagggccaggcagaacagagtcatatttctcttcttgcaaaagcaaataggagaaatatcgctgaattcttttgtcagcaaggaatagccctgggaaaagaatgcattcccgggggaggtctctaaaatggccactctgggagtgtctgaattacatggttgaagataagggatgaaatatgccctggtctcctgcagtgccctcaggcttgctaggattaggaaattccagcctggcaaattctagtcatactggttctctgctctcgaaccctgtttcctgttaagatgtttatcaatgacaatgtgtgcccagcgggatgtggaacctcatcagtgattctagttttgccctctgccttgtgatcttttactgccctctgaagcatgtgatccctgtgacccattccctattcatagacccccaccccttttgaaatccataataaaaacttgctggttttgcggctcaggtgggcatcatggaacctgctgacatgtgatatcacccccggagacccagctgtaaatttctctcttttgtactctttctctttatttctcagactggcccacacttagggaaaatagaaaagaacatactttgaaatattgggggctggttcccccagtaaacctccttggttaggtatattcctaagtattttatttttttgcagctactataaaaggggttgagttcttgatttaattctcagcttggtcactgttagtatatggcagtgctacagatttgtgtacattgattttgtatcctgaaactttactgaattcatttatcagatctaggagctttttggataagtatttatggttttctaggtatacagtcatatcattggtgaacagtgacagtttgacttcctatttactgatttgtctgattgctctggctaggatttccagtactatgttgaatagaagtggtgagagtgggcatccttatcttgttccagttctcagggggtatgctttgaacttttccccgttcagtataaggtcggctgtgggtttgtcatagatggtttttattaccttaagttatgatctttgtatgtcaagtttgctgagggttttaataaaaaagcgatgatggattttgtcaaatgctttttctgcatctattgagatcatatgatttttgttttcaaatctgtttatgtgatctatcacatttattgacttgtgtgtattaaatcatccttgcatccctggcatgaaacccaatttatcaccatgtatgatctttttgatatgctgttggattatgttagcttgtattttgttgaggatttttgcatctattttcatcagagatattggtctgtagttttcttttttattatgtcctttcctggttttggtattagggcgatcctggcttcatagaataatttagggaggattctctccttctctgttttggaatagtttcagtaggattggtaccaattctcttctttgaatgtctgattgaattcagctgtgagtccatgtgaatctgtgattttttatcgttggcagttttttaaaaattaccatttcaatctttctgctttttattggtctgttcacagtttctatttcttcctgatttattctaggagggttgtatatttccaggaatctgtcttctctaggttttctagtttgtgcctgtgaatgtgttcatattagccttgaatgatattttatatttctgtaatatcagtggcattttcttccattttgtttctaattgaggttatttggatcctctcttttcttggttaatctcactaatggtctatcaattttatgtatcgtttcaaagaatcagcttcatgtttcatttatcttttgtatttttttgtttcaatttcatttacttctgctctctttgttatttcttttcttctgctgggtttgggtttggtttgttcttgtttctctagttccttgaggtgtgactttacattttgtatttgtgctctttcagactttttgatataggcatttaatgctatgaactttcctcttaggactgtttttactgtgtccgagtggttttcacaagttgtgtcactattatcattcagttcagagaattttgcatcttgatttcactgttgacccaaagatcattcaggagcaaattatttaatttccatgtatttgtatagttttgaaggtttcttttggagttaatttccaattttattccactgtggtctgagaggggacttgatataattttgattaccttaaatttgttgaggcttgttttgtggcctattatgtggtctatcttggaggatgtttcatgtgctgatgagaagaatgtatattctacagttgttgagtagaatgttctgtaaatatctgttaagtttatttcttctagtgtaacttaagtccattgtttcattgttgactttctgtcttgatgactttctagtactgtcagtggagtattgaagtccccactattattgtgttgctgtctatctcatttctcatgtctagtaataattgttttataaatttggaagctcccatgttaggtgcatatatgtttaggattgtgatattttcctgttggagttatccttttatcattgtataatgtccctctttgtcttttttaactgttgttgctttaaaatctgttttgactgatataagaatagctactcttgcttgcttttgttttccatttgtatggaatatctttttccactcctttaccttaagtttttgtgagtccttacacattagatgactcttgaagactgaagatacttggttgctgaatttttatccttcctgccattctgtatcttttaagtggagagtgttaatattgagatgtgaagtactgttctatttctcatgctagttgttgcctgaattccttatttttttcctttgcattactgttttataggccctgtgagatttatgctttaaggaggttctattttggtgtattttggagttttgtttgaagacttagaactccttttagcattttgtgtagtgctggattggtagcggtgaagtctctcagcatttgtttgtctgaaaaagactttatctctccttcatttatgacgcttagttttgctggatacaaaattcttgcctggaaattattttgtttgaggaggctaaagataagaccccagtcttttctggcttataggctgctgttaatctgataggttttcctttataggttacctgatgcttttgcctcacagctcttaagattctttcctttgtcctgactttagataacctgatgactatgtgcctgggcgataatctttctgtgataaatttcccaggtggtctttgagcttcttgtatttggttgtgtagatctctagcgaggccagggaagttttccttgattattccctcaaatatgttttccaaacttttagatttttgttcttcctcaagaatgccaatcattcttaggtcatttaacataatcccaaatttcttggaggctttgtttatttattaaagttcttttttctttgtctttgtctgactgggttaattcgaaaggcttgttgtttgagctatgaagttctttcttctacttgttggatcctattgttgaaactttccagtgcattttgtatttctctaagtgtgtctttcatttccagaagttggattgtttcttctttatgatatctacgtccctggggcatttttaatccatatcctgtgtttttaaaaaatttatttaagttgtttttcacctttctctggtatctttttgagtagcttaaaatcaaccttctgaattctctatctagcaattcagagatttcttcttagtttggatctattgctggggtccagtgtggaggtggtaggggagtgaagtagactctgtgagaatccttggttgtagatagacttagtgtggtggctttctcaaatgctggttatgctagcagtgcagttgtcatgtgaacagaccgaagaccactggttagtcaagatttttcagccagtggaattagctgttttctcctttcttagagcagttattctgtcgtgaattgttgtaatgtcctgagttggttggcctccagccaggatgtggtgctttcaagagggcaccagctacaatagtagaaggtggatataagcttgccctaagttggccaagataaatattcagtttctcaggcaatgagtggtgtcataaagctcccaagagtttacgtcttttgtgattggctaccaggtgggtagagaaatgccctcaggtgtggacagggttaggcaggtctgagctcagactctcctcgggcggggggcttgcggcagccactgtgagggatggggtggagggtttttctccagccaatggaattatgttccagagggcattatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctttttgttgcgacggagttctcactctgtcacccagggctggagtgcagtggcgcgatctcggttcactgcaggctccgccttccgggtttatgccattctcctgcctcagccttcctagtagctggcactacaggcgcccgccaccacgcctggctaattgttttgtatttttagtagagacggggtttcatcgtgttagccaggatggtctcaatctcctgaccttgtaatccgcccgcctcggcctcccaaagtgccgggattacaggtgtgagcggcagcgcccggcgtacttttgtatttcatgctaaatctgtttcaggtctaggtaaagttaaatccttttcctgtaatctggattttcgagttccccagtggggacatgggtccggaggcaggtttttcccctctcacgctttgggaacgcacagtttttcacytgtctggtggagtttgcagtggcccctcccttctttaaaaggatctgtgaattctttcgattttctgggtattctcctgcagtggttcctttcttgagggatctgtgaagtgagttcctcaagatatttcttgtcaggtgaacagtctgtggtctctgcagggcctgtaccacccctgggcactgtatgccccacagagtgggcctctcctgtgcagggcctgggaagaggttgattataatctggtgtctgaggcctggcagcaccacactctcttcagtgagtcaggctcaagtctgagcacatctgcagagcttatgtttgctgtgttgctcatgkaaggcagggaatccaaaattgttttcttagagatggactctcactatgtttcctaggctgctttcaaactcctggcctcaagtgatcctcctgtctcggcctctcaaatcactgagattacaggtatgggccactgtgcccagcctattatcgattttctcccatttcattcagtcctcaacccaatgyactctctctttttctttccctcatctctgatgctcctctcagggtggcaactaatgacttttatacaactcaagccagtggtcactgttctgtttctgtcttatgtgtgtcattagtgtgtttgagatgcmycctctcctctttcctggaagttttctcctgtctsttgtcttttatgaacccrcttcctctctgttttcctaccamtttctagtcctctgcttttcagcctctttcttcatgtctgtgtttgtctggatgcaggagcacacactcagatccctgctatcctgactttgtgtacttttcttgagtgacctgacccaaaattagaacttcacccaccatgagcctccttccagtttatgtcactaacctaatgtagcatgacactcatccatttatttcactgccttcaaatcaactgtatgttttcccctagaagtttaaattcagtatgtctcaaacagaaaattttaccttctctcaatcacttaattatcacctttgcagkcacggatgccacaattctccacgttgcgtggttattctcgacttcttcatatccctacttctggcaygtgatttagtgattcctgtggcctctcatgtcattactgccatcaaatccatctgctgtcctcctcaccccatgttcctgccctggcctacgccttcattacttccyaccagagggcttaaaagtgctactggtcttgccttgagtccmgcctcctccagcccatccttcctacaggtgccccatccaaacacaaatctgaccgtgttactctcctgcttaagatacttcacaacttcctrtgtcctgtgggataaaatgcraacacttgccatcagcacacaaggcaggttacagtgctgcctggcccacatctcccctggcttcagtcacactgaagaactgcagttctccttgcaacttcatgcctctctgctcctgagcctgcttctcctgctggaaatgccatttcccctttctctgttttgctatctgcaggtgaacactgtccctaggaacctttcctaaatcgtattttaattttgctcctgagtagctcttgtgtataccttgtgatactcagtggtgatcaaaccacacatgtagcaatcatcttttctttgtctgttttattcttgaatttcaagtagattaaggacaaagttcccatctttagagtttcatccttattacctagagagtgaaagttcacaaaaagcatttattaactgaatgaaaattaacatttgaagtgtggaatttgcttcaaaatgtgccaacctttagttttcagattttgtaaatataataaatacaaagtracctaagctgaaccaattacakctgtgtagcccagtctatacaccrtgtatttttctttttcctttgggattcatttctgtaggtgagtaatcctctagaccctaaactcagtgrgggaccctcaccatccgtgtgcggcactgaacctgctgtcacactatgcatctaagtagaggactggttctccccrtgctgggctgggaggggaaatcctcacttagggaccaccaaccatgcagtgtcatttggcttcacttcctcttccaggccgaaccctaaactctctgtaattcactgtaataataattcactttttgttatcaaccagttgctgcttcttatgtatcaggtaaagctaagatactatcccrtaggtctttcaaatgccaacaacttgtatttccaggtgaaactacacttgaaaactacactccwcaagacaattttgtgaatgttatgtgaatgataatacttttaaatttactctgcctaaaatgtaagtgttgtggataaaattatagaaggtatcatttttcttctaaaagtaagaatgtaacttgaagtctataaatgtcactaagactctggaggtattttcatgtccttcacgattttgttccactctgaaatatttattccatccttccacttccctgccttgctttatggctatatcagtaatttttaatgtattgtcctgtagggtttctgagatcctacaggaatgaggtaggaggactactcaatattgtttctaccaggagttgtgtgacttggacaagttactttacctctggggtcagttccctactatggaaaataagttcttctacatgggggtgtgaagattcaatgagtaagtttagcacatagtaagtgcccaataaatattatcttactgtattcagcattaccattatcatagacggatgttaagtcttcagggacaagggaaacaacctatatcgtccatgggtcatttctgtctttgtttcttctcactccttttcttttctttcatttgcatttctcattttctgtgttattccttcatgttcccaataaccttcctgttacctgtttgcttcctgcattctgtgtagcatcctacrtattcacccattctccatcttctccttcatgcagcagaccatgtgtcaacatatgcrgagtttgtgcagacgcacagamcctctggggagtatatgtttgaatttgatgaggaggagcagttctacgtgaacctggatgagaaggagatggtctggcctctaccagagtttattcacacytttgactttggtgctcagaggggtattgctggcatcgtcatggcaaggaagcacttgaacacccrgatcaatggtccaaacagacttgggccacaaatggcactgcctatagctgcctgttcctctcagaggggtattgctggcatcgtcatggcaaggaagcacttgaacacccggatcaatggtccaaacagacttgggccacaaatggcactgcctatagctgcctgttcctctagagtccagctggagggatgggagggcctctctgccacacatagaactagaggccatgatgcccactcatgaatgagccccttccctgagagcgagaaatcttrggtccacacagctgggttcttaggacagcagaggaggaggcattttcttcttactcaagagaaaggctgggctgagggggccaggtcaggagcacgagaagctgtgaccctgtccaggagccctaggggagcaggaggatgggcctgggagaggtggcccctaatctggtgaatataggacttggggtggtggaacctttaagaatcagccaatggcagtaggctccttgggttctatccccttttggagcccccaccgaggtaagcgtctttcccaaggagcctgtggatctgggccagcccaacaccytcgtctgccatgttgacaagttcttcccaccagtgctgaacatcacgtggctgygcaatggggagccagtcattgagggtattgcagagaccatcttcctgcccagcaagaaactcagattmcacaggttccactatctgaccctcgttcccatggccgaggacacctgtgacctccagggggagcactggggcctgcaccagcctctcctcaggcactggggtatggagcgccctccctctgccctcacggccttggcaccacctttatttcctgggcccatcgcccctcagcacctgccttcctcaatcccatgttttayggtcactttatccaaatttcaccatctcatggtttcgaatacccaacacctcccacatccaaggccagcccctgctctctgtaccttataactctgtcttcccttggtgccccagaggtccatgaamtaatccaggtgcctgagaccatggagatgctggtctgtgccctsggcctgctggtgggcctggcgggggtccttaatggcaccattgtctcaaagaccaagcgatctgacagcatccccgggtccaggggctcctatgagtcatcctataggtgtattagggacagagtggaaaagacgaggtaacaagttaggggtgaagagtgggaaagagaaacacttcaccaggggctctttgagcattactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcactgcatccttccttagaaatcccagagtttcataaacacctgcatatgtcagagtgagacacatctgataccttctttctgtgactccagggacattcctcatctcctgacaccctcagttccctaggagcacatatcctgttcctgtaatgtgggtgcagatacctcagcttctgatcctgacaagtgttagtccagagattgttcactccactcggggtactgccctaacctgtaacatgagtacaggagacaagcaggaaagagaatgactctgactggatatggtttgtaatttgtaatgttaactgctcagtgactctgagggtaggatttatgtgctctgggtctgaggatttcataatgatctcgatttgaagactttctgctattctcatgacctccttccatcgttgaatccctggattgaaatcatattaattttatgctgcataggtttctcacaagtttcctgtgaagccaaaagggaaaataagacagataaagggtccttatttactatatactgtcttccttagcttattatgtgacagctgaaattactacgcaaaaacaagtcagcagcattttcctttatagtttttgaggaaatgaggctgatcagggataaagatgttttaaaaagaaaaaatgattgtgtcctattccctaggttaagaagattatgagaaacatgattggttgtccttgtgtgtggcttctctttcctgactccctgactcagtccagcctctctgcagactccagctgtatttacttatatctgtgccagtgacgcccaagtctgtgccttcagccccacctctcctgaaattggaggaagccggtcccccgatggaagatattatttgcaaggggagatgggcaagaggagcacagtagctttcgggaattgaccagggacaggtgcccagggacacacaaggcccagaagatgcttgtaagaagccagggagactgaaggcatcaactggatgtataagagagctgctgtgcactgattgtgtgtatcaggagtgaagaatccatcctctacacgaaaaagaaagcttacaacaaacatgtcctctaccttgaccaaaaggtgtcaatatgagacgcaaaacacataacaatgttggattgttaagaaaaaaaaaaagaccagtgtttgaaaaagagtgctacatgtattgctttgctctttccccagtggggagtcatttctgtctgtatgaaaattaagacaggaggcctaggctggtggatgaatgcagacttagacgacaaatgacgtctattggatgcattcaaaagtccaagccgtatttggttaaggagtatttgtgatggcacacaaagaaaatggttaaagtgtattagattatatttatgattttaaattctgatgttcatttaacttcttaatggtaatgataaaacatgctctcagtaaggtatatgttgaattagtgctgtgggaatatgggtcctatcaggcagatttgcagtctgctcaccattgaatagttaagaatagtggtctgagacataaatggatgagggcactaaacttgatttgggggcagctcactgaaatacagtcaattcagaagagtgtcatgtgtaacaggccccattatacaatagttaacatatccccattttcatggttctcttctttcctatgtttaaaccaaaatgaacttctttattaactcctactgtctactaaaaccctcagagaaaagtgatgagagatgatttggtgcatatttttaaaggaaaacaaacagtcatgttgggttttgattatttgtggtgctaagaagaagggaacatggttggaggcccagtgagagaaacagtgctttgaatcaaagagcagaatgatagaaactgacttcagagcaacttcttggcagcagtatccaatttggaagttgaaggtctgtcctggagccagatgctaacgaaacacagcaaatgcttttcctaaggcacaatagtcttttcagtgagctcaggaaccctgtgggggtaaaagacaagttatcccaggttgccagcctccttcctgtaagtccaggagagaaaaattatggtgagaggatgcgtctcaggctgataaataacagagttgatctctgcttccttcagcaatggagccaagcaatgctctttccccacttgcctgaaggctgacattgaaagaggggttcatgcctgagattcccttcctggaggagcctcagtgttacaatgcacagaaaggactcatatcctcctgcaacccaccccacaaggaaatcaaagcaggaatattacctgtttatgcagatcctcgttgaactgaaatgaaagacgaaaggttatataatcagccattgaaaccacctcagataattagagaaacatttccatcccaccaaattccattgcccatcactcaatggacgctccgcaggagcctgagtacttgggacctcatgcatctggctgcattaagatcccagcctgggatccctctctcgctataggtcatgtttgttccccgattatctgatatcagtggcctctagagctttctgacatttcttttctgtcaaacccctcatcgtggaataagtgtgaatatgccaggggaaggtaagtcccgctcaccctgcaggctttctcacctttcttgctcctcctgtgcatgaagatgcccactccacagatgatgagccccagcacgaagcccccagctcccgtcaatgtcttactccgggcagaatcagactgtgcctctgggaaggacagacccaggtttagtgtcacctccaccagctgcatccctactcatgtcctgtctgagattctggagcctgatgcagcatatcgggatgaggacagtgcagcggaaaaagcttgctaagaggaaattcagaaagagccaccctcatatctggaacaggggtgtgacctcaacaaggtggcaaatgctgattctggaagttgcctctcaaaatgcctgagaagaggctaaaatgctgaaggaagagaactgttcctatgtgtgaggtcagttcctaagtgtgagggtttcgagaccagtcagtgtccctagattctctgacaagggggagaactatgaatcttcaggaacccctaagccaaggnnnnnnnnnnnnnnnnnnnnattaacaaatgtaatgagaaatgacattcattgagttgcttactatgttctaggcactattctaagtgcttctcatgtgttcacttatttacatctggaggttggttcttatttatttcatgttacagagcaggaatcagacaccgggagaggtgaagaccacacagcttcaaagtgcaaagcttggatttaaacccaggctttgggcctgcagtggctgcagtcttgtccagtatttagattatttcatctgcagtcactatctgtcttcctacattttacacagccttaattttcttctgcccgcagagtgatgttcagaacttccaatgctatgttaaacatttccagcaacgaaggacatcctatcttttgcacaatctcaaaggcaatccacctcatttctttgaaatatatatgctatagatttttggttcactacctttaacatgtcatgaaattgattaaattctgtctatgtcttgagctgaattcagtttaaattaatatgaattttgcggagtccactaatgtgttaaccacattatatattttctgacactgaagaatcattgcattcctagaataaatctaaaattggtcaaaacgtattgtttttataatgtactgttggattcagtgacatggctaaaattagtccacaatcctgttctcctgtactattcttagctggctctggaaatataaatgaaccaacctcataaaatgatctcaaaaattctgttccattctatgttctagaatcacacgtgtaagaggcatgatctgctcctggaaatgtgggaggacgccctcatctgcaataagatcaggacagggccctttggaaggcgattctttgcttcccatgacaatttctttgatattctctactctattttagttttctatttcttcctgtagttttgacctttatatctttctagaaacgtatccgttttatctaaattttcaaatttatatgtatagagttggtcgtaagattttgcattttaaaatgtgtataaatgtcatttacccttttcgttctgaatctcctgtattttccttaggagtcttgccagaggtctcattaaagttttcattgcctcaaaatttgattttatcttctctatttttatatttcattgaattcagcttttgtccttattatttacatgtattttctttttgctgtttttctgcttttccatcctcttaattcacataattagctcatttgtttacagtcattttactctaacaaaattgtttaacagtctgacattctatgcagcattttgaatgaacttatttcatctttctataaagactaaacatctattatgttttcagttatttcctcttcctccactatttccctgactttctagacgtctaattattaagatgtcagatgtctgtttctatccttcatttctcttcacttgtcctttacattttctattgtttactcgatcatattgtccttgggacagtttctcagtttggctttttgtttattaattacacttcagttgcaaaagtcctatttcttgtctcatttattatgtttctta

SEQ ID NO: 1709 - DNA, 77522 bp, Homo sapiens
aatacagatgactgggcctcacacctcattccttccatctgcaggagggccctgacatgtggattttgaaaggctccttggagatgctgactatccatgctagatgggcacctggatgatgtttaagtcccttctagcttgacaaatcctcagctgtagatattaaaatgctgcttgtgctggagtgtatccctgtcatcagtccacaagagaagctctcactggggcagctgggctccctagggagcaccctggaaattaaaaaaaaaaaaacttttggttgtcataatgatgaggctggtgcttctggcattcagtgaggggaatactgcagtccctggggcagaaataaggcccatgatgacttttctctctcccccaggtgctgcaggcaggggcaacaggcaggtccctctttgttcttagtgagggatgcatcccatcacattgaagaattgtcctgagtcctgtacatcttttgaatgtactgtcagaatattcatagaggtgaaaagctagttcataggcacatgagccataatcaacttcactttacatgtacgtttaaaaaaaaaaaacaccctggtgcagtggctcatgtctgtaatcctgaagcgggtggatcacctaaggtcaggagttcgagaccagcctggccaacatggtgaaaccttgtctctactaaaaatacaaaaattagcctggtgtggtggcaggcgcctgtaatcccagctactcgggggactggggcaagagaatcgcttgaaccggggagacagaggttgcagtgagccgagattgtgccactgcactccagcctgggcgacagagtgagactctgtctcaaacaacaacaacaacaacaacaacaacaacaacaaaaaagaacacatgattttattgcacaacctacctggagtacaactaccatgttgagagctgtgtgtaaattgtcctgcattttgtctgaaacgttatcgaccttaagccacagttttgtaaaatcacatcatccatggcaatgctgctcacatagtaattgagtcactaagacactacctctatactggtctgcatctgcagctttcctatccatgatgattgtatctaattctatgaatagcctaatttagtccttatgtcaaaatgtcaaatataaagaaagcagtgacagcactattcaattaaatattgccttcctgtaatgcaaacatatccattgtaagtccatgcctctgccaacttcatgtatgattttatcgtgacattcccttttaaaattatagtgctatattgatttcaagatagtaaaagagagttacaaaacaatatttgttataaacaggggtgttggatctggttggtttaggacttactgatctacaagcaataaaacctgcaggaaaacagtagatctgtagctctcagacaagccttgcaaaggtctagcatgccctagagagggcaaggggcacgttggaaggactaatcaacttgttaggatcaggtcctgatggggatcgaaaccagcttccagcaacaatgtgagagggctaggctgggcttagtcaatcacacggctcagattggaatcttatttgagtacaccctggatgtatgcggagggtgttagaccaataattcttggccgggcgcggtggctcacacctgtaatcccagcactttgggaggctaaggtgggagaatcactggagcccaggagcagcctaggcaacatagtgaggcattgtctttataaattaataataataataatagtaataattattgagtgcttatggtggatcaggcctcatatgtgatgggcacacacatacatctcttacaattgccacagcagtcttagggtagttgttaattcttgctttacaaaggaggaagcccaggcttggacagttacaacaacttgctggaggccacacaatgattcctgggtagaaagctgtctccctgccttcaaagctattttgaggccacacaatgattcctgggtagagacctgtctccctgccttcaaagctattttgtcaaaggaagtttatatttattcagtgtttgagaaacagctgctctcagtttttaatgttttgctaggagtgactgtgcagcctggatagcaacaatggtgggtgtattagtccgtttcacactgctattaagaacttccctgagactggggcatttataaaggaaagaggtttaactgactcacagttccacacggcttggggagggctcagaagacttacaatcatggcggatggtgaaggggaagtaagccccttcttcacaaggcagcagcagagagaagaacgaaggaagaacttccagacactcataaaaccatcaaatctcatgagaatcactcagtgccatgagaacagcatgggggaaaccacccccatgatccaatcaccctccctccctcgacacatgggaattatgatttgagatgagatttgggtggggacacagagtcaaaccctatcagtgggcttctttacgaaagatgaggtttccttgggaaataactcttggctctctgagggcttggccactctgactttgatcaaactggcaactggggtatgtacctgagtgaggtcagggggcccatgataactcggtgacttgctgccccttgctcactccagttggcaatgtcggggcatttggtccctgctgtgggggctcccatgtctgtctggcccttggcctctcctcccctggtggccagctctgctgtgatcagctgagcctgctgctggagctatgtgctggtttcctgcctcttcttgggcattctgggctctaggaactgtttgttggtttcctgtgggccattcctttccaggatgggcctagaggctgcaaccctcctaagatctgcccacacccctgtcctgaggtgagcttctcaagaaggtccccggctgagcaaggggtgtcaggagcaagaatggaggcaggagagtgtgtgcgcctgctttttagagtgggagtgtgcactcatgcatgagtgggaggctgtcattaacttggccatggatggctgccattttaagcagaaccagatttgctggcatgaattgtttaaatgatggcaggcacaagcactgcagggagatcctcctagcctaaattaaagaagccacagagggaaaaaatcccagaccatcttgctccacacctccctcccccgtcccaagccttccgtcatctgcgggaatttcagtgcctcactgacacctgaatgacaatcttttgtcatcctggaaggcaccatgatggtaccaaaggacaactggggagcattggttccctccccagccccaaacaaacacgttcttcatcagcctccttaagccatcccaaacaacccacacgcttaatacaactatcgtgccttctatccgggcaaagtgccatgtgtctgtagacacagctactcaggaggctgagacaggaggatcgctcgagcccaggagtttgaggctgtagtgagctatgataatggctgtaaatagccactacactccagcctgggcaacattattgagaccatgtttctaaataagcaaacaaaaattgtgctttctctgcaaacagagtgtctagggaagtgctttttactttcttgtgcattaagatcatctggggaccttgttaagctgtagattctgattcaggaggtctggagtggggccccaagaacctgtatttataacaagctctcaggtaaagccaatgctgctctcagggaaaccacactttcagaatggaagttccagatagccctcctctgcctctgaccagccagctatgtgcctgctaacgtcattctgctgtcagagggagtgtggggtaggagagcagggtggtctgaagtctttctctctctctttctctctctctctctctctcacacacacacacacacacacacacacacacacacacacacacacagggcttcatcggctcagagagttgcaaacccagacccatgttctaggctgggctctgccaggaactgctaggagtcgcatctctctctggacctcagtttcttcacgtgtatttgtgtattctctggggtggagctggcgaatagctggagacccctctagctctaccattttttgattctaattaaccaaaaaggatattcgaggtccccgctacaaattctgaacccttggcttcccctccaaactcccacacaaactccaccccatcctgcctgtgtgtctttgggaggatcatttccttctttggtcttggtgtccttgtttacaggttgagggatgataagagtcacctgatctgggcaagtcaggccataaataaggcttgtatgtaaaggtgcctagcatagttcttggcaaagcaaggatcagtcgatatgattgcattggtttgtgcatctgggaagaatgagcagactgcatactgtgtgttagggtgtagggaggaatcagacgtgaccctgccctctagtcatctgggtgcacagattctagattaaaggatgtgggggtggtaactaacaaggagatggagaggaggtgtgcagttcctgggggatctgatgaagaattaaagcagaagggtaggagatggagaatgggaaggcatacctgaaaccctaaagcaactcttgatgagtaggcattggcaggaggccccagaacattttctgaccctcaaacactgagaatgcatgtctgctggggaatagtagtgagggggctaagggtatgggggtgttcatgcctgagtcaggggctctggatggtagaaatgtctgggagttctgacggaatgggggtgaggaggcctaaagataacctgttcatagtctttcagggccttaaccattatggctggggaagtgggaagtgccgatggggtatgcagaggagggcagctgtgatagtacatttcatcctgaaagcactacatgtggataatgacggtagtgatgatgccctaattttagtgtcatggcaacattttccaaggggatggaattgggtaccctcattagtgtcatttttgtttgagagatttcaagagtctatctaggtgtcattttaaaatctattgaaaaaaaatcttgaatgcaggtcactgaccagttggttccatgtaactgcactgccttctgctaccactaaagcaatgttatgacaacctggacaagtcatgggaaacctatgtgagacttagttttttctttttctttttggagttgggggtctcactatgttgctcaggctgatctagagctcctgggctcagacaaccctcccgcctcagcatccccaagtgccgggattaccgatgtaagccactgcacccagctgagacttagttttttcatctggaaatgaaggcgacctttgtgatcccagtgggcccttgcacttgtgtataaggtgattcccagcactgctcatgaaagtagtgatggcagagtagcctctgctctccattttatttttggggtgggggggggcagtggtggaggggaggatgaggatgatatttccattaaataagtttccttgttgcttttcttcaggcaccactgacctcgatggaaaaatgaagtccctggcccaggaaagagacccaactctgtggctgttttggattagtttgtacaatgccctgcagacctactctctcaggaggctccaagtgaccaaatgtgacaagaaagttttttgtccaaggcagtttggaagagaagttggtgaccgtcgggataccacagccgccccaggacggcctggttgagacattcactggagggtctgggtgcagcccgctgcctggccggtaggcggcgcgcacaggccgtggggcccgggtctgggcgtgcgcgcggctggtagcagcggggccgcgcacgccagggtccgggagccgggccggtgcccccggagccatttccgggaggggcgaggccggcggctgccgggcctccaatctcggcggcggcggcggcaacaggggagcctgggtctcgcggcctgcgagtccgtcgcgtgctgagggagacgcaggaggtggagccggccgggtgctcgagggaaggagactggaagctggttccggcgtgaggaggtggaggggccgccgcgggctccggggggcggtgagggtcgggacggaggcgccgcggggtgaggagaggacaggggccgggtgggccgagggcgggcagaggcggcggggcggctgcggccggggcgggggcgggggcgggctgaaggcgtgggcaccagccgctgaggtccaagcaagtggacggcgggcgggcgcggggccgcggtggggcgggtctggagcccacgcctgccgcggggtaggcatgggcggccaggatttgctggtcctccgacgggaggggtgacaacgagagcgaggccgtgctgattctgaagggagtgcggaggaggcaggaccctggtagcctcggcaccttcagcccgggttaggtggcctgggctgggctccccaccccsatcgcgcgcagacggggcgtttcccctagtttccacctgggtggaatgctttgtgggagtctgggtctggattagtttcatcagctgtgggagggaaacctagttgcagcaggattttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttggtgagccttttgcagacatcctcctggttccaaggcatttgtctccgttttttyagtccaaaggatcccagtgtgtagatttcacctctgatgcttgcttttggtwgctgagcgttttgccaccttttattttgttttgttttgttttgtttttttggagacggagtctcactctgttgcccagactggggtgcagtggcatgatctcggctcaccgccacctctgcctcctgggttcaagcgattctcctgcctcagcctcctgagtagctgggattacaggcgcacgccaccacgcccggctaatttttgtatttttagtagagacggggttctccatgttggccaggctggccttgaactcctgacctgtggtgatccacccgccttggcctcccgaagtgctgggattccaggcgtgagccaccgcgcctggccaaccaccttttattttggatgaatgatcaggatgaataaatagctgaattaaatacatcaatacagtatatgtagaacttaaattattgaagaatctttttcaaaattattattattttttttaaatgagacaaggtcttgctatgttcctcagaccggagtgcagtggctatttacaggcataatcatagctcactgtagcctggaactcccacttcaagtgatcctcttgcttcagcctctggagtagctaggactaggagcacaggtcacctctcctggctttctttttcataattcttgcagttttaatccctcccttcccgtactaccagagcagttttgaaacctctattattacgttttatcagggtctgccatatactagtttatctgagtgtttgtcttccagattagagttatggttcctcgacaggcagataatcatgtcttctttgtttagagatgaataaacacctagcatggtgctctgaatatagtatgtgcttaacaaatgcttgttggattgaaccagtatgaatttaagttcttttgttggacagagaggtatgcctgctttagagctgtttcctctcctcctgagatctttctgtgctgttttactgagcagggaagaatagcgttgctaaatgcatgtttaccaaaatgacattttatttttgggacttttatgattccttatggacttcttagtgtgagaattatggagagtttatagctttgaaatggtggtatagaaaaagtgtccgggtttagttttttttgtttcgttttgttttgttttgtttgtttgtttttgagatggagtttagctcttgtctcccaggctggagtgcaatggcacaatctcagctcattgcaacctttgcctcccgggttcaagcgattctcctgcctcagcctcccgggtagctgggattataggtgcacaccaccatgcctgggtaatttttgttttttaatagagatggggtttcgccgtgttagccaggctggtctcaaactcctaacctcagrtgatccacctgccttggtctcccaaagtgctgggattacttacaggcgtgagccgccgtgtccagccaagtttgtttgtttgtttgtttttgtcacttctctgagtgcaaaatcagtgctttaaaaacaattcatttctctctctttatctcactatcccagagggtgggttggcgtcactgggaaactggcaaaaactggtagtgagatttccttatactgggtgctgacatcgtagtggcataacctgtaaggtctgcaggggggctaaagaagagagaaactaagttttgatccattgtgatttgaggcagggatctaggataattttaggttgtatgtgagagacatagatgaatacttaggttatccgcagatcccaatgaaaagttcatctaaaatagtatcttgccccaaatttcatggatttttcagttttaattaatacccttatataacttaaaattcttattcaaagaccattatgttagaaatactggaaactataagtaagcaaaaggaaaggggatttgttaatctcccctatctcctacatccccttcattcgcctctaccccgtgcagtaatttatcacccagaaataaccgctgtgagcatcttggatggttaatgcagagtgacttgtagcaattgacagtttctgtttatcctcttacagaaggatatgtttatgtaaattataggttcttatatgtaagatatttccccatgcacagagatatggttattacttatagggcctatgcatttactttaacagaacaatgactgcttttactcggaatattaactttggaatcagttttcttttgaggtatttctctagctgttgccaccacctttcacctcctcacctgttaatttagaatgtttaggagtgttgctttgcttgttgctgtaaggaattaatccacatagatgcgagtggccctaggcagtcatcactttctgaagacaacatacatgttgcatgaagtgctttcactggaaaagttgtcattcattccttgactgtaatgtataatrctatttggaactaactggtaaagaaccaataaccatggctgggttttcagtggcacactaacccatcattctatgaggtgtttctcaagctactttatatgatatgtaaaacatgttcttggccctccacctgggaagaaaggacctaagtgaataaaaaaataacctcagtgcagtgcagcatctcagaattagaaatagtcttagaagtcatgggatgcagctttttttttttttttttttttgagacaaggtctcactctgatgcccaggctggagtgcagtggcatgatctcagcttactgcatcctcaatctctgaggctcagatgatccttccacctcagcctcctgagtagctgggacgacaggcacatgccaccatgcccggctgatttttgtatttaytttttgtagagatggtagtttgccatgttacccaggctggtatctaactcctgggctcaagggatccaaccgcctgccttggcctccyaaagtgctggattacaggcatgagccactgtacctggcctgtgatgcagcttatattatacatgaatctgttgaagagtatctctggtaaatggatatccagtctcccgtcttttctgctaatggaataagtgagcaaaagctaggaaacaatacaaggtggattcaggaatagtaatgttaactctgatagctaacatttattgagcatgtattacatgttaagtgtaggaatactgtacttatttaattttcacaaaaaccttttggtatccttcttttacagatgaaaaacgaggcttatagagagtaactacagcagttgagtggtggagccaagtttgacctcagttggtctgacttcagatccctccctcttgcctactttgtgtccttacccctggtaagggtagaggttgctgaccattgtgactgatgggagagggtctgtgtggagcagatgggataggatagctccaccctctagggggcactttggcaatgggggactgggggaggagggagtcttttttcttctagtgtagtctgaaaatacatgttttattattaaattattattaaatcttgtttattgggtcaggcgtggtggctcatgcctgtaattccagcactttgggaggctcaggcgggcagagtacttgaggccaggtgttctagaccagcctggtcaacatggcgaaactctgtctctactaaaaatacaaaaattagctgggcatggtggcgtacacttgtattcccggctatttaggaggctgaggcaagagagttgcttgaacccgggaggtggaggttgcagtgagctgaagctgcaccattacactccagcctgggcgacagagcgagactgtctcaaaaaaaaaaaaatttgtgttttattttcttttacgtcgcatttaatgaattatattgaaattttaaaacttgtrtctgcaggcatagtgttataatctttaaatgccatgtcagagtagcaaaagggattacagaatatttgttataaaaagagggcattgggtcatagagttgaagactacttgtgtggacagtatgctgtgagagaaaacctggagatgacctggagtccacatataacaagccttgaatccagactgacaggctcgggctatcagccctcagtgtgttcctgccctcaattttgttatcatttgattaggatagtttgcttgcctttttccatttgctcgtatgtgatgtgtcatagactgcagtactttccacctgtgtctcatagagaataaaatgagtatgttcatctgctgagagttgtgatgatgtcagagggaattcaagtcagacagctttgtagcagcctttctcccccttggcaaccattctttttattcatactctcctccttggtgctagagggtggtatcactttgcaagttgccaaatatttgtagtttttaagaaaaaggtattttataaagccagtctaccccttaggtggcttttttcttttctcatcagaaaatgatgactaaattagctgatattcatagatgaatcaaggttagcgtgtgcaccctggtagtgctaggtggggtttgagtgataattgcttatctagggcagtggttcttgaccaggggcaattttgccctctgggtgacatttgacaatgcctagagacattttgggttgttacacctgaagggttctgctggcatctagtgggtagaggctagggatgcaaccaaacaccttacaacgcacagtttcctgcaaacaagaattatctggcctagaatgtcaatagtggtgaggttgagaaactggtatgaagtttcttaccatagatacctggatatctgtgtagtctatgctttcatatgggtgggggagtgattcccttcttggaggttaacgtgtctgttattgtctcacttggggttattttgcccatgggtcaagccttgctgctcaggaatatatattggagatggtgcagctgatcttttatagcaatgcagaattcttaagaaatgctgtcctttgcaacatttctgcaccactcttttcttgatttgcaaacagcaagcttccctcagttttgttttttgggttcaaaaattgaatctttccaggtccttgagcgtctttatctgtgacccttgactctttttcagggatgctttctttctgaatctcaagtgggatttaagcaataaactgaaagattgaccttaggagctctgttctattatttgagccttgtgtcttgtttgtaggatttgctagaagaaagggaaaattcattgggattgttgataggacattaaaaaatttgttgacatttgagtggccattgcaggatgaacactgtatttggcaatctcccagtgttatagatgaaacagagctgtaataatttccacagcctttggtttaaaggaaaagagggttataaacagatagaatccaaatcccagtatttgacttagcttttcagtctatgtgtcaggaatttttagtaatatttaccttcttaattaggttttacccaatctaatattatatacagtttgtgcacattggtggcagaattgagaatcagcctgggtttaagaatttccatagggaattgatgtgaatcagtctgtatgtgtaaatgtacagaacccaattactgagataaaaaccatgctgtgggggaaggggagataggggccctctgagaagatggaatggtgaaggctgcgagtagtttgtggatatatcagtcatatcttggcataatccaacagcgtactaagggatcaagggactattttcaaggctgagcaggtttaaggaaaacatctaggtgaaacatctaagggctagctagcaataggagagccattatcactcttttttttttttttttgtcatggcaatttcactgaagcttttattgcctctattggtaatatgacagggactgtaagaaacacaattgaacttacagagatatgcagatgatattcactaaagataatcttcatctcaagtattttttatatgtgggcacttctaattttatacatttttctatttaaaaagcattacattttaaaatktgtacctgttttgacatttggcaaaaaggaaactgtacctatggttcagtttaaaacaaagaatcagcatggggagtttaccggaatgaggactgaaacacttaggagttaaagcaattcaaggggcgtgtgtgtgtctctccctttctcygtcaatctctctcactctctctggctctctcacagacacagactcaaacacacacagccatatgtgtaatcattttttagtacaaaatattccctgtagccagacatttatcttcagaataatcacaccacattaaatcagtcttctcttttcagccctagtaaaagttttgtttaattctaagatgccatcatagdgaacaaccttaacttttatsctacataattatattcaaagctttatgtatttttgtttataattacacagtaattataaatgtttagtaccaacctgatgacaaacactattttgttgaaaaggttttgcatttaaaaagaaaaatatgtaaaatccaaggcactaggccacgaaccaatatcagacttttaaagaaaacactttatattgaaaaaaaaaaaaaaaaaaagctaatgggatctcatttcaaaacacagcatatgtgaattaatcaatctgaaaccaataaccataactcaaaatcttcaagacaggaaacaaaacagtacatatatatagatatatagatatatatatcttttaaaaatttttcataattgaagttcctctttatatttacaaaaaaatcaggaaatactgaaagcagcaagattcttctttttcctttttcttttaataaccaattccagtagcctgaatagaaattttcagatttttcttttggtaaaactgcattcttgaattaaagttatgattggaatattgatatgtctatagggaaagctttctagtctatttcaaaatcatgtaaataaaaagcagttttgatatgtcattgtttcttaaaataatttccatatttgcataaaatgtactgctattctaagtacattcctttgttaatatcaaccctagaccttagagagtgcctggatatatatcccaagcagaatctgttcctatcaaaagaccataatcatcgaacatttgaagcattacatttctagcctgccttacggaaatgtttaagaaagcaagaaacccttcttcacatgtcagtaagtgaacagggaaatgaccattttcagcataaaagcagctcatgggtcttgtaatgaaaaaaatacatacaagatagcattctgctttgatgagaaaactgagctaatctgagtgaaacaaaaacagtaaagagactagaagccagattggtattttgcatcatgtatgcttgtttgaaaatctttgctcctgaagtaaatatttggcaaccaagtgattagcgaccacaatttcaacaaaataataagtcattgaaaatggactatttgtctgaaagagcaatacctatattacaaagattgaacttcatggctcattacaaccattttcaaaatttaactgcaactatcttcttataaattaagagagtttaatttgtgttccatagtgcgatgacaawaaaaaagtaaaaacaaaacaaaaaaaccctcatgcctaaatttagaatattgtattatgtagcaatccaaaacattcaaaacaaattaaatagtttaacttatgtgacaggcagataagcatttcaaaagcataatgaagtccaattatgtagtgcwtaatgtagacaggagaagaatctaacattatgcagacattttctaaataaaagctccctgtaggacagctatatataaacatgggtaaggtaagcgcagactagttctgtggaaccttttgaaatcaagagtctaaaacacaatacatttttcaggtaggcaccaagttatcctaaaaaattttcatgttggttattctgacgttgttttttctcttttttttttttttttgagacaagtcttgctctgtcgcccaggctagagtgcagtggctcgatctcggctcactgcaacctccgcctcctgggttcaagtgattctcctgcctcagcctcccaagtagctgggattacactcttaagcctgtgagagggcaaggaagggagtagtttctggaactttgagagagttgagatgaaggagaaggtaacctgtaggaatgccagccagtgacccagtaggaaaggcatcaaggggaataaatacttcaaactcttttgctaccctctgatctcctgctgtagcctcccattggtctaatacaactggaaaccagaggttaaggagtctggttgatttaattcagagggtggaatccggaggcacatagccgagctggaaaatgctggatggaggatctggaggaggagatcatctggaggggagaacatccagcatgctggagttgagaggtctagtttgtcttaaaaggcacaaatgaggagataattcttgaacagaatcttgaaggtggatagcatatggattatagaaagggaatgttcccactgattttaacaggatagattcagaggcacacagttgccacagctttggcaagcccaaagctgctttgttccagtagtagccttagaatcttaattgcctggagggcctttaaaagtactgcagtccagctttcttgctgcctaggaatccctctacaatgccctgtcaggagtgagtgctacatactttctcagggggttctttccactgttggacagctttaatttttagaaaatttttcatgtgtccagatcactgaatgcatcagctagaattaggtttgagtgtatataacagaaaaacctaaagtaatagagattttttaaaagacataaatatatttctttaagagaaaactggcctggcgcggtggctcacgcctgtaatcccaacactttgggaggccgaaatgggcggatcacttgaagccagaagtcaagatcagcctgggcaatgtggtgaaaccccgtctttactaaaaatacaaaaattagccgggtgtggtggtgggtgcctgtaatcaatcccagctactcaggaggctgaggcatgagaatcgcttgaacgcgggaggtggaggttgcagtgagccaaggtcacactaccgcactccagcctggacgacagagtgagactctctcaaaaaaattacaacacagtacaatacaatacaacacaacacaacaatacaatacaatacagtactacagtacaatacaatacaatgcaatgccagtacaattccattccattccattcattcccattccattccatgccgataaggccattcctgagtctttgaggtgccaggctgcttctgtctgtcattccgctatcagtagtgcatcccctcctgggccagggtagctgcctggggttctacctgtcaggttcatgtttcattcatgaagaggaagaggaaacggaaaaagaagggcttgccctccattttaattaaaaattattttggaatttattatacgtgcagaagagtatagaaagcacatatctacattttaatgaacaataataaaacaacgataccagattaggatataaaccatttatctctaactctacgcttcaccctgttacaaatatttcctttcttcccctctakggataaccccatcctgacttttataattattcccttgcctttttaaaaatagttttaaccacctgtgtatgcatcctaagtttagtttgtttttttttaaacttgatgtaaatggatgcatatgtatttttatttttgtgattttcctgtgttgctcagtattcatgcgatccatgttattgcatgtagtttaagttcattcatttttattgctgtatatatagtattttattgtgtgactaaactgcagttatttatccatttgacttataattcacatttgggttgtttccaatttgaggctttttcaaacattgctgttatgagcgttcttatataacaagtgatcacaagtgcaagagtttttctgggatttgtgcctaggagtggaattgctgattgtaaaggcatacatgcctaacttcactagatattgctaaacttttctgaagaggccaatacaatttataccactatcaacaatatatgagagttatttccacccaacttggcaaacctgatatttataaagcttattttttgacaatctggtaagcagataaatgtaattgtaatttccgtatgcatttcctgataactgatgtggttaagtacccttttcaatgtttaccaaccacttggattttctgttttgtggctgcctcttcaagtcatatgccttatcagttatttctcctttttagttctattattaatagattttgctgtatatttgctgagattttgttactaggtgcattcagatttaaaattgttacatcttgtaagttgagcttttcatataatttgctttttgacataatatagctacatcagctttttgtcatgaaataggaaacttcaaatgtatgataaatgaatgagttgcctgttagtataggcagaaactgcagaacaatcctagcccattattcaggctttatgtatcagcgatttgttctgttatcccataaagtgaatgagtcatttttgagtttaaaaaaatcatagggctttttttttgaggtccaatttgcatacagtaaagggcacaaatcttaattatccaggtcagtaaatatttatgtatgaatatacttccagatcaagatattaaacatttccagcactccagccagcttcttaatgtccctcccagttgatacctaccaaaggttttgcttagttttgctgattttgaactttacataaagtggaaacatacagtatattctcttttgtgagtggcctttttgctcaacattgtgtttgtgagattcagtcatgttcttaggtagcattagtttttctttcttattgctgtgtagtgttacaatgtataactatattataactaatttgttctgtagttgtagaacatttatgtttctagttttttggctattgtgaatgacactgctgccttcttgaacatgtcttggtaaacataaaatgtagagttgctgtgtggtaacgtgtactgccaaacagatttccaaagtggttgtactaatttacgctaccagagttttaatatataacttcttgatttagctttgggcagcaaatgttaaatttctgtcatctgcataccacacatggagaagagcactgagaactctttcctgaagttgtataggcacttttattttattttttatttttatttttttcggagacagggtttcaccctgttgcccaggcaggagtgcggtggtgcgatcatggcttcctgcagccttgaactctgggtctctaaccatcctcattgagaagcctcggcttcctaaagtgctgcgattatgggtgtgagccactgtacccagcctgtacaagcaattctaaaatgtgaaatgcccttccttttctgtaatttccccagagagtaaagcctactgcattcttgtttatctagtctgtaaatgttaatacacaattgatgggaacaaagcaaccttagttctttttgagtatgaaaaggaccctgttaagggcagaatttaaaatatttgtagtagttaattctcaggttaaaatcataatcttctagaatgctttagattctaagtggctattgtagtaacactttatactcaatattgggggaccatgttttttggaggctttcactgaagcatttaattccattcttttgaattcgttttgacagatgggtctaaaaaggaatagatcaattctgtattgaattccagtcttaatggcaccgagtctttgagacaattgaggcaaattggaaattctgttttcacattcttctgaaaggggatgcctttcagaagtgtcctgaagggcgctggggagggcaaatatgaggatgccagggtaagtctgctccctgtctggctgtgttgggccagagtggaagaaagcctaagactctgttacccagccctttctgaaaatgttttcaaatgctttcccaacaatcacgaccacaagagtcaacagtctgtttggatgactgaaaacacacaggtttacgatctgtaaagatagtaggtaagtgatttaatcttgttgtataggtaggccagagggcactygcagccttctgattgatttaatagattgttgaagattaagagttgacttaacatctctcttagaaaactgagaaatagctcattactaaggtgtgttttattaccaccgtctgtaagaaaatacaacataggcatgggaatcaaactacttaaagcctcttccagctcctttgtgactgggaaggttacttttccttgttgcttattgaagagaaaaggaaaatgtttatcattggataattcaggttcactgaatatttaatgagtgtttattatctgcagtcattttcttattaccttatctcatttaatattcacaacaaccctgtgagtggacgatggtatcttttttttttctcctgaacgttttgttgaattatcccaatggcttctatttttgcagatgagcagagtccagttgcatagaggtttagtgttgtgccacacatcacacagcttctaagtgagagctaaaattagagccraaggttttgattaccagtccagactttctaggacaccacagctgcctttctgtagaacagattaacatgactctcagagtccgcaagagtagtggtgaggtgtcagttcaggggaatactcaaaggtcactgtccttttcagrtatctgggtagttgctacagtatgtgcttaggaattgctggataaaaaaatattctttaaaatctcatcattttagtcgttaataatttattattataactcgtaaaaatatacctttaggcaagttattcttaggtagttatggttgctttcatttggagtccagagctttactctctatttctggagttgcaatttctgctgtccttggcccatttaaaaactttttcagaaggccttttaaattttatttttttattaaaagaaagcctgtgaatccaaagaatcttaggtggtttcttagctgaagggacatttggtgaacacaaatggaactgttaggtcatgatgcttttttaagtgtacaactctggtgttttgtatattcacagttgtgcagccatccccacgatcaattttaggacattttccaaagaaacccagtactcagcagtcacttccttatttccttctcacyggtcctcagcaactaccagtctactttgtgtagatttgcttagtcaggacacttcatataaatacaatcatacagtaaatatgtggtctttcctgattgacttcctgattaaccattcgtttaatggtttcaaggttcatccatgttgtagcatggatcagaactgcactcctttttattgcagttacagggcttttcctacagaattttaagtaatggatatatctaacaatgtctcttgttctcacctacaggagacacaggatcttgggcttactttacttatataggaccttttgtaatatcgaggctatttctatgctttattgtagaacagaagttattaactggggaatatggacctttatgactggcctttaggatgtcctgaattctttgtaattatataagattttatgttcacaagcattttctgggcgtcggaggagtctggaacagcaaagatctctagcttttgttaaaagataattttcgaaagtaatatcctgactcttatacagatataaaatgaacatatgttgaagattttattttactccaaaagaggaaaccaggcagatgttataactggttcaaaggagaggtccaaaaagctgctcatttatggatcaggaatatcaaatgaatgtgcaaatggaggcaaaacaactctctgtcataggggtaggaaagtcaggtgaaacttcacctgacggcagaatttgcatatttagggatctagattactttgcactgctatcagttatctacaactttcagagccgtaaacagcctcctcataatcagaatctggtaacccggaggggcgtcccagataatgcataatttttcaytggaagccgtagggaaaaactctctcctctactctcacaccacaacaatcaacaccgaagacttccgtgaccaaacgtgtgggatttttttccccacactccaagaagcagacatcactgggtgtcgcctaattcaattctgacactgtctacctggagatagcatcagatctatgggttgagggctcagtcccaacccatacctgtctcccccaaccccaacctgtcacaagtctggtccttcaaaatgtctgactgactgtcttcaaggtgaggttcccatgacctcctcttggattggattaatttgctggaacagctcacagaactcagggaaacatttacttaggtttacaggtttattttaagggatactgcaaaggttacaaatgaagagatgcatggggcaaggtataggggaaggggtgtggagcytccatgcctccctgggtgcaccaccctccaggaacctccatgtgttcagctatccagaggctctctgaaccctgtccttttgggtttttatggaggcttagttacataggcatgattgacaaccatgtagaaatgtgactggacacaggaggcatgatctcatactaatagactgaccggaaacccagcaaggcctgtctgttcaggttgtcgctggcctttctgtgcagccttccttcctccagaatatggggcacaaccctcccaggaatgagggttttttggcccacagttggactagagtcttgctttgaggcaggtaaaagaggacaggagaaggttgagagagattctgtttcctgaggcccaaagtgccccagcattataatagaagactataacaagggctatgggggttatgaaccaggaaccatggatgcaaaccaatatatacgtataacatcacagaagcacactttcctgctcactttcaatagataccacaaagtttgaaactcttccaagtattaattttaaattaaatttactcagctgcttacttcagcttttaaaagtaggttcttggtaatttcgaagatgcactttccaaagggtgtttatatagttgaaggtcagtcagagacctagggataggtccctgcttattcttttgagcaggcttacgtgttrgaaatctctagagaaatagctttagttaggttacacttctcagcaaatattcagtattcctcatctctaatagcagcatgactgttgtagggaaggaatttccacaaatggttatgaaaagtctaagtgtcttaactcccagacaaagatagagaattctgttagtaagataagtatgggactggagaagtcagctaacctctgcccttccccaatcgtgatatgctcagagaagttaagacttctttctgtgtgagaaatacgggatcttttccactagatcttgcttattatccaagaaattatcatttctagttttagagaatgatgaaactcatttgtgctttgaaatataacctgtatacatgtgcacagtaagtcatttrgctatttattgtcagactctgrgagttcatagcaaacttagcaacattccatgtgcaaatttgcatatttttccccccatatcttacctacttgccttaggctgggagtctattttcctacaaaactggtaattgctcttatctctgtgtccttcagtgtgttcctctgcttattgaattcagttttatgcatttagtcttctctcctagtataagctgctcctgatacttttaaatatgtatttcagaagagaggtgctcagaattgttacttaacagaatcagcatctccctttacttgatgccttgtcctgaccacaagtacattaataaagtgaccatttagcagtgtttygggttcagcttttaggaacttagaagctgtggttttccatgagtgcacttctgatgacttgggaacatttcatatgtgtgttctttctgtggccaagatggttttgttatttcagggatggaaagatgctttgcctgaatactcccatgctaagtgtatagcagttggtgcttggggaatggtaccaagtgtacatatctggcaaggccaggctagaagggaaaatgtagactcttaagctttttgagacgaacttctcagatactggatctcttgactcacatagtggaattttgggggaagtatgtggtttgctttttgtctcctaagaaatgatgattcagtttcctcaaacgtttctcacagtcactactggttgcttggaatggctgtctggttttgttgctcagttcttacttctttaatgacccaagaggattttccctttggggttgtgatgtgtttttgatgataaactttaatgcttttggaggctataaagacaatagtattttcttacctgtttaccttgcactttgaagttctgtagactgtaatatgaaagaaaatcagattaaattagctttgctttctggcttttctttttttggtgggggggcagaagctgataagaataaatatactaactgagtctcttctgtattttaacttcactccctaggctgaggcttagtccttagagtaacatttgaactgggtagaacagatttttcttttcctcaacagcccattcctgctgtaaagctcagatttatggtccttctggaaaaagtattgagygttgaatagttcaggaaaacaaataacaaattctgtcttctttgcaggattgtggggtagaagattttgatttttattagtatctggccaaagaataaatattaggcaggaacaatgaattgatatctagtagagtgacgtgactgggccctgacttttaacacttcccaggaaagcttcgtggatgtcttttccctgctgcgtgaataccgggtagccattaagtttggtgattgggtgtcagtaatatgttaagtcagctactgggtcatcttttaatamaagaaaaggatggggaagagaatggattcttaagcagtgttgcctgtcagaatcaccggagggaggtttacaaaatacacattctgtactctgaccctgtgggtggggtattctgacccaagaagatgattcgttccaggaatcatgcttcttggatgatattgatgtacccccactggctttatggaaagaatattgaagaagaagatagattctcttgggggctgtgcctctagtttgaaaccagggaaggcacattttggtattaktctgtggcctcagtttcttcatcactgcartgagattggactataggtggtctctaaggttccttcagacagtagcattttatgattttgaagacaacttttctgaagtacttttcaaactaatttctttccgtctttcttttgtaagcaaataagtagtatgagtgtaagtctctagctcagagaagaatgaagtttgcagttcgaaaaggccatgcaatagcagttcacttccccaaaatgctcagcccttgtaggatgccgttaggtcatctggaagttctgtatgccttcaytgggagcgtagtgaagatgagagcctttcctttggctcttggagtaaactagctgacaggactttgagaactgttggtctcctgatttgtgccactgatagtttggctctggaaaactaggcagtggaaaaaacaatgcattttaaaccagaagatttgagtcctggctcygctatttccgagctttgtgacctgtaggcctcaatrtcttcatctgtgaaggacaggttcagctctgatggcctatgatgtgatgaaccttgtgaacttgtaggcagagtgccackgtgtgcagagtccagttacagataaccagccattctcctctgcagattcaacccactgccactgtgtcttgttaagcttaaataggagagatgtgggagagaggaggcagaaacatcctaggatcttgcaaaacaaaactgtcaaaagtataggcaatatcataattactttatttgaataaacgttgagttcctgctgtgttgaagatgctgttttaggcagtgtaggagatagaagacttatatcctcctcctaatttgtattcttatcagcacctggtaccatagagagttcatatattaaaattatttggttgttctccctaaccagagttgaattctttccttctaggacaaattaactcataatgcaataggctaatgcagtttggccctgagtgactcttgagaaataccctgagttgaggcacactggaaacgtggcacattagaaatgccaagaagaggccgggtgcggtggctcatgcctgtaatcccagctctttgggaggccgaggcgggtggatcacgaggcaggagatcgagaccatcctggctaacacggtgaaaccctgtctctactaaaaatacaaaaaattagctgggagtggtggcgggtgcctgtagtcccagctacttgggaggctgaggcaggagaatggcttgaacccgggaggtggagtttgcagtgaaccaagattgcaccactgcactccagcctgggtgacagagcaagactccgtctcaaaaaaaaaaaaaaaaaagaaatgccaagaagacattgtacaggagaatgaagggaaactttctgtagggaagtagctttcccagaaacttgactctataatgaagctatagagatcagtaaaatcattagggcattactgttttgaacatttccttgagtgaataacagacttacactcagggccctaggtctctgttgtggcccagcaagctgcattcagacaaggaggcagtttgagaggtacgagttgttatggaagcctgagaaaactggtttgtgtgcacttcagttttgaccatacaaccttcactcacttagcactgtgcagtaatccactgagcaaaattgccacattttccttggcagggaatctgtgtgcctgtggcagttcaraaattatttgtagagtgggtcagcctgtcagcaggaatgtttttctttgatcttcagcctgtttttctttaatgtgagcagaacagtaaagagagaatacattggaatatcttgttggttcccctgtttggctttacctacagctctttggttttcttcttttaggtcatactttcccaattagtatgtaggtatttatgatgttttgaagcccagagcgatggttccaatatcttgtggaattcagctctgagtgtgaagtcctgactttgcctctttctatcagtttgactgagcaagtcacttaacctttcttgacttcagttttccccatctatagagtgatactgyacactggtttcttttcttttctttttccccttcctttccttttcctttttcttttccttccctctccctctcctccctttgcctttgcctttccctttccctttcctgagatagagtctcactctgccgcccaagttgtattggagtgcagtagcatgctcatagctcaatgcagcatcaaatgcctgggctcaagtgatcctcctaccttagcctgccaagtagctgggactacaggagtgtgccaccatgcctrctgcttttttgtttgtttgttttttaaatttttttgtagggatgggawcttgttatgttgctcaggctggtcttgaactcctggcctcaggggatcctcctgccttagcctcccaaagtgctgggattacaagtactttataatgtgtaaatggcctgtacattcttaatctaatagcctcatgaggttataaaatacaaataaaataacatgaaagccatttagagttttaaggtgtataataccatgtattctcattaattaaattttaataaatttaaaagataaaattatttttataaaataaatttatttttaaaattttaattacgttaaaaagttaatgctttttttttttgagacagagtcttgctctgtcacccaggctggagtacagtggtacgatcttggctcactgcaacccccgcctcccaggttcaagcgattctcatgcttcagcctcctgggtagctgggactacaggtgtacgccaccatgcctggctaatttttctatttttagtagagacagggtttccccatgttagccaggctggtctcaaactcctgacctcaggtgatctacccacctcggcctcccagagtgctgggattacaggtgtgagccaccatgcctggccaaattaaaaagttaatactttttaagtgcttcactctttcctgtgcatgttgtcttggcctctttttctaaattagttttattccctctgtaatcagagggtcaccaaatctttgagttttagagggaagagaaagtttttagtgaaacaagtgggtgaactctgatccctgtaaaatagtgccttcatacagtaggcactccaaaaataattgttgaatgactgaaactcttaaacagcagtaagcatacgtatagcagagacaacattacagagtagagctctttctaggttggcatggtagatagctctgagggactacctgaatggagatgccattgcttttgaataaaacaaatatacatggtgtcttagtccattttctgctgtgatagcagaataccacagattgggtaattataaacaatagaagtttatttggctcgtggttctagaggctgggaagtccaagagcatggcactgatatctggtgagggccttcttcttgctgaataataacatgtcagaagggcaagtgagcacgcgagctagaggggatgggccaagatgtcatcctttatcaggagcccactcccaagataatggcattaatatactcatgagggcagaaccctcctgatctaaatcacctcttaaagatcccacctctcaacactgttacaatggcaattaaatttcaacgtgagttttagrggggacattcaaatcataacaggtagttagccctgttgagtaatggagaaaggattgtattagttccaaggaaagatgcatcatccagtgtgggtctggaaatatttgccagatggcttttctcttttagtaatattcatttgtggaatgtttctttaggtataaattggtgctgaagtaatttgataaggaaaaaatatcactgcctaattggtatttggtcacgagcagtaccagttcgtaagatttttttggaggtagcaaggggtggatagtgctactattggaagtttgcttatggaatcttttgctctcttgaagtgatttggagattaaaagagtttagtatcattggggatagctgtggtctactgtcagttaggaagtaactcatgactagatatcctgggcttattacttcagctcatattcctgacctcacaaaaatgttaagagaataaatcgtaagtataaaaagcactgagattgtgtagagtggaaaataacattagtgttagctccctcactgtattacacaaccacattctaaatttaaggaagccagaagtaaaatcactctgaagcactgcttttgaaactgcagattatgatccatttagagggacacaaaatcagtttagtatatcaagcgttaaagaaggaagaaatagaaatgtgagtacattacaagtaataaggtgctaagtattattttggaaacttttggttttatatgtttctgtttctacatgtattagattgtgttgtaaaagacatttctttgggactgtattttacaacacagtctcatacacgtagactctaatacacatattgaaacagtttgaaactcagtggtctaacaagtagcataccccaaatttacaatatttgtagccttctgctgttgggtacattcatgaaaaggtcttgcatccttaaagtgaaggctgaaagagttttatgtcattggggcragtgggctaccaagctcccataaattctaggagctgccttttgtctaacgattaggattattgagtactattttgatgccttttgggtatcatctgaaatgtaatcattgaattggaaatggaataaacaagagaaaggctagtttactcattatttgacaatagctctttaaagtagttaatattatgaatattcctactactaaggtttataagagtttgtttttttctttaatgttatactttaaaaagtattattcattcactgggcaaataatttttttttctagaggaatacctttccaattttataacagtgaaggaaggaatgttttacttayagaaactgtactgaaactactgttctattaagcaagggttggagataagcacccctgtcccccttccctgcccaggcacacacatatacagatacagcttattttatgactgtattgttcttgtgtttcttcttctagataaagacataaagattgatgaaataatttacctggagttgcacagtaagctagtggcctttgtggatgaccattcatagttcatatatttccagagacacaatacattgataaaattgaaataaacagaagcctaagaattataagtatatattcagagatatatagacaaaaaagtactgttataagtaaaaagacatagtgggaatagtaattataatcacatgaacttctgtgccatctctatctagatcaggggtgtccagtcttttggctgtcctgggccacattggaagaagaataattgtcttgggccacacataaaatatactaatgatagctgatgagcttaaaaaaaaataaaaattgcaaaaaaaaaaagtctcatgatgttttaagaaagtttacaaatttgttttgggctacattcagagctgtcctggactgcatgttggacaaggttgatctagatgtttatctgtagtcatgacctaactatataattttagtatgttatacatggtaccatgtatccagggtagatcctgccaagaacataaattgtgaaaagaaaactcttgggatgctgctggattgtaatgtgttactcctctgcccatgaatactgaaaatcaagatttgaaagggtactgaatactgagtcaaaaggcatgcgttcctagacttcacttaatcacaagcatgtctgtatgagcgtagtcatgtcatttcactttggggtctctgcttgtaaaatgaaaatgttagacttgatcttccaggttcccttcagctcttacattctgtgcttcccaagggctagagtattgcatcaggacccagcctggggtttgtgctgttttcaaggtcctaaggaactgcatcatcctttagtccaaggagataggataccttatgccacagagcccaataattcagtgagctgtgagtgttgtgagttgcatctacattggggactgagcctaggttgtttgtagtaacactaggaggaccttagaatgatgccaggagatgtaatttctgtgatcaactagttgactactcaaaaagcttgtcaggacccatccaactacagtgtcattctgtctttggtgttaaagaatttagatttatctccttttaaaggacctcctttgaatttaagaattgccattatcttcataagaatcaaaacaaatacaaagaaaatatattcttgctgaatgtaatttttaaatgttagtgargaatgtctttatatcttaattttaaggcttttaaaaattagtttgcatttgctggttctttgctgtcaccctaatactggttatgttacttttttgctcagtgctgtgaattgttcataatatctatagtcatcttttgacattggtaacttctgttttctgggtgaattaggaattagtatcaccagaagaaaagctaatctgaataattgttctttcatcatctcgttcatgcacagtatttaaccatctggtttgaccacaactttcacactagacgagtctttataatgatagaaatcatgacatacttttgatgatagactcctctggtctttcccaggttttggctggtattgccattgctttggattgaggttgttgatgcaacagtgggctctggggaatggccaccaagaactgttggggaattgcagataaactgtctccatgggtagccctccagggaacttagtagttgtctaatgttaattaccttataccacagtctaattactaagagtattgtctgagtccattcaggctgctataacaaaatgccataaacgtggtggcatataaacaaaagtccatttctctcagttctggaggccaggaagcccaagagcaaggcaacagcagatatggtgcctgatgaggcccacttcctggaaggtggccttcataaaagtggttcatagaaaatgtcttctcactgtatcttcacatggtagaaggggcamatttgctctctgggggtctcttttataaagtcactaatcttattcacgaggcctctgccttcatgatctaatgaccccccaaaggctccctcttcctcctwccatcagcttgagggttagatttcaacatatgaatttttgggggatgtaaacattcagtccattgcaggtataaatgttttcaacaagcatttgttgagtatctgtcctttttctaagctttcatgttcctactagaacactggatgtggatatccaataggaatatatttaagtcagtatcattatctttttctcaaaacatcttctaccttttttaccttcccttcctcttctagtcttaccatagttaatactgatattaactgttaacatcatagttaaccagtctgtcgaacttgaacttgaaaattttgaatgatctatacccacacccgaaaaaattactcacatacttaaaaatccatgccttttgttttgttttattgctgttgtttgtaatttacttatttttaccygatactatgttctggaaatttttctacgtagttcatgtagatctgtcttcttcttaatgtttcatggtatgggtacataaaatgcacgtattatagtttatttaaccattcttctgtgggtggacatttacattattttttcccttttgttagagaatactgaaatgaatatccttgaacatgtttatttgtatacatgtgcaaagtatgcagatgccaaaaagtgagattgctaggtcaaaacgaacatgcgtttaaaatgttgatagataccaacaaattgctttacaaaagttcctatcagtttgtatatcagtttttctaagtcctttttaaacatggactggattagcccgttcttgcattgttgttaagaaatacctgagtctgggtaatttataaagaaaagagggttaattggctcatggttctgcatatttgtacaaacatggcttcaacatctgcttccggtgagacctcaggaagcttacaatcatggcrgaaggcaaaacttgagcaggcacgtcacatggcaagagtgagagcaagaaagagagkggggggaggtcctaggcttataaacaaccggatctcacctgaactaactgagcaagaactcattcatgaaagatgcacccccgtgatccagtcatctcccaccagacctcatctccaatgtcgggaatcacatttcaacatgagatttggaggataggcatccaaaccatatcatggacctagcatacttctcccagcctcacgtctctgatttaagtgttcactcatttacttgggcactgttacttgggcactgtcagcccctgtccatgtttgtattcagtataaattgtgtgccgggcactctgccacatgttggggatttagtactggatgagacagaaatggtccctgccatcatgtagcttacactttgccacatagaacttttgccatatgcagactctttttatgcatttgcagctactatcctctctttctggtatgacttttttccttttaacttttctacctagagaattttctttcatccttttaaccagcttaaattttgccctcygtcattatctttatcccttcagagttagatagtccttcctcagtgctccatcttggcactcatatgctttttgtggctattcccctgagaagttttcgtgatttgtttgtatatgtatgtgcctgtgtgtgtgtgtgtgtgtggacacacatctacatcttgcatattagattgtaaactcagtatagacttggaactatgatatgtacctgaacacttccccagcttactgccttcaaccctggagatgcttaatcaatgttgattaagtgaatgaatagtaaactataaaatgaccttagtttgtacagggcattgtaggggattgtagatatgaatagaactggtctgtcttcaagaacttaaccatatagtcagggagataagaaacagatgagtagactgcaaggcaggttgtgataagctctgtataggacttatcaaaaatgagtactggaggagaatttaaagggagagaggaattctcgtgaatgagatactctggtaagtttacagaggacaggttttttcttgctcgtaccaggtgttgtgaggaatacacatgatggtaagatatggttgctgactgagagattatagtcaagtaaggccttagagcaggcattggtaaattgtggcctgcaagccaaatctggctcttgcctgcttttatatggtccttgtgctaagaatgatttttacattttaaaaattgttaaagaatattttatgaacatgaaaattatatgaaattcaagttttggtgtcygtaattacattgtgttggaacacagccatgttcctttgtttacacaataactgactatatttgtactccagcagcagagakgagtagttgtaaaggagaatgtttgctttgcaacacttaaaatataaaataatttagtatcaagctcattacagaaccagtttgctgactactggggtagagaataggaaagattcaaatagagaagagaaatgacattgatattgggggtattagtgtgagttaagagagtgggacagtgattctagcagtcatatagaaattttagggctgaagtgacgatctagcttaaccctcttactgtataaaataggcacaagattgaaaatagtctcaaagtccactagctgttaagtggcagtggagtgctgctggagtgactggtacagaagccttgagggctgtagatgataataagattattgctgaagaagggcaagatccggaatgaccttgcccttgaaaaatgagagttgaagtacaaactaagaacagacttcttttctctctctaaatgtaatgtttttatttttcacttgtatttctagaaggcctttgagccctacttagagattttggaaktatactccacaaaagccaagaattatgtaaatggacattgcaccaagtatgagccctggcagctaattgcatggagtgtcgtgtggaccctgctgatagtctggggatatgagtttgtcttccagccagagagtaagtatgctgtctcctctgtaaaggtatagtggtgtgtcactagcctcaaactaattgctgagagataggactaatttattgccttttggttgtttttttgtttgtttgtttgtttttgagacggagtctccatctgttgctaggctggagtgcactggcctgatcttggctcactgcaacctctgcctcccaggttcaagtgattctcctacctcggcctcccgagtagctgggactacaggcacacgccaccacgcccagctaatttttgtatttttagtggagatggggtttcaccatgttggtcaggatggtcttgatctcttgacctcgtgatccacccacctcggcctcccaaagtgctgggattacaagcgtgagccaccgtgcccggccctggtttggttcttatttttaaaatctgtttaaatgtaaagcagtactttgtcttctgattggtcaagttataacaggactcttgtataactaatactccttacattgattttttttggatttgtagttcacgtaaaaacgcctcagaattagtcattgtaaggatccacagaaatctcagtatggtttaaacctttggtaccagtttcttccctagaacataattatgtcacctggagttcccagagcaggaatttattgctttcattttgtgctatccttttcagtaaagattaggtgaaattggaacagcacttacatggtgaccatttgagtgcttgctatgtgccaggcactgccatcaggctgtggggatatctgcacaagtagtacaggatctctctcctcttggagttgaactggtatcaggggatcgtatactttgagcttcctagaagtgactcagtgccagatcaacatggggaagaagaggccacttctcagggtgcagaagatgagcagtctcagtgatctgcttctgaatcttccacctttgcttaggattaagcccctctcctgcccacccacctttttcccgcctagaaacctggttgtgtgttaccttccttttttttttttttttttttttttttttttgagacggagtttcgctctgttgcccaggctggagtgcagtggcgcgatctcgactcactgcaagctccgcctcccgggttcacgccattctcctgcctcagcctcccgtgtagctgggactacaggcacgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccctaccttcttatgagttattttcctctgcagtctgtgcttggtgagtgttgttagtacctaaacacaagtagtggatttggtgctggatgttctataacactcccctgcaccttttccccactcttagtagggtatgggagttaacttccttgggataagaaaacagtaacattgaagataatcattagctgtttctcatttgcttgaaatttccccaccactttgcttccctgataacacctgtttaaaagggctctttaatgtgttttttctgcttttcttctcttgttcaaggaaagtcaatttagaagccagattccatttttatctctttaccctgcaaatagcttcttagccatttatggcgcagtaaacattgcaaaacctgacaaccaagaagcaagttccaactgcttagagtttttaaattaaagtggaaatgagacctgactctcctgtgtaaatctgtagctcactccagctttaaaaaccttgtcctcagttgctgctcctagtccttgcaagattttctgataaactctaagaaattagactggccggcccttccgctgcatctgctcaatggtttggatatggatgtagcttgtgtccttctgctcttgcttattcctttcctaggaagtattcaattcagtgagtaaggggcccatttcagaggattctgaggggtagcaagaaatatactttctttttattttttaacttttcattaaaaaaaaatcagtctctgcttatccttctattataataaaatatatacaacataaaatttaccactttaaccatttttaagtgtacagttagtcctgtggcagtaagtacgttcacattattgtacaggcatcactattaccagaactttttcatcacyccactggaactccattttaataaacatcaaataataactgcccattactctctcccgcatcccctggaaaccaccatttattgtatcgccttgttttacaaatgtactacaattcaaaggtggtacatttatgaaataaggctaagcttagagatctgagatttatattttacttgctatgattaatattaattttaggtattctttttaaaacaaattttaaaattaattggcaaataaacattgtttatatttatcatgtacaacatatgttttgaaatatgtatacattgtgaaatgggtaaattgagctaattaacatgcattacctcccatatttttctttttttgtggttaggtatttacttctgttttcagttctgcagctcactatgccatacattttgcttagctaatagtagagacacagccatcttaggttctgatacttatctgcttttagtggtcaaaaaggaatatgctggcctctgagaggccaattttccatgagaaaattgttagtcgtagtatactgatgagatatgccatctaaatccttgtgggctgaactccaagccatttgaggttttttttttgttttttgttttttgtttttgagacggagtctcactctgtcacccaggctggagttcagtggcatgatcttggctcactgcaacctctgcctcccgggttcaagcaattctccctgcctcagcctcatgagtagctgggattataggtgcccactatcacgcctgcctaatttttgtatttttagtagagatggggtttcgccatgttggccaggctggttttgaactcctgacctcaggtgatccgcccacctcaacctcccaaagtgctgagattacaggcctgagccaccatgcccagctgagttattttgtttctaaagatacaaaacaaaagcagtacatattcactatggaaaagttggacaatatgggtatataataagaacaaaattaaaatcttactactgaaggataccactattgtatttctctgtttctatatctgaatccagtttgaaccatacaaaatgtaattttgtaaaaaaaaaatcgtcaaatgttgacaattttatacaatttagcacatacacacacagcacactttcatttggtaatttccaacttgaattttagacacagataagaatgtcttccctccagagatcagggataattttgatagaatattcattttttttagcacttgctcacttgccatgtgttgctgaacaatcaagttatttttagttacactgcactaaaggagtctgaagtctggactagtgatgaattttgctgatcttccaacactgaatccctcttgagggaagagagtatttctggaacaaaggatggagcctggggtagaggagaagtgggcagcggcatgaactgtgctggggttagcagcctcttccttaattctgcctctgtgattatcagctcacagtttattacttttactttaatgctgattttaactgtgggttgtccataattcatcaacagaaatcagctttatgtcatggaggaaatgataaactctcagtttcttgttgtgtcaccttgggtgacacccttaagctctcttagcccatttccttgcaataaaatggacatcataatagctgctttacctagtcatgggtaatatgaggactgaatggcatcttttgcatgagtggaatttgtaaactgttaagaaccatgcattgttcttacactggcattttctattttgttaaacttaaaattctttttttaaagtaacaaataaaaattgtatgtttatgatgtacaacatgaagttttcmaatgtgtaagttgtggaatggctcaatcaaactaacgtgattacctcacgtacttttttttttttttttttttttttttytgagatggagttttgctctgtcacccaggctggagtgcagtggcacgatctcggctcactgcaacctccgcctcctgggttcaagcgattcacttgcttcagcctcccgagtagctgggattacaggcgcgtgccatcacgcccagctaatttttgtatttttagtagagacagggtttcaccatgttggtcaggctggtcttgaactctgatctcctgatccgcctgccttggcctcccaaagtgctgggataacaggcgtgaaccaccacacctggcctcatgtaccttttttaatggtgagaacacttaaaatctactttcttagcaatcttgacgtatgcaacacatttttatttactatgtcaccatgatctcttgaacttattgcttccgtctaactggaattttctatccttttgaccatctcccagtcttccttcttccccttactctcaatcccactaaaaaattctaattacttttcattctgtaccttctggggacttttgagataatctttttaggtcagggccatgggatctttttatttttagtttcttcatctctgatgctgtattccgttctttttaccctgtaccattttttctcacaacttccacaaaattagtttattcttttatcctccacctagtcacattactatacttctggacagctggtccagtttgctgatttttagacttctttttacctcattaattacttcatcaaataaggaagcatttctgaatctgtacagctttaacagttagaaatagttgaataacaagaagctaaaatatccaatattagattatagtcatttgatgaactattataacattaaaaatatgtttagaaagaattgttaataatgtagaaagtgctatcagtgaggaggatacagttattttacattatacagaatctcaggtatgtattacagtgtgtagaacatagggctagaaggaaatactccaaaatttaaacaaaaagtaaccacaaacaagtggtttcagtctctttgtcttcttattcagtctgtgtcttagttacctggttttgtcccaggtgtttacagaatgtggactctagggagagttagaaagagagggatgcagctgaagcaaaaacagctagcagagatgcaaggcatgatgtgatagatacaaaaagggggtgcagacacatcccgtggttgttgagtgaagagggagctccttctggccaggaaagtgggaatttccagatctcctaggaatgcagtagaagttcatattcagttcacaccttggataaaagccaggcttagattcttatagactcaaacagaaaattcctgtggtgcatttgaagcagtatagaatcctgggaatcctggactgaaaatacaaagacttcagttaaatctttgctctatcactgattttatctgtggccttgagcaagttttgatgctttgatcttgcattgccttttatgtcactcgtagatggtatataatgccttctgtgccagcctcagaatgctgttgtcagagtcagtcgagatacattgattgtgaatgcatcagaaggtctattagtctatttagatgccatgtatttatgattattatgatcgacaggatttgtattccctatttgttctatgtactgcctgacagagtggactctggcatctgtgatttttcaaacttttttttctttttgttgagacagggtctcactgtgttgcccaggctggtctcaccctcctgtgctcaagcagtcctcccacctcggcctcccacagtgctgggattagaggtgtgagccactgtgcctggccagcatccacaattttgagggcatttgtaggtccagaaaatgttagaatctgtgttggatgagaggctggacatagatccaagaaaaacaaaactaaaaacaggctgcccattagtcttgggggaaggaagagaaatgttgaacatctagaaaccttaggaaggtcaagaattctggaacacgtatatcatttgacctagtagttctgcttctgggagtttatcctgtaggtgtacttgtagtttatcctgtaggtgtgcagtatggtgtgtgttacaaggttatttcagcatgatttgtaatagcaaatattagaagcaacctatatatccatcattaaggggcaggttaaataaattttggcacatccataaaatggaatactctgcagctataaaaatgaatgaggatgcactgatctttaagataatactcctaagtggaaaaacaaggtctactacagtgctagagtgtgctactttttgtgcaaaaaaagggagacaaataagaatatagctttactgttgcacgtgtatgcataaggaaactcaggggggtagcatgagggttggggggatacgtttgagagagggaagcttcactgctttactgtgtgtgttatgtgtttgtatttttaaaattttgaaccatgtaaatatagtacttattcacaaacttaaatttaaaagtttttttwaaattttttaaacgaaagaaactctttgcaattggaaggcaagtgaggtggaagacacattgaatggttgctatatgccaggtcatatccatggaaatttatttgaataagagaaccatttgtttcttttaggtttatggtcaaggtttaaaaagaaatgttttaagctcaccaggaagatgcccattattggtcgtaaggtaagtagaatctgtgtatgtcattttttcccctcttgataatcatacctctttctttctatttactaaacctaatattctcaaagtggaggggtgattttgtctcttacctccaggggacacttggcagcatttggagacatttttggtggtcacagcttggatggaggggtgctcttggcatgtaatggatcgtgtccagaaatgctgctaaacactaaacatcctacagtgtacagggcagcccccscccacccaccaaacacagaattatctggctggaaatgtcaaaatggccaaggttgagaaccctgacttaaccctttctccaaygtaactggccaaaggagagatgagaagcctgttaaggaagtaagaatttgagaaaacctgactgtattgttaggtgctttggaacaacatgcagctggctgactttaggtatttatctaggagttgggtgcttacatggtttaggtcaggggtcggcaaatgttttctataaagggctagatatgaaacattttgggctctgtaggccatatcatttctgttgcaactcctcacctctgcccttgcagagggacagcagcaagaggttcaggaatgagcctggctatattccagtgaaactttctttacgaattcaggtaggcctttgttggttcctggctgtagtttgctgatcccaagttgcacagcgctgtctcttgctgtttgcaattttctgtattgtagtatgtcccctttgttatgtcctcttggccctcatccatgttgaggataaggtagtcacctctgtgcgtctcccacaggttatcccagatgaagataaacagggcaggccacttggcaagctctaaggaaggcatatgagtccttggaatcttcatctcctccagtgccctcccctgacccccctttggtctttcccaactttacctgcctttaagttttcttctacttttggctttcagttccctttcctggctataccagggtttgtttgccaacccctgacctaaagttggccagttatctttaacctttggctgaaatccattcagatcgctgtgctaactctcccagagataggtatcttcaggttcatttcctgtaggagagtgggagcaataacaggtggtgaagggaaatgtgagcatataggcttctgtttgctctccaaattatattaatccctaaaagtaaatctagtccttacagagtataaggggtggggacagggaaggtattgtagaagatggactgtagcacaaaggagattaggatttccccttatctcctgaatttttttttcttcttttcgttcagttttcagactttgagacaaataaatgctagggttccagaacccactcttaaacttagaaagtaacagaattggaagatccttagcttgccaaggactatccaatcactctccatttttcagaaacagattctgaggcttagatacaaaaavttacatgtgtgtakgtgtgtgtgtgtgtgtgtgtgygcgcgcrcgcgtgtgtgtatacctctgtcatttattcacttaacacatgcttattgagccacctgctcagtgtcaagtacttttctgggtgctggggatatggtggtgaacaagaccaaatccttcctctcatggaacttacattttaataggaaagacagaaaataaagaagtaaacaaatatgtggaattttattttgaaataaatgctttgaagaaattaaaattgggtaacgtaatacaggctttgaggcaagaattgggggtaaggaagtacttgtgctttctaatatacctctctgtcactttttgtctgttttatggcaatagcatactctatgtatggaagctcagctttcatagcctgttctgttgcatgagtcgccatttatgtgaattaattttttaatttacaacttaaaaaatgtcttcacatscatagcatgcccaggcattgcccaggagtgtagcctctgctccctgccagtgtgggcctcttagactattgcagacatgctcgaaaggagtggctttccctgtggtttcactgagggccatatctaagaagatcttcttgtattctaattatccttggctagagatgagaaaatcttagtgtggagtgagttctggygttctttaacaaatatattgctgaaacaatagcactgtgacaaatcgtgacatgtagcttctctccccaaacctactacccaagagccttttgctataagcagcagcccctgcccttctgcctccttactctgctattttttttccctcagcactttttgttacctgtcttactattttctgtctctcctgctgaaaataaacttcatgaggacaggaggttttttttcctgtgtgctccattgcctaagtttgttttgttcactatgtgtccctggcctgcatatttgtgaatatgcagtgaatatgaatgtgaatatgtaagtgaataaaagaaaacagctcagaagctgtggctttgaggatggaaaagaagggaaccatagttgataaactacctagcagaaaggaccttagttccttttaatattttggggtcagacagtgcaagctgtcgacagcagcttaaggagayacattagagtcttcctggcagttcttagaatgccttgtgmtagtgttgaatggsacctccaaattcctagtgtgctgcgtgtatgtctgttgaaggagctcatcacttgcacaaggaccagaatcacttttactgcagcatggccagttttstggccactgttcctagttayacctttgattcttttacacacacactgtagctgctgccaaggcaggatcaaagtccaaatactgccctcaaggatgtgctgactttagcaatgccaaccaagtgaagcagcagtgatgtcaatgtggcagagaaaagggttatggggaaattgggtgcaacttttttttttttttttttgagacagagtcttgctctgttgcccaggctgaatggagtacagtggtgtgatcttggctcactgcaacctccacctcctgggttcaagtgattctcatgcctcagcctcccaagtagctgggattacaaatgcctgctaccatgcctggctaatttttgtatttttagtagagatggggtttcaccatgttggccaggctggtctcgaactcctgacctgtaatgatctgcccacctcggcttcctgaagagctgtgataataggtgtaagccaccgcgaccggctgagtgcatcttgacctttagagagaagcttcgcttttcaaatttttaagaggctattgtacatgccagaaagtagctgatcagtcagaatatcaccatatatctttaggaaaaatgttagtttagttacttgtgcggtgcctagcattgagcagttgcttgactgtcataataattctgctgtctctacygtactcttgcatctggataactttgtctttcttacctttggagattcaagacaagttgaacaagaccaaggatgatattagcaagaacatgtcattcctgaargtggacaaagagtatgtgaaagctttaccctcccagggtctgagctcatctgctgttttggagaaacttaaggagtacagctctatgggtatgatgcttggcatatacatgctctctacttccttaaagagacaggttttgtcattgtttaatgttcacataggttaagaataactcatcattggttaatacatgtttaggagggcctactctctgtttcacaggttgaatttcctatttttaaaattatgtttagattcatccttcatccataaagcaagcaaatctcagagacagtggaacttggcttttatttccttttgtaagcatgaataaaacaaatatatttgtgtttaagaagagagartataagatatgtaatacaaatgaaatacagatccatgtaaaaatgtgaaatctgcataaaggcacaaaagaaaataagtcactataattccactatcaaagataaacagatggtgtctatctttatgcatgtagctataggtagagctgtctatatagtttacatctatctatatatgtatatctgtctgtttctgagaatgctaatagtgtttgtctgtgtgtatacacatgtatgcatgagcacatatgggatggataaatagaccaaatagcttggtgcttaagagcgtaaccctggaaccagcctggattcataycttggtttgccacttaaagtatgcctttggcgagttacttctgtatgtcacagttcctgtatctctacaatggggatagtaatagtagtacagtacttacctgaaaagatgattatggggattaaatgagatcatacatgtataaatgttttatagtgcctggcatatagtaaggattcagtaaatgttaaacattattgctattattaactcaaacagatttatgtttgttactgattaagatcatattacaagtactttttaaaaagaagctttttagtttgatatatttacagaaaagtagcaaagatgatagagatttccctatacccagcttctcctgatgttaacatcctctataaccatggtacgtttatcaaaactaaaaaattaacattggtacagtgctattaactacactacaaattctatttctagttcatcagggtttttttttgttttgctatgttttgttttaaactaatgttcttttttctattctaggagccaatccaggagccatgttgcattttgacaaatacccttattttttattttttgagacagagtctcactgtgttgcccaggctggaatgcagtggtgtgatctcagctcactgcaacttccaccttccaggcttaagcaattctcgtgcctcagcctcccaagtagctgagattacaggcgtgcggcaccatacccagctaattttttgtgtttttagtagagataagatttcaccatgttgcccaggttggtctcgaactcctgaactcaggtgatctgcccaccttggcctcccaaagtgctaggattacaggtgtgagccactgtgctcggccttgacaaatacycttacaatttctaagtgacatgtgttgaggtcttgacattgaatagtacaaaatttgatatagtctaggatgtagatgaataaagcagtggttagcactctaaaacctggtgttaaagatttccatgattatgagacctggttgccgccatcatattgccttctctttaatgtttaagtcactgtccattgctgtattctctagcatcagtaaaagaacaggaaatgaaaccagttatcttatttttgaaaggctggtgaccactggtctgaagctgtgtatagtacagagcagtgtcctctaaggaaagagtgaaagtcaaacgggcagcaagccagagcttggcagattgctgtaagaatgagtttgtctgtatatttaccacttagttttctgttctcaagagctgaagatctttgctttggagagcccttggctccatgcagtttttagttggtgtgtttccgtaatagctttctcactacccactttcaatagggcacagctgcattgtagcacaaggacctgagacacccatatcaacaaatttgtgggtaaaatgaagaatgtctcggggagagaggaaagtggaaagtcagatcttatattctactcaggaactttacttttctttccacactgggataaaggaggtttatcccaatgttgactgtgttcctgatcttgaatatgctacagcgtgtgctgctggaagcaggtaactagttttatgtgggtttccaggcttggcttaagggagccggcgtctgagaccggggtgctcatggtttatacctcattgtggtttgtttgctggtttcatctctgatgatagtgtgctgaaatttcacacttttcattttgctttcttctgccaactctgctcataatagttctcaaaattcctaggactggataggaaaggagagaagaaggaagctattgcagaaaaaggccactccaaagccatatagagaacaaaaaataagtatagacaaaggcaaatgttcctgctgttagaaggcagttgaggatgaggacaacattattatcagattgcctttattgtagctaaatgctattaatatctttttcacattgctgataataatgatttttcatctttattttattgtgctaactctattgaacttttttcttgatttgctataagaatgctgttgggtttccwctcaacatttttttcttttgtatccagaggagtttcttcctgtttcttctttatcagaacctgtcttcccagagattcttgcttactgaccagtgaccttacctttctctgcagacgccttctggcaagaggggagagcctctggaacagtgtacagtggggaggagaagctcactgagctccttgtgaaggtgagtgtccagttcttgagggaagcctgtgaggtctgtgccagtttacatgacctcctttttttcccttacttttgtaattagaaaaattacttaaggaaagcttattggtacaataaaaccataaaagtttctcttcacccaaacataggcgaatatgtataatattatcaaagacatcttcagtctgtaaaatagtaaaatgttatttatgttttcagtctttgcagatgtcctgtctagaaggcagattactagggaaggtagtcctgtcagatgagatttttgtggtgagacagattttgtttgataagaagagataagatagggaaactctttcataattttctcaaatcatgtgacccaagatgagcagtggtctcatgtatacttcaaataattctcattcttagcttcttccatttctaatcaaatttatttttattttattttattatttttacagacaaagtctcactctgtcacacaggctggagtggagtggtgtaatcatggctcacttcagccttgacctctttggctcaagtgatcctcccacctcagcctcctgagtagttgggactacaggcgtgcatcatgacacccagctaatttttgtatttttttgttggagatggggtctcactctgttgcccaggttggtcttcaactcccagcctcaagtgatcctcctgccttggcctctgaaagtgttgagattacagctgtgaaccactgcactcggccctcatatttatttttgaaactccacttcatcatataaaattggggttgtactgatgatctctaaggtctttgtgtttgattattataaatatgaaactgtcccttactaaataaatatggcaggttttgcataagttggtgtaatgctctgatcttctgtgcttaaaatctttcagtagcttcccattatctacaggatgaaactcaggttcttatgcagcagagaatacaagtttcttcatgagccagctcccacttattttttcttaactacttctcttyatttcccacataaacactaatcctgccttttctctttactaaatgtgtcatgcttttacgttgttttccttcccttccatcattcctcttgttccaaatgatgattcctactcatctctcaaagttccactcagcagacacctctagatcactcaggatgttagttgttccctcttcagggtcccttagcactctgtacacacacctgatattgcagtcgataacaacagctgctttgtgccagacactctactaagtgcttcacatgcattatgttatttaattattgctagaacactagaagatagctaccataacaacttctgcgtatgaagaaacaaccttagattatgtgacctacacagctgaaagtaataggcaaagcttagacttcctcctgggtcggtttggtgttatagtctgcgcttttaaccatatttatacttctttcctcatcacattgtaaaattatttatttacatgtctgtctcctctgctatgttttgatcttttggttgaggaatatatcttatctttttttccagtttatattgttgtgcctaatacttagaaactgttgtttagtgcatgattctttgtcctgtatagtgtaatagttttgatttcacatctgcttgcatttttttgcaggcttatggagattttgcatggagtaaccccctgcatccagatatcttcccaggactacgcaagatagaggcagaaatygtgaggatagcttgttccctgttcaatgggggaccagattcgtgtggatgtgtaagtatatgcaaggggcatccaatagccttattttttaggttaaaatagaagagtttttaataaatattaattatattttaaaaaataaaaaatattaaaaatattttactacacaagaaatatttgatcattgtagaaaggtcattttactacacaaggaatatttgatcattgtagaaagatcctaattaactgcagttttaaatgttacttrtaattttgtaacctagacaatgtcaacattttggtatatattcttctagatatttttattttcacctttttattttgaaaaactttgaacctacattgagttgctaggatggcttaaagaacaccttagattcactaaatgtaaatatgttgccatatctgctctctacactctttccctccctacccgcttcttccctcatcccccacctgcatacctaccattcccctatttatctgtgtatacttttgttgttccatccagcagtgtttttagtgtacttctggttttacctgagccaaagtttaatttattattttgctgtaaactgaacctcatttagttgctattaggcataaagaaagggggaggacatcattatayttaaagaaacacatgaggattctttgttttacctgttctttcaagtagatggttgttagttttcgtaaactatgatagataaacttctgtttagatctgttgtctttagaaaaaacgaaatctcaggttatgtaggatagatagatttaactcaatatgctgcaatggtgtcctagaggtgctaatcctatcagatactcatcatatttgcagtcattataaagactgcagatttaattattgaagggcccattcgaagagcacctaatttagtttctttttttttttccaggaagcattgtttttgttttgtttttctaatatgttggcgccatgaaaatcatcatgttcaaatattagtagtaataaaggtgatatgcctggcattcattttcaaagcaaaatactgaaactgttaaaaacagaaccacccataatacagcagcagtttcccttagagtactgaggtgaacagggtgactttcagagggaagatgataatgtacttacagtatattctcctatgccattagactcttgaagaacttgtaagaggccagagtgaatagccacagaacagtttggccttatctggtaaatttgaagatacatatatcttatgacccagaaattctgctactaggacatactctagaaaaattagtacacatatatatcaggatatatggacattaatattcatagcaatgttattcatgatagctaaaaactggaagtaattcaaatgcctatccacaggacacagatgaataaattgtggaatgctgtgtgtgcctcaatccattgtagctcttattcagattgatgtacaaattgcctcatccatctttggccagtggaaacatcatattggctcctaggtccatttacatgacccaagtaatctttgaaagccttttttctctttctttccttttttttttttttttgacgaaatattccaggttcaggttcactttgtccatttcctgctccaggccttcaatcagccatttatccaaggagccctggttcatttaaaactaggtaaaataattacatagttccaaaatcacatttatggaacaagacagattaaaaaaaaaaagttaaccagaatgcagtccagagagacaaagaaatagaaggtatgaaagagaggctaagagatgcaaaggataggatgagaaggctaacacacatctaactggtgtttgagagcagccagagaaaatagattacctacaaaggcataactgttaggacaactgatactcaatagcaacgatggctggggcagttgggggtagatgaaagattggctgtaaattgaaaattgctggagcctggtgataagtagtgagaggtcacagcgtgctggcagtcctcacagccctcgctcgctctcggcgcctcctctgcctgggctcccactttggcggcacttgaggagctcttcagcccaccgctgcactgtaggagcccctttctgggctggccaaggtcggagccggctccctcagcttgcagggaggtgtggagggagaggcgtgagccggaaccagggctgcgcgcagcgcttgcgggccagctagagttcccggtgagcatgggcttggcgggccccgcactcggagcagccggccggccctgccggccccgggcaatgaggggcttagcacccagccagcagctgcggagggggttctaggtcccccagtagtgccggcctaccggcactgcgctcgatttctcgctgggccttagctgccttcccctggggcagggctcgggacctgcagcccgccatgcctgagcctcccaccccctccgtgggctcctgtgtggccccagcctccttgacgagcgccactccctgctccacggcgcccagtcccatcgaccacccaagggctgaggagtgcaggcgcacagcgcaggactggcaggcagctccagtcctgcaggcagctccacccgcagccccggtgcgggatccactgggtgaagccagctgggctcctgagtctggtggagccttggagaacctttatgtgtagctcagggattgtaaatacaccaatcggcactctgtatctagctcaaggtttgtaaacacaccaatcagcaccctgtgtctagctcagggtttctgagtgcaccaatcgacactctgtatctcgctgctctggtgggggcttggagaacctttgtgtggatactctgtatctaactaatctgatggggacgtggagaacctttgtgtctagctcagggattgtaaacgcaccaatcagcgccctgacaaaacagaccacttggctctaccaatcagcaggatgtgggtggggccagataagagaataaaagcaggctgccagagcaagcagtggcaacacgctcgggtccccttccacactgtggaagctttgttctttcgctctttgcaataaatcttgctactgctcactctttgggtccacgctgcttttatgagctgtgacactcaccacgaaggtctgcagcttcactcctgaagccagtgagaccacgagcccaccgggaggaacgaacaactccggacgcgctgccttaagagctgtaacactcactgtgaaggtctgcagcttcactcctgagccagcgagaccacgaacgcaccagaaggaagaaattccggacacatccgaacatcagaaggaacaaactccagacgtgctaccttaagagctgtaacactcaccgcgagggtccgcggcttcattcttgaagtcagtgagaccaagaacccaccaattccggacacagtagaagcccattgggcttttmaattttatttactctaatttcattctaaagaattctgttttgtagttctccttttattttattattattttttgagacagggtgtcactctgttgctcaggccagagtgtagtggtgccatctcagctcactgcagccttgacctctctgggctcaagcgaccctcccacctcagcccccttgagtagctgggactacaggcatgcaccaccatgcctcgctaatwtttgtatttttagtagagatggggtttcaccatgttgcccaggctggtsttgaactcccaagctgaagtgatctgcctgccttggcttctcaaagtgctgggattacaggcgtaagccaccacgcttggccgtcttttttttktttttttttttttaatctgcttggttgttttttatagtccttttccttggcttaacttttgtttacttaaatatattacacataaatatgttgtattctgtgtctgwtaattccaatatccatgagccttacctgattctgctggcttcagtcatggttccttgtttccttatatttgtgattttattttatttatttatttttttatgagccactcatttttctgggaacctagggattctttgaggcctagattgaagttaagtctggaagttctcttcttccagagaagatttgtcrtacctttttgagttgctggggattgccaccacactggaaccaaattaagtcaaatccttagcttgtcattttgtaccacagaggtagtgtgaattctgaccacaaactcacataaaggcttccttgttacacattcttgaaagattgctatttttctttacttgaacatcagggttgagaaaaacagtttttcttttctcttttgcagtagtgggatttatttcttgtacactgtagagtgtggtctttttccagccatctcctgttggactccttatcttgggcagtctctaatgtatcttctggtccatcctttgctcatctgtcagtgtaggagtttgaagtctgaagggtctggtgccacctcagggtgaaagctagttttgccactcacttatcttgcaggattcttgattttgctttgtttgggggtttagcaagtttctttmtgttaggttagtgataggtttaaattttttttttttgatgttttatcaagttttttagttatttcagttaggaaggttgctcaaggtatataatattgctagaaatagaagttccataattgttttttccatgtkacagaccttcgtctrtttgaaagcccctttctccctgaatcttctctgccccacatttttctgggttactccgcttttcatatgatttcacagacttccaaccatcgcagtcattctctgtatgacttttggttgcctctggccagattgaacacagttctccacatttggagtggcattgatctttcaatctctgtcttttttaaatctgggttcaataaacttatttcagaccttttccttgaagtcagcatttttattcttggcaatgtttattttattccttgctgttcctaatgtctttgttagttctgtatggatgctactggctttgtttttttaggtctgtagctcattctttttgtttcatggtctaggttttgaactctttgttttcttaaattcatgttcttatgatattttcctawagtgagaaagttataaggggtttccttcatcccttagcttgtttccttctgtgttgggtttttattttgcatgctacatactaccttttcccctgccttttagtttgtttgcatagtttccttgccattttctctcatcttggggtggcattctccagacattgttmttatgcactgtgggtgcttcctgtctgagaccatttggctggggacaaagctcagccaaagctttgttctatctgtattagaataaccaggtctattctgagattctcttcaaagttacctatcagagttcactctcttatttggaagagataatataccctttgagctctgattatttaattcactgaagtcttcactctaaagagccaatcctgatgttctctcttcattttgctcatttctccctagcagccatgtttaccactcactcatgagaagaagaagaaaataaggaaaccccctcagcttgcctctgcagatttgggggtataaaggaaaattctcaggattttgctgactttgcggtacagtttcaagggctgattagaaactagtgttttgcttacttctgctctctgctgtttcactgtttcttttttttttttgattgccaatatttgaagtttattgcctagattatctctctttccttgtttggttgttgttattgtagattttgactcttttctctccctgcactcaccctttttttttttcttcccatcttactcctgaagtccaggcctaggggttttttgcattgctgcaattaaaccatatctctattattttgatcttcagcacgtgtgagggatcagaagaaggatagagtctgattcccaggctcttctaatatttagacttttataaaataactaatcagcactggtattgtctttttccctctcccactctgtctcccccactcctcccttagcttcttacttctctctctggatgagctgcttctagtgaagaaagagttcactgttcagaggtgggaagccagaagataaaaccaaatggctgggcagtctttaggttattcctagctaagagttaagagttgtaagctctctcattctttgttcttcagccttaaactatctttccttctattaactttatttgtctcagttacaatgatagaggtaacttcacatactaaaagaaattaggttaccatgtgaaacattcttcttggcttgtgctaatgttatcagatccaaacagcatctgaaagaaaattttccaagtagatgttgttctcttgttttctgaaatacatatcatatgttaaagtgagagtttttatacatgttgaaagaagttgaatgacataacaaatagttactgaggcctccattttcttacttcacagttaaaattcctgtttctctttgggtataggaggtagaaagaagtgggagagtaatagcattttaaaacacagaatcaaaaatacatattaaaagtagaacttaggcccaggcacagtgactcacgcctgtagtcccagcaccatgggaggctgaggcaagtggatcgctcgagcccaggaattcgagaccagcctgggcaactaggtgaaaccctgtctctacaaaaaatacaaaagttagccaggcatggtggggtgtgcctgtartcccagctactttgggggatgaggtgggaggatctcttaggcctgggaggtggagattgcagtgagccgagatcacgccatggcactccagtctaggtgaaagattgagaccccatctcaaaaaaaaacaaaaaagaaaaaagtagaatttaggtattcctacttttacagtcaaaagtccactggtgtttgcataacaatgatgttttgactagttattggactaaaagtaggacacatgaagcaggtgactaggaatttggaaatattattgcttaggtcattactggaccttacgaagagattgttgcactggtgacttggactttgctggtccctccccgactcttcacagctggcttgacgactcttgtgacattctgaggttttatgctaaaccacaggacatgctgctgatttgcagagctgacctcagctgtaagcactttgtcttctgcagcgtagaaatgtagtgacctacaagtgtcccatgcccaagttgggtgcattattttktggtgayggtcacatgtttcataaagacttcctgagtcaaaaaatgacttttctcagttcatcttccatataactcctggccacagggattttgtatccaatggtatttttgttctatgtgtggatattattttagcaaagttcagtggtcactttctctgattccatcttgtattaagctacactaaatatgaaaacgtagaaagttttacttcttatcaacagatgctaatgtatgacattgagtgaaacactttaattcctcaagggctcagttttctcacctgtaaattgaaaaaacctttcaaagattgtatgaatcttcagagatggtaagtctaagaagttgtccaactagtttagtattgtggctttttgtttgttttggaatgattcattctcatatattattttttaaaaaaatagccaggtggctatgacatgcctgtgttggtcaaggtttactgagagtcaagtcaggcattaagaaatgtgaaggccaggtgcagtggctcacacctgtaatcccagctctttgggaggctgaggtgggcagatcacttgaggccaggagcttgagaccagcctggccaacatggtgaaaccccgtctctgctaaaaatacaaaaattaggtgggcatggtggtgggcgcctgtaatccgagctactcgggtaactatggcaggagaatcgcttgaaccaggaggcaaaggctgcagtgagccgagatcatgccatggcactccagcctgggcaacagagtgagactctgtctcaaaaaaaaaaaaaaaatggattgagggtttgttaggtgtcagccactatgtcaggtgctaggaatttgtcatgaacagactggtccctactttcatgaatttatagtccagtgagggaaataagatgaataaaaagacccctacgtctttttgtttgaactctggtaaagaaatgtgtttatcagaggggctaggccaaactttaggaaaacatttcacttcacttaaaaaaaattaggatttttgttttatttcagataaggcaacaaacttccatcaagtagaaacttctgcttttctctgtctttcaaacttgtcaaaatcagcagtttactttgttaaatctgaatgtctctttttagtgtattgcacagtttactagaattgtaatcacaatttcacattctttaacaggtattgaaaatttaaattaaaattctgatatttttgaatggcataaaatgccctatcttatctgaaaattgaaaaattaatacagaaatgtaaatggattgtgaataggtgggatctggccaagtgtgcatttgtctaggcagtgctgagtttctgctcattatttagtagctttcattcttcacctgagccaaaattaggcttagccaataaagccaaattttccttctggaagacatggcagtgtctgccttgcagcatgcatccaagaccttatctgtttctgtatcaaacattgtcaagatcagggcatgaagagccrgggcattcctgactcccccaacagatggcatctcttctttattataggtgacttctgggggaacagaaagcatactgatggcctgcaaagcatatcgggatctggcctttgagaaggggatcaaaactccagaaatgtatgtatgtgtggctgttttgtccccttttggatttgtctgtctggagtacagctttatgaaactaaagcagataatccattttcctgctgcttctcttcctctggtaattctggtcccctttccccctgtcctagcccctctgcccttatccttttacattcagtaaaattctaaatggatcagccagttatttttaaagatcattcccatcccgccccacccccagatcatgcatagtatatactacaagcaaaaataagatcctttttccaaaagtgagagtttgaggactacatctttgaatcctgtgatatttgcaaattatttggagcctaaagaaacctctctaggtactttagttctgcttaccttagaaagttacttaatattataggctgcctcagggtactctctgggaaaactttagtgtgagggctgttttctgggaggaagaataaaaatatctttttgagatttacccacattgccttccttggacataaatttgatgtttagttacattattttttcctagactgtccccttgtacagtatgtttatcctacatcttaatatttttactgcaagtattacttgacaatggggatttattgcatatggtctcatgctgtggttcatatgtagcataagagaataaaccaggctgccattctttcttcatatgtcgatctttggtgcttggtacttcctcagtagtagagatttttctccttagagggaacagattcgttgtatgaatggagtagttgaggaaagtctaaagcaaatacccgtgacctcattttctctttcaacactatttgaaatactatttccaaatgtgtaggagaaatggggattttagtttcttcaggtttgttgtctttcagagttggaaggggccactgagctgatgcttggccgctgtgtgaacatttctgcttgaacatgtgttgtgccgggaagccttcttctcattctcactgaggtgcctgtctttggtaggcaaccgttagccagctctgccttgtgttgctctcatccaaagtctctgtcccccarctttccgcctgccagcctagctttatgctttggatccctcactgtgggatcacttctgagtcctcttcctattgccagaatgatttcctaaataggagggaagtttctgcagaaaatcagttggcctctttttgggtgtgcttaaaaagaaaagtagagcagtctaaacacttaaatttttaatttggggaaaaataatcagaacttactcccggtaatttagattagctgctaatggtgttttctattattttggcctgagttacattattctcctcttccctgtcatttagtgtggctccccaaagtgcycatgctgcatttaacaaagcagccagttactttgggatgaagattgtgcgggtcccattgacgaagatgatggaggtggatgtgcgggtgagtccctctggagggcccactgtctrtgctgggccctgacagcagaagggccctcctgttgactagccgtttccagtcagatgggtctgactgcctttgattgtggcagccagaatatgaaaaactgcattgatagtggtgattgactgcagcttcagtcttttcataggttcatgaattctgaaagggaggtgatctagtcactaacttgggacttgagagacactggttttgcggtcagcgccatcactttttctttcttttctctatttgtaaaatgaacatggactcacttcccctaagactcttaccatggcccgggcatggtggctcacatctgtaatcccagcactttgggaagccgaggagggaggattacttgaacccttgagcccaggagtttgcgaccagtctgagcaacatagtgagaccccatctctacacaaaatttaaaaaagtagctggacatggtggcatgcacctgtagtcctagctactcgggaggctggggtgggaggatcacttgagccccaggaggttgatgctgcagtgagctgtgttcacaccactgtactccagcttgggtgacagagcaagaccctgtctcaaaaaaaaaaaaaagactctcactgtggtttagattggcttaaattaataccattgtcattatgatagtgattatttttatgcctcacatttgtgtagaggagttttctagtttcagtgttctgtcagaatcccatttgagctttatgacattccagagaggttgatgaagctgttatattattgtagttcacagataaggaacagactgaagtagcatactcagggtttcactgctggtacgttgtggggctggggctcacatttggctctttggcctcttagctcaatattattttcgcccccacagcgattctgttcttattttgtgctctcagactattctccaaatggacttacctggagtcacctgtgtcctgtcaccgtggtgggatgcagtcttctcccagttggagtggtgaaggagggggtactggtggaactggaactctaagctagcagcccaaattgctcttggcagcagaagagaagagtaattgtgacatagattctcattttcctttaaactttaaatccctaggcaatgagaagagctatctccaggaacactgccatgctcgtctgttctaccccacagtttcctcatggtgtaatagatcctgtccctgaagtggccaaggtatatgagagaaatgggctgctaaggcaggcaaatggatattttaaaacaaagcctaatggggcagtacttggcaaatagaagcgattttttttttgtttttgaccacagtagtgataagtagctctcatcagccctaggggaagccctgcagctcagttgcaagcctttaaaagttgctagtctctgctgtgggggaagatagtacaaggctgaggccttttaaactggaaattctgaaataggattgccttctagattgagatctggaaataatctgcatgtaggaatgtgcccaccaaaagggtgatattccacatgctgcccctcagcrcctccctttccctcacgcctcatcctgcagtgactgaggcaggacctttcccttgtgcgagaggcagcctaaatcagagctctactcatttcctgcttgataccgcagagcgtttgaggtcatgcatatttaaatataaaattgataccatatttcagatgaattattttgaagggaaaatacatttgaaagataaattttgttgggaatgttaaaaatagccattttttaaaaacatgggaggcataatacaaaatagccttgtgtttatagcccatctttccacccatgtcttgcagtttttattatagggctataaaggaaattctcttatgttctttgttttttggaacaagctggctgtcaaatacaaaataccccttcatgtygacgcttgtctgggaggcttcctcatcgtctttatggagaaagcaggatacccactggagcacccatttgatttccgggtgaaaggtgtaaccagcatttcagctgacacccataaggtgagctaaggaggagatcaagtgttaccagttgattattttgactattattgataaaataaattggtagcttcccygcaaagtataaaattaactayagaattctcatcagatgcttgttttaaactctctctttgccgtcaccagatcagctggttcaggtgatggggtatagtggtagaggtgacaagcagtagtgaaaatgaacctgttacctttatctcaaattggctaagagaatttctgtatccactgactgtgtgtaactagaacatgctagtgtagtggcccttgttaaaaaagctccctgaagccttgagctgatttgaggtggagggtagaggagtgtgagggttggtagtggagttcccatgctggtagataacattagagctgctgtgcaactgggctcctgagcgtacatgacgggaaaatgttgacggaagagtcctttggaaaatgggaagaacctgtgtgctcaggaacattcagcatttgagatggccacgcctgccacccttggtggactgagacaaagtctagatcagttgataacgctattgaatatacatccagatgtggaagaagtattagcagcctcaggaatgtgtaccttgttttgattgcattttcagagcttgttttaaactcaagtatatkaaagacttgtttttcaaaatcggtgtgatctgcagccgattttcagtcagcatctgttttttccttaccatccagatagctcctgtgtccttttcccataaccatccatttctggatggttcaggtaatgaaattagttccacgttagttttaataagagttaattagggggtcagatgttctataaggaaaccagttacatagttaattttaaagctggattaagtagcttttagtttctgagcaccattatgttctcataagcataatattcttagtaatactaagcaaaaaaagatgggaagggggtcagatggtgattttaacttgaagtgacaaattccatcctttcctggcttccattgcaaacttacccttgctttcatcctgacatatggtctccagagaaatattttaaataaggtaaaccacatgctgggcaagagagggagtaaaccgattaactgggcgctgttcttccctgggtctcagattcctcattcctaacagagagaatttaaactccatcccttaagttcctactatcctttagcattttaagtttgaatccttaatgtgagtgggaaacataacagagaaactgagaaataaataggatttcctttgcatgatgagagttctgggacaaggtctgccagacagaactatactctcacttttcttgtctgctacttcttccacagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagagtatgtgtggaagactggggttctgccttgtctattgcttttttgtcctagtaggctcaaggcacctgcctggctaagtatccatagccctagcccacctgttgtctcctgcgatatagagggcttagggcagcagcttagggcttaggccagaccagctggcctgggagaagaagctccctttctctgccctgacttttggagggtctttgagacgggggcctcatttgtagtttatctcatctctatggatgtcttaataactggcagctcttaccctaaggctaatgtacaatttaatggttaggacagtgattcccaaacttgagcatgcattctaatcacctgaaggacttgttaaaacacaggtagctgggcccacccctagagtttctgattcagtggaactgggatgggctctaaaaatttccatttctggagatactgatgctactgctccaggaatcatacttgaagaatcattggaataagaaaataattggaaatgggccagaaggaatgaggaaaggagggcaatgaaatcttgggttaagccaaggccagaacaggctgcatgctttgtctaatgtatctgttaacatcttatctgcccatctctctatgtgtcacttggattggggaggctctttaagtatattgagggggaaggaaagctgcctgcaggcatttctcatttgagaaagatccttggccaggcacggtggctccggcctgtaatcccagcactttgggaggccaaggcaaaaggatcgcttcagctcaggaattaaagaccaaccggagcaacatagtgagacattatctctacaacaaatttaaaaattagccatgaggcygggcgcggtgactcatccctgtaatcccagcactttgggaggctgaggcgggtggatcacctgaggtccagagttcaagaccagcctgaccaacagggagaaccccgtytctactaaaaatacaaaattagccgggygtggtggcgcatgcctgtaatcccagctactcaggaggctgaggcaggagaattgcttgaacccgggaggcagaggttgcggtgagttgagatggcaccattgcactcaagcctgggcaacaagaacgaaactccatctcaaaaataaaaaataaataaaaataaaaattagccacatgtggtggtgtgcacctttggtcccagctacacaggaggcttaaggcaagaggactgcttgaacagcccaggaatttgaggttacagtgagctatgatcacaccactgcactctagcctgggtgacagagcaagaccctgtctcaaataaataagcaaacaaataaataaaaattagatatatataaaaggtcctcctatagctctgatagggccatttattaagacctgctataccatttcttgstttagggattacatatgactttttagaactgtggagatgggcagattacttttccagaaatttttttagtacatctttcatgcctcagaagcayctaggggaatataattgggagttgggtagacaggttcgaagtcagtgattgagtcattagatctagatggggtttgggccttggaattccatttttattgttccatctatgattctgatctcagtaagaaccactgatccagtgtagccctcttcttttttgaagatgagaagactaaagcccaaagggttagattgcattcattataaggaagactttgaatgattaaagagatagtgaccaggggattgtatgtgactgaatttactttttcttccttcatttatttttttgttttaagactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccaggtaagcttgaagaagcctctttcccttattttgctccatgattttggaagaacttgggtggtacagtaacctgaagtatagagtttgactgctagaggctagcacgttagtagcaactgtagtatataaaggatttctctcttgccacctggaattattagatacaaagaacaagaccattagctttaaactctggcagaattaggtgacagcctcctagaccagtggttggtcatgaggtktttctctcagtctctagcctttctactctccaatccatcttgtacacagccatcaaattgctcttataaaatacttgttacctggctaatatttagttcaagaycttcctgggggtctctaatcattcaggcctgctactgccttctttattagacttttctaacctaatcttccatgatgcctttgagtaaatgcaccactccaactgagtacaggtctgttcatgtcctctgtgtacagcttagccttccacacgttggtgcattgccagtcccatctggactatctttttccctcttcacaattccagtaaaccccactaaattcctccagggcgaggtagaatttcttctgtgccctgaagtcctttaagaccccagccatgtggccctgtccccatgagagcacatgggggctgattatctaagataaaagtgtctcattgatggtgacgtggttgaaggaatggtggtggaatttgtgaggggatgggtgggacaaagcagccaacactgttcatcctcttagcatggttctcagtcatgccgagaagctctgaggccagcccatgcctgacaccccaagcatgagagagccgagattcccaggactaggaacaacttggatgactacacttgtcagaaatattgtgaaagggcaaccaggaaattcccgtatttggggctgcatcattttagaacattttttctttcttcaaggttcatctctctctgtctcttctttcctagtattcatttctgcatcacattactacacgcccggaaacgagtagctatacaattcctaaaggacattcgagaatctgtcactcaaatcatgaagaatcctaaagcgaagaccacaggaatggtagggacacttggagttttttttcttctctkggaaatttaggtgttggtggagagtttgaaggaatcatatgacccggagtctgttcctgcctctgcccctttgccacagacatcttttatttgttgactggagctgatgatctctgcatcacccaccccttagggttgctgaagtctcaaatgagatacactataaagtaccttgtaagttagagacttctgtataaaagcagctggtggtagtgtccatttgaaaagaaaattttgtcacaggaaagatagtaaacatgttttttctggaattttcttaggctagtccctttatgcagaaaggcagactggaaagtccctgtgaaaaattgactatgccagctgtttttctgatagaatgatgggatgccttaggtggaaatggggtagggcagtgcacatgcgaagctaggactcggggagaaggggctcattgctgcagttttattcttgcttttggacctggcctcactaataatgtctctttctttggatttgtagggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctcttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacrccattcagggctggtgtggcatttatgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactgtggcttgccagctgccaagatggagaagcatgtgcccctgtagagcgtctccccagaaccagaccccgagccactcgcttcctctgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtygcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcartgctcccttcctaatttcagcaataatctcaaaaagcaattaaatagttaaatgaccctaattgtaattactgtggatggttgcattcatttgattacttgggcacacacgagatgacaaatggggcagtggccatgcttgaatgggctcctggtgagagattgccccctggtggtgaaacaatcgtgtgtgcccactgataccaagaccaatgaaagagacacagttaagcagcaatccatctcatttccaggcacttcaataggtcgctgattggtccttgcaccagcagtggtagtcgtacctatttcagagaggtctgaaattcaggttcttagtttgccagggacaggccctatcttatatttttttccatcttcatcatccacttctgcttacagtttgctgcttacaataacttaatgatggattgagttatctgggtggtctctagccatctgggcagtgtggttctgtctaaccaaagggcattggcctcaaaccctgcatttggtttaggggctaacagagctcctcagataatcttcacacacatgtaactgctggagatcttattctattatgaataagaaacgagaagtttttccaaagtgttagtcaggatctgaaggctgtcattcagataacccagcttttccttttggcttttagcccattcagactttgccagagtcaagccaaggattgcttttttgctacagttttctgccaaatggcctagttcctgagtacctggaaaccagagagaaagaggatccaggatgtacttggatgaggaggcctggcttatctaggaagtcgtgtctggggtgcttattgctgctccatacagctgtacgtcagccccttggccttctctgtaggttcttggcagcaatgagcagctttcactcagtgacacaagtaattactgagtcctaatttgatagccaccaactgtacctgggtaggcaaagtcagatttttgagaacctttttcctgatttgaagttttaattaccttattttcttttatgctttcctctgtcttgtaatcttttctcttcttaatatccttccctataatttcaattatttggattaattttagaataaacctatttatttctaaaaaaaaaaagaaaagaaagtgttacctgtgtctttgtctcacatgaatgtgcttcatacaactgtagtgctgccaaggttggctttattttttggagacaaggtttcactgtcacccaggctagagggcaatggcatgatcatcactcactgtagccttgacttcctgggctcaagtgatcctcccacctcagcctcccgagtagctgggaccacaggtgtgtgccaccatgcctggctaatttttctgtatattctgtagagacagagtttctctacattgcccagcctagtctctaactcctgagctcaaatgatcctcccgccttggcctcccaaagtgttggaaatacaggcatgagctgtccctgcatcgggtgaacatttttcaacccttgacccatgaaaataagcagaggcaggaatgtaacataacagcatagtccatacctccgcatctggcgtcttctgtccttcagtcctccagtcatcagatcaaagcacacttggaaaattttaagtcagaagtggagcagatgggagaccactgtctgaatctcgtttgccatcaatataggtattgataatcctttactagcatatatgctaggaacggggtcctgctaatccctcttgtgaacaatacgcttatttctcaacctccagcctctgcccctttcctggcctttgctgggggaccaactcattcagactgagttgtgacatggctagattcctgttccaagtgaccccggcatttacaagtcagcttagtacttgagttaggagacacaggtgagaactattaggaagaaggcttcccagtctctgcatagtgacatatgtgaggtaaaatttgtgtggcattctcgtgggggtagagatgaggctgctcttagtgcccccttcttcatgacagcgtgggaatattctgtcctagagagttcctggctggggaactgactgtgcaaaccatctcttaactgctccagtaataaatagcctgccaggtcctaagctgcctgtgtcttctctcttgtggagtaaaccaggcaagccctaagaactttgctaagattttaagaaactgaagagaccatcaggatttgggatctgccatatctgatatgataggcctgtgtattatgattctccagagaaacagaaccaatacacacaaagagatttcttataaggaattggctcatgtgattatggaggctgacaagtcccaagatctgtagttggcaagctggagaaccaggaaagcagatggtattgttgcacaccggaggcttgtagccttgagacctaaggagagtggatgtttcagtttaagtccgaaagcaggaaaagaccaatgtcccacctcaaggcagtcaggcaggaggacttcccttttatttggaagagggtcagccctttttagccctttttttctgtacaggccttcacctggttgaatgaggccacccatgttagggaagacagtcggctttactcagtctactgattcaaatgttatcctcattcagaaacaccctcacagacacacccggaatgtttgaccaaatgcctgggcaccccatggcccaatcaagttgacacctaacattagccatcacagccaggaagaaaatataggttgagtatcccttatctgaaaggtgtgagaccagaagtgtttcagattttggattttggaatatttgcattatactgacaagttgagcatctctaatctgaaaatcagaaatctaaaatgatccaatgagtatttcctttgggcatcatgttggcattcaaaaagtttcagattttggatttccaattttcaaattagggatgttcaacctgtaatatggccccagactgcctttctagacataggttccacaatgcatataatacctgtgcccttcacacccttatctgtgttcatggtgttctctcagccatctctgcctcccaagaatcctacccaggtcttcaaggcataactcaaagcctccagatttgcccttttcaccattaatcacttgcgttccctttagctcatttcttatcctgccacctagcattaattcactctagtaatagttaattagtactagttaattggtaattggtaatagttaattgtgttcctgtttgatgataatcaaatggtatcccctagatgataatgaatctgaaggcaaggtggtctggtccctgtcattttccagtaccttgaacagaggaagtgcctagcacagaggaagtgctttcatttaaatgcctattgactccaatttggattgacctgtggaaaagaagtttctagagcctgagaccaagtgatataatagttttatttgagacataaaaacacatgtgtttctattacatagtgtggggtttagggtcctggtttctaagacaagactttatttcaccctgtatcacagcttcctgggaaatgaattagggagcaagagacggcctggcaagaaaatcattattgttgctgggaagttgcaaagaaaggggagagtttattcaaattagtgtaacagagcccccaggatgaagagagtggtgcagggaaaaggtctaaattcctggtgttggtggggacactggcacatcccacagcaaggactcagccctcaacggcggcggctgggtcttgggaggggagtggtgggagggtaagggctcctcagctccctccctggactcccagttcagtcaccccttcccccggaagaattcaaagaggaagggcagggtctatgtcatggacactgctacttgttcgatgaagctggccaggtttatgtcccgttctgaaaggccggcacactcatgggtgctcagcgtgatgtggacctgaaatgaaaccagaaattctgcttccactgacttcacttaagaacaggagggagtcactagctgctgggctcagccctgctaggagctccagaatagcagctggccagtacgatctctcctggggactccttcctgacatgtctgtaacaacatcttctacatctcccctttgctgtctctcaaaaataatcatgacttcagctatagaataaaagcttaatatctgaatgtcaagagcaacctaaaagctaaagacaaaaccaaaaaccaatgccaactcctaaacactatccattcatagacgacctcttccacccttactgtttttataaacagagaccagcagagcttttggcacatggtagacatttaatgactgtttctattcattaagcaaataatttgataggttggctatgtgtctgtatttttttttttttttttttttgagacggagtcttgctctgtctcccaggctggagtgcagtggctcaatctctgctcactgcaagctccgcctcccgggttcccaccattctcctgcctcagcctccccagtagctgggactacaggcgtccaccaccgcgcccgcctaatttttttgtgtttttagtagagacagggtttcaccatgttagccaggagggtcttgatctcctgacctcgtgatctgcccacctcggcctcccaaatatgtgtgtattcttagttcaagtttattactttttcattcttccatacctccagcaagattaaagccatttagagctatgaacactgaataagtatgcctgattcccacagcctttcctttcttgggttttgccttcttaatgtctacttaaatgtctactttaaccacaactatctcatgcatcttttaatttgcatttctttatagtaagactgatttttttttcccaggggtatttatgttgattctaggcatgtgcaatctcagtgagattggaaatgagatgagtggatgacctatgggtcaggaaggctcattgttaagtccaaaagccttcagaatgtgtcagagttcgcagtatttggatgggggcagagcacaacagaggcacacagcatcactcaccttgttgtacacgttaaaccattcaggatggtggtccagtttctcagcctgcagggccactcttgtcatgaacccaaaggcctatttaagtggagtgagagccaggttagtgttctaagagaaaggacttctggacatcaccaattcaaggcctagacgcaggaggatgaattagcttccccccaggagactcctctataatcatttcccccttgacatcctgtcactggttctcaggcttgagttagagattgtccttgcagtaggaagaaagtcttgctatttaggatgccaacaaggtggaaacaccacaacaggcttttggcctggccagtcttggccgtctgttcaaatgtcttcagatgtgcatggtttccacttgaactatctcctcagaagactgctgctaaaagttccaggaagggagagcccaagacacatcctcctatggctctccaatccccaaagatgatactttctgagttagacaggaaaattaatttccccactggcacagtgcccaaataactggatgagtgtggtgtctgagagtcttggctaacaagacgtgaagggagagaacatgctttgtaaggtgaccccatcagcccgtctcagaaaactctgtcccaccctggtgccataccctgttgaagtctttgaaatgaaactgcttgaagatggcatcacggccttccagctcattccaccccacagccctcaggtttggcagcagctggtccctctcctcagcgctcagcctgtgtgctttgccagcctagaagagggaaaaaaacagaggcccaagggcatttctctttataggtcaaaacagaggggctccaacctttaggggaacttagcttccactggctgctttggacgtgggtgaccaaagggcagcaggtctttgagcaataggctgggaggcctcaagggtggcaccctgcccaggaggtggggtccaggctcgtctgccgataggccctcaggtcttgggttttaacactccacacacacacaagggaaatcacaaaagcaatgtaattcatatgacggggacagagaagcactcttcccccaccctgccctcaaagccttacggaccttccctccatgagattattacatcagtgagggcgtaaaagcaaaataaatcccagatgcaaatatgttactccacaacctctcaggaagagtacccatgactctccccccttccttttcctattatgtacttcatcatatgcaccccacgtccctaccgtaactttcacgtgtattgaagaggaaacaggcctagagaggggaaacgacttgtctgctgttctttcccgcccacccctagccagtgatggcgcagtgttgtctgtgtgtcagcattgctggggctggacgaaggagctacatttaaaataagtgtccatcccattcttagccacactgcagctgaccgccgttggcactacctctagtaggtcctcagtcatgctcccaggcagcctctggtcctgagccgccagggctaggtttctctggttttccgtctgcttttctggctggttgggaagctcaggccaaagtggaaggaacttggccaaaggcagctggcaaacctagtgccccatcctatttacctaatgtgcgaagtgccctcaaggcagcccaaattggcacaattcaggccatgagtggaacctcagagaaagcaaggaagcaagggtcagtttcatcctaggaggatccaggtctaggagcttaacagatcccagaacctaggcttctagagtagcaccaccccagggcagaaatagagtgctgaattgaaaagatacccttaggggtggggagggaatgtgagggaggttgatttagcttttatgaggcagcctgcagactggacaccatgtgttgattggcaggagttttgagacccgctttcaccatttaccagccaggtggctgtacctctcttggcagaacctccacctccacagatcatcatgaggtgccaatgggacac

SEQ ID NO: 1710 - DNA, 12607 bp, Homo sapiens
gaattgaattaagaaaagaatttccatgagagatatgcatttacaattttgtagatttaatctttgcatagacttttttgttgcagatactgaaaaggaatccataaaaatacatagatccctttactagccacttttaatttacggatgaggaatattcagttcacagactggctagcgctttttagctttctttagcgtttgaagcagggcttctaagtcacatgaaagactagactagttattggcatttaaattttttggctcctacttgtatgtattatttattaaacaagtagttattgcactacctttatgtatgcagcactgttttagacaaaatagaattgtgacatattccttgctcatggtcttgtttcaaagacaatacctacaactgaaagaattaaataatagagccaggcaatatctgattgaggaaaagcatgcagtaaaagttcagagaagaagatacacgtgcagaactggaatggtcagtagttgcttcatgagatggttgcactgagctgaacccttaagtaaggatgtggatacatgagaaggaagaagctggaaattttaaacatgaggagcttcatggggaaagaatttcaagctatcaaaagatatcaaagattgaggaatttggacttggtctgggaggtattggggatcttgaagatttgggggtagggaagtgatatgacaaaagctgtgtttggaaggcacaagtgaaacagagttgggtttttttgtttgtttgtttgtttgtttttttcagacagggtctcactctgttgctcaggctggagtgcagtggtaccatcttggctcactgcaacctcaacctcccaggctggagtgatcctcccacctcagcctcccaattagctgggactataggcatacaacaccatgcctagctaatttttgtatttttttttaatagaggtggaatctcgctatgttggccagcctggtcttgaactcctgagctcaagccatcctcccacctcagcctcccaaagtgttgagattatgggcgtgagccactgtgcccagctaaaagagagattttgatagcttatatgatttgatgactgaataaaaaataaagaggatgaaaaaagtgaaaaatgaatttttggctgataaatagagaaatggaggtattaaaagaaattgggaagagagactctgtttcaggaggaagagggattagcttgatttttggatttgatgaagatgtgaagttaggtgaccagacctcgattcagattttagaatcagactctttgatttggtgtcattaacattgattgaagaatgttttgaaagctgaggtattaagaaacaacacaaaggtggagtttaaaagaggaagttgagcgtttggagagagtgccatgccaaaggaggggacttttaagaaaaggaagacaacacttagtacttctgtgtacccagccttgtaggaataactttacctgtgtaatcttattttattctcacagtaccatgtaaagtatgaattatcattgtccctatttgacaggtgaattaagtgaagtttattgtggttaaataacttgcctgaatgtcgtgctgctggtgcaaggttaatctggatttaaactgagatctgtctgtctaacccccaagcccacatatttttttaattgaaatgctgcaaaatggtaatgaaaggtcaagaagaataaaaaaaaaaagagtaaggccattagaatgttcaaggagaagatcattgtttaagattataaaagcgtagtggtaggaatatttcagcatttagaaggtaatagtaaattaatggaggaagtgaccctagaccattgctaatttgggcagcgagtaggacagttctcttctgaggcagctgagtcaagtacagcagagaagagtgctcatcagtggagaaggtgggaatagtgttggagaggtctcagaataaacattaagtaatcccagcactttgagaggctaaagcgtgtgaatcacctgaagtcaggagttcaagagcagcctggccaacatggtgaaatcccgtttccactaaaaatacaaaaattagccacgtgtgttggcactcacctgtaatccccgttacttgggaggctgaggcaggaaaatctcttgaacccaggaggtggaggttgtagtgaaccgagatcgtgccactgcactccaggctgggcaacagagcaagactctgtctcaaaagaaaaaaaaaagaatagacattaaaaagacacagacgatgtgagaaaaaagactgttcccaccaagtttagaagaaaggataatgaggttgatgtgcctgctgtgccggggggataagagaaaggtgtcaggcaagaatagatgtataaaagcactagttacaactatactttgaaagtcatattttacctggaagaaatctcaaaaaacaaagactacatggcagttaagtgacccaaatcaagtcactttccctcttcaggcctcagttttcccatatgttagacaggttaaattaggtgagacaaactgatcttttaggaccattctataatactgtgcttaactttctaagcattctggaatggagcagccttgatcttttcacagatacgtcaaccatatagctttatttataaaacgaacatgttgagataactaaaattagagttaatatcttcataggtacaaagaaacttttagaacttaagtccacaagtcagaatttctggatgaattcctttttcctcttattaaaaattgttaagatgtctgattagactagttgtaaattcccttgaaagcaaggatgatatcctgctctctactgtgtcctcagcatcaaggacagtgcctaacacagaacaactaccaatgaatatttatgaaatgaatgaaagtttgaattgcaaaattaaatgccaccaataaagaggctttgtgagcgagcgtggtggctcaagcctgtaattccagcactttgggaggctgaggcgggcggatcacttgagctcaggaggtcaagaccagcctggccaatatggtgagaccccgtctctactaaaaatacaaaacattgtctgggcgcagtggctcacacctgtaatcccaacactgggaggctgaggtgggcagatcgcctgaggtcaggagttcaagaccagcctggccaacatggtaaaaccccgtctctactaaagatacaaaaattagccaggtgtggtggcaggcacctataatcctagctacttgggaggctgaggcaggagaatcacttcaacccaagaggcggaggttgcagtgagccaagatcacgccgttgcactctagcctgggcgacaagagcgagactttgtctctaaataaataaataaataaaagtataaaaaacgagccagtgtcgtggtgtgcacctgtagtcccagatactcgggaggctgaggcaggagaatcgcttgaacccaggaggtggaggttgcagtgagccgagattgcaccactgcactccagcctgggggacagagcaagactctgtctcaaaaaaaaataaataaataaataaaggcttagtatagaactcttcccagtcttttttctccactttgattttttttttttttctcaatctcttccatgacaattcagggacacattaattgtgcaaaaggcagtcacttgtctgtattgtctatttttatatcacttaaattggtttttcatttggttgctatgttgacattttatgaaaagggaactaaacttgtgaattgactgacagtggaaatcataggattttcaaaaataagttttgtagttacttaaaaattagtattccagttttcggtcgttcattagtttaaatgttaccaataatattttctttataaaaagaaattatgttttatattgtagaggaaaaatgatttagaaaaacagaaatctatttctgaacaaatttagtgatgctgatgtaagaaaaagaaaaccacaagaagtcatcccaaatttagtaatgcttcctatcttaaacacatgatttcacttgtcttctggctagctaaaggttacaaaatgtcaccataataccttttacttccttatgagttcttgctactccaccccctacccccaaatatggtagatcgagttgtaaaaaccctgaagtatgacaatatagtttattgcacttatagttagaattattctgccaagatgagctgagaaatggaggaaatggatttaaatttacagcagtccagtgatacacaatatgcgttttccagaccactgaaacagcaagccaacttttaactttaatacttcatacagtggaaaagttacagctgtaataaaatcaacagatacatctctggttaatgttctcaaatgagaaaattgactgcaagaacatttgtccaaatacatgtttttatatattttatgctactttccagaatattaacagttttacatagcgctgttttggaagtcactcattgttttcatctttctgattaagaaatagggccaaagttgtacattgcactagtagtagacttttaaagatgtctttgtctctttttcagtactaagcttcaagttcatagattatccttgatctttcctttccctaggtagagatttagagtatttgtttatgtgagatatatataaaaaaaaaggagattttaacaaatgactgtttgattcttgggtagaaactaatactgatcaagaccaaccaagtattcagacaagatcgggcgtgttcagggtggtacggccatagacgacaaccaagtattcaaacattgagtgttcagtggaggctgtacagatatcctgggttttgattcaagatagtgagatagccatcctatgagaatgtgaacttgaaataagattttgattacttttttttcctcctttaaaggtttgttcaattttaactattttttttcaaaatctgcattatcacagtatattttaaaagaatgactaatttactgtgatatatttgggagttaccttgaaagagattatcttgtaatttaaaataccagaggtagagtgaagagtcaggtggtaaaagagaaggagactggatgtttgtacccggtttgcttcttcccctttgttctgctgctggttttattttagctgttctgtttgcctcaccgcaggcagcgtcaccactccggttccaatcttctggacgtagagttttcaaaccatctataaattagcagtctaagtggaactttggcaaatgaggttgccaacaagcattttctttatatttagataatttgagctcatggcctctgggcatttggtaagaagtccagtaaagagaagcctaaagaacagaatctttattatgagtagtcgcctttttccactcagcagtttgattccaagcaccctgagaaaaactagagacatagtctagttggcaggttttttgaagagaatgagaagcccaaaccaaaagataatgaagaccacagcagagaactaccgaggcagctggcgcagatgcttttttggcactgttgagaaaggcttcagacccacagtctgaagagatggagaacccctcctccaggagcaaggaataagaatgacaattgttctgtaggacagttgacttagattcaggaaagttcttcagaaaatatattcagatcacaaaaaaggtgttaaaatcccaggatttttcagccaaggatggcacttgcttctttcagcatcactcatcaagttgaaatttatgagtgtcctttgttatcacaaacaaagcaagcaaactgaacaaatgagaatgcttctttagtatytacatagcactttaaaagctctgttttctttacaaaatgtgtgtatggaaaggtaaaatgggaataaatagtattaaattctgttcttagaacctactgtatagtgattgaacagctaaacagaacgaaaaagcatgcacatcttacagatacagagatcatgactttggtagatgagactaacatgtatgaaggtgtaggaagaakgtttatttttcagtccaaggaagcaattcacaatcaactgttagagaagcagcaaatagcgaagaaaaaattaaagaactagaacagaaaaagtcctacctggagcggrgcgttaaggaagctgagaacaacatccgggagatgctgatggcacgaagggcccagtagggagcctctctgggaagctcttcctcctgcccctctcattcctggtgggggcagaggagtctctgcagggaaacagcttctcctctgccctgatggatgctttatttggatggcctggcaacgtcacattttctgcatcaccctgagccccatttgcttcccagccctggagtttttaccctggctttgcctgccacctctgcccaggacactcttccctcttggggtgtgtgatgaactcccaggagaggaaagatgggagccagggcaagataggaagctctgcctgagctttccactaggcacrccagccagaccaataaaaagcatctgtcccactctgctaagcctgcttttcttgagcagagggtgagagaggcagtggccatctccacctcagctcctgctccctctgcatcagagcccttcctttcttgggggatgggctcttgccctcttctcttttcccttcctgtatctttgactaacgcctcagctttcaggcctacatgtagcagacagaagaggaagaaagaacagacgttcacagctgaatctcagtgaacagaatagcagtccctggatggcagtctgcctaaagattcctttccctgccttctcccatacattccaaaaggaagttcaacagtcagcagcacctccaagactgtctccttttggccaatatcataagatggacgccgtaatcctgaggcctcctagaggctgagggggcaatggtgtgctccagctggctcatcccagcccaggtgggccaattattcaattttcaagaattttgttgcaagccagttgttaaacacagccattataattatgtaaatttgcaaattatgttaaaaacaaggacaataaatactcaaaatgcaaaaaaaaaaaaaaaaacctactgcatagtgtaatagtgctctcacttttctctccttgattctgatgtcaatcactcattgtcacctccactagagggggataaaaaggataataggaaatcagaatattttgatttgtagttcaactgttgatcaattatctttgagacttttaacattcatgactaaggaggattaataattaacatgagctgtagaattaaggtttgtatggcatgataagtataaaccagttttgggaccgctataattctaaaaaagcaggtagactagatgattagttgtacacttattactgctaattcttgattgtagaacaaattttcctatgaaaaccatgttgtgtattttatatctctattagttcgttaaaagtttagcagttttagatgtcgaaccagtaaaaaacaagttgcccattctatcatttttttttattgtggtaaaatatatttaagataaaatttacgattttaaccatcttaagtgtacattggtacagtggcattggttacgttcacaatgttgtacaactgtcatccctatctatttccaaagctttttcatcacccaaacagctctatacccactaaacaacaactccacatcacccactccccagccctggttatctctgttctactttctgtctctatgaattcggatattccagttgtttcatataagtggactcatataatatttgtcctttttgtatggcttatttcatttagcacagtgtcttcaaggtgcatccatgttgtagcatgtatcagaatgccattcctttttatggctgagtaatattcccttgcatggatatataccacattgtgtttctccattcatctactgatggatacttgggttgtttttgccttttgctattgcagataatgcttcagtaaacattggtgttcaagtatctgttttagtccccacttttagttcttttgggtatatacccaggagtgaaatgctgggtcacatggtaattctgttttgctttttaagcaactgccaaactgcttttcacagctgctataccattctgcattcccactgcaatatatatgggttctaatatctctacattgctacaacacctttttttaaaaaaaaaaaaaaaaaaaaagctgtcctattaggtgtcaagtgttatctcattgtggttttgatttgcattttcctaatggctgctgatgttaagcatcttttcatgtgcttattggtcatttgtatgggttctttggagaaatgtgtattcaagacttttgtccatttttaaattgggttgtttgccttttgcctttctattcttctctcacttttaaattgattttctcccatatttctccacaaagtcaaaaagatgatttcatttgaacacagataaatgctgtcagccttccattgccatatacattgaattaaggtcaaatgctttttgtgctgttgctaaaatcacttgagaatctgtctctcttcaactgaaagaattgttctggatgcgttgatgctgtggaattccttgtactctctcccaaatctcatttaacaagctcacatttagggtgtgattcactgtgaagtattccagaaaataaaatccattttctcagaatgatgagaaattttacaccttgaagagaccatctcttttccaaactgagatccacagattcttggagatccacaaatatattcttgggctctgagagttttagaattttaaaataatctgtttttatatcaataatctaaaaggtcattagaaagcccacatttcacaatacaaggacattttcctggaatgagactgttttcttacattagtaagatggaagtgacttgcctaagataacacagcaagttaaaaccaacactaaaactcatctttggaagcttttctcagtgttctttgttactagtgtggagatcttgcaatgattctgtcttcattaagtctacaggtagtggggaaagcagaaaaagaacaagtattaactaaaatgatgagtgctgtaagggagagaaatggcagtatgagttgtgtagaatgagagcagttgcataggatgagttaagttactgtgagagtttgaggaggtggtttttatgccgatagttgaagagtgaattggagttaccttaagggggttgtgagaagaaccatgttacagatggaggaaatgagatgtgaaggctgtgatgtgggaaacagcttagtttactccctgatttaaatggagaaaaggaatccagtgaggcttcagagagaagcaagaactaggttattcagggtttaagacaatcaaaagtcaaaatagagtttaaacaggggagtgacataacctgatttgcatcatgctggctgtagtatgcagaattgattggagaggcaaggatggcagacaggacgccaggtgggaagctatggaaaggtgcatatggaagaagagagtgtctttggattccagttggtaagtggaagagactgaagcatgtggctgaatgtaaatgtttaataagtagaattaaaaggacatggcgattggtttgatggggatgtctgggccttcaattatgactccctgtttttggcaatgatcagctgggagattggtggcagcatttactaagacagggctcattgaaggaggaccagttttagggaatagaggatgaatggagtttttaacctgttgagtttcagttgcctgtgagatatttcaatggagttaccaaatagatatttctatgtagtgtcaaggttcagactagaggactgaggcagagatataaatttggtcttaatatatccatagtgcttgaaactatatgtgtggagatagttatatactaatggttgtcaaattaagcattttttccaattcctttcccagaatctagtcatgtgaaatgatgaggaactggaatgtacagtgtatacattgttcttggcaaaactaaatttaaatttctgcttaacctaatcaaccaaaaagccctttttatttctgcctgtgtaaaatctttcttcaacatattaagccatttttctgtcttggtaaatatgatagggtgaaataaaatttaaattgaatttagatagccctgaattgatgattcaagaacttttagaatcttagttttatttttgagtagcaaataacattatactgtagatataaaaaatgttgaagattatcccaggaagtgctctggaagctgcttttaaaaataaataacttttaaactgccttttctcccttagcatttgcccatttgttctaaaggtagaagaacaactttcagtgtgttaagggtttttaatagttaatcacagttatatggcatttgtttttgtttaatatgtggatttttatgtaatgccacccagaggcctaggtatatcagtacattcctcagcattattaatgtcatccaaatagattgtctttgattactgatcactgactccatatatagggcagtgatttcaaaattattctactaccattgcaagtagacatgtatacagtaaagaaccatccaaaggccaggagcagtgactcaggcctatagtcccagcactttgggagaccaaggtgggaggatcgtttgagcccaggagttcaagactagcctgggaaacatagtgagaccccatctctacaaaaaattttaaaaattggctgggcatggtgggatgcatacttgtagtcccagctacttgggaggctgagggaggatcgcttgagcccgggaggtccaggctccagtgagccatgttcacaccactgcactccaacctaggcaacagagtgagatcctgtctctaaaaataaaaattctgaaaagttacatctaaattaggtttgagtaaatgaagtcatgagccaactgcataggtgatctttctagtggtagcaataccaaagtgggccttgtaaaaacaaacaaacaaacaaacaaaaacacccttttaaatgtagttcagggagaaggaagctagtatttcaacttactgtatgccaagcacttctaagtgctttacattattctctttaatattatttcttatattcatcaccacaatcctcatttacaactgaggaaacagaaggaggttaaatagctttgcccaaagttacaccactggcatgtggtaatgtagggcttccagcttgagtatatctaattttatagccatcattctttctctttccatctctgtatctctctgggagtcaggagacctatattcctgtgtttttgttgttgtcgttttgagacagagtctcactctgttgctcaggctggagtgcagtggtgccatcgtggctcactgcaacctcaacctaccgggctcgagtgatcctcagctgtgccatctcgctatggaaccttggctaagccacgttctgagctatggtaaagcacagtaataggttcacattcactctcccccatcatgcttatgccccctacctcgtctagaaggctccacacttcctttctgtgtgctcgttcattcagtcgtcagtcatttcgtcagttagtcagacaacagactttgttcatacgacattagtgactgaggttctgttgagtgacgcagataggaaataacctagctgcatggttgctgtctttcaaaaggccgtactcttaggatccacatacaggcccccatcttctgtgaagccattgtccccagccatcccattttgacgagtttttttgagtccctgtgaaactttggcttttttacatttatctggcagttaactaggtgctgctttgtgacagttcttctattattggatgcaattcttaattcaaatcatgtatcattacttaacttttcacctctttgcagcttctttctcccagaagattacaagttccttaagagcaggcttatacttctttgtataatatttcccacagtgtctcttaaatagcaaagttttttgacctgatttactaaaaaaaagtttgttgacttggcttaaattttattttcttttctttttttctttttttttttctttgagacagagtcttgctctgtgaccctggctggagtgcagtggtacgattttggctcactgcaacctctgcctcccgggttcaaacaattctcgtgcctcagtctcccaagtagccaggattacaggtgcccaccaccatgcccaaccaatttttatatttttagtagagatgggttttcgccatgttgtccaggctggtctcgaactcctgacctcaagtggtccaccctcctcggcctcccaaagtgttgggattacaggtgtggaagccaccgtgcctggctgacttgggttaaatttttaagtttagagtttactccctggttgaatgatttgggccaagttacatagcttctgtgaacctcctcagttttcaacaaaatgggaataattcctactt

SEQ ID NO: 1711 - DNA, 13557 bp, Homo sapiens
gggttcactccatcctcctgccttagcctcctgagtagctgggactacaggcgcccaccaccacgcctggctaattttttgtatttttagtagagacggggtttcaccgtgttagccaggatggtcttgatctcctgacctcgtgatccgcccgccttggcctcccaaagtgctgggattacaggcgtgagccaccatgtctggcctggccaggctggtcttgaactcctgacttccggtgatccatctgttctggcctcccaaagtgctgggattacaggcataagccaccacgccatgccgaagcccagcttgtttttaatttttttttttttttttggagaaatgaggtcttgcaatgttgcccaagctagccttgaactcctggcctcaaatgaccccgccttggcatcccaaagtactgggattacagatgtgagccaccatgccccagccttgctttcttgagatacgatttagaataccataagattcatcccttttaagcacataattcaatgacttctgtacaaacaaccatgactacaatctaattttaaaatatttcaatcactctaaaaaagaaacctcctgcttatgtacagcgactctgtctacctcttaagtgaattctcctacctttaatagccctattttacagttcaggaaactgaggttcagagagacaaagtcacttacccacagcaaagaagcaaggctgggtatcaaatgcaggacccccccggtcctgatgcttttttttttttttttttttcctctgagagagactctcactctgtcactcagtctagagtacagtggcgcgatctcagttcactgcaatctctgcctcctgggctgaagtaatcctttcctcacaagtaaacctcagcctctcaagtagctgggactacaggcacacaacaccacgcctggctaatttttgtatttttaggtagagacggggtttcactatattggccaggctggtcttgaactcctgacctcaggtgatccgcctgcctcggccccccaaagtgttgggattacaggcgtgagccaccacacgcagcctttttgttattagactctgtcattactgactttttttttttttttaatagaaacagggtctttctttcccaggctaaagtacagtggcatgatcacagttcactatagccttaaactcctgggctcaagtgatcctcctgcctcagcctcccaagtagcagggactacaggtgtgcaccaccacacccagttaaccattcattcattcattcattcatttattttgagatggagtctcgctctgtcacctaggctggagtgcagtggcacgatctcagctcactgcaacctccacctcccaggttcaagagattctcctgcctcagcctcccgagtagctgagactacaggcgtgcaccaccatgccagactaatttttgtatttttaatagagacggggtttcactctgttggtcaggcttatctcgaactcctgacttcgtggatccaccctccttggcctcccaaagtgctgggattaaaggcgtgagccaccgcgccctgccaacctttttttgatttttcttagagatgggggtctccctatgttgcccaggcttgtcttgaactcctggcctcaagtgaccctcttgccttggcctcacaaagtgctaggattacagcctgagccatcacacctggccaacaggtttttttttttgttttgttttgttttttaaagaatgtctaggccaggctcatttactttcacctgtaatcccagcactttgggaggccggggtgggcagatcacttgaggtcaggaattcgagaccagcctgggcaacatgctgaaaccccgtttctactaaaaatacaaaaattagctgggtgtggtgacacgtgcctgtaatcccagctactcaggaggttgaggcaggagaattgcttgaacccaggaggcagaggttgcagtgagccaagatcatgccatcaccctccagcctgggcgacagaaggagactcagtctaaaaacttaattaattaattaattaaaaataaaaatacaaaaattaacctggtgtggtggtgtgtgcctgtaatctaagctactcaggaggctgaggcaggagaatcccctgaatcccagaggcagaggttgcagtgagccaagatcgagccactgtttgcccagtctagtgcactgggctgctgaatttatttgaccagacacctagcaatagactttgaagttcttttccacttttcactctaagatgctgctgtcatgaataaggaatattttgatccccttcacaaacactcggggccctcttaccagttttcactgaagatcttgacattcctatctgcttaggtgtctgggcgtgtttgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagtaagaaggggcaggggcggagtggggcttcttgggggtgtgacctgaacccggggcggggctcactgtgtgcctattccaggctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcgtgtttttccagatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctgtgagtgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgatttttttttttttttcagagacggggtctcgcaacattgcccagacttcctttgtgttagttaataaagctttctcaactgcctcagccttgtgtgagttgaggggaggtgtcacatccagctggagtcctttctaagcagccacagcctgatcctcccacttcctcccccaagaaaacattgtgggttgatggccataccctgaggttctggtccaaatcggactttctatgaccttctgggtctctagtgaaaactaaagactcctctccagaaaaaaacatttggtttctaatgaggcctggaatcttattcttgacctggggagcggaatccctttttgcagtactcccgggccctctgttggggcctccccttcctctccagggtggagtcgaggaggcggggctgcgggcctccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagartcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgttgttgttgttgtttttgcgatcactttctccaagttccttgtctccctgagggcacctgaggtttcctcactcagggcccacctggggtcccgaagccccagactctgtgtatccccagcgggtgtcacagaaacctctccttctgctggccttatcgagtgggatcagcgcgggccggggagagccacgggcaggggcggggtggggttcatggtatggctttcctgattggcgccgccgccaccacgcggcagctctgattggatgttaagtttcctatcccagccccaccttcagaccctgtgctttcctggaggccaaacaactgtggagcgagaactcatctccaaaataacttaccacgctggagtgagaccacgaatggtggggaggggagggtcccacggacatattgagggacgtggatacgcagaagaggtatccatgtggtggcagccgggaaggggtgatcagatggtccacagggaatatcacaaactcgaattctgacgatgttctggtagtcacccagccagatgagcgcatggagttgggggtggggggtgtcaaagcttggggcccggaagcggagtcaaaagcatcaccctcggtcccttgttctcgcgtggatgtcagggcccccacccaccgagcagaaggcggactcaggggcgctccagggtggctcgagctcacacacgctgagtagacacgtgcccgctgcaccctgggtaaatacagacccggagccgagcggattctaatttagacgcccgcgaacgctgcgcgcacgcacacgtgtcctcggctcgctggcactttcgtcccgccccctccgtcgcgtgccggagctgacccggaggggtgcttagaggtatggctccgcggggtcaaaaggagaaggatcagtgagagaggcatccccacaccctcccctagaactgtcctttccccatccagtgcctcccaaatctctcttagtccccaaatgtatccccgccctaaggggcgctggtgggaggagctaaatgtgggggcggagctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgcctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagccccgctctggttcggggtggacagggcgggggcggagtccctggacctgagaaacggcctcctgtccctcccagctctgccctcgcctcgctcccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctgtgctgtgcaccatggtccacggactggcatcttccccactcgcggtccgcgaagactccatctctccaactaccctgactcagaggcgctgttcccgctccacccagagccctggcaaccgggtccctcagctgttcccgcggttccttccatgagcccagccttgcgtcccggctccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatggctctctgctaccacgtcccagagacaccctcgaggtttagactctgggagtgcgcctttaaaccggaggcctgggcacgacgcgggacgcctgggttctttccctggctgcagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggcgttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggatgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctggtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtggcccgagggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggcttcccggcaccactcctgaccctgagcgaacccagcgtctccgaggggcagatggtgacagtaacctgcgcagctggggcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatgtgagttggtgataacccctcgccccccaccttctggtgacttccaaggacccgcctgctccctcaccgtgtcgtggaggcggagccatttcttacgtctaagcctctgtaaccccacgccctgcccgcagacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtgtgagtgggggtgcgcagggtgcatttctatctggttcaaggtctggagggtggccagcctccagggaagagtaggagtagggtatgaggtgtccctttgggtgaggttttgggaaagggaagaggctggttagtggggttggagaaagatcttggaggatggaagggaccgggtgggcgtgcccctagcctagggcgtggtatttgggcggagtcgtggaaaggcgggcagtccagagtgtttaagtttttagacgaaaaaggcgccactggtggctcaggaagctcccagacagagtgcatgcctcgactagcgtgacacctccttggatcggcgtccaagggttatgcagggacaacacttcgtggaagccttgccgcgccaaggagggtctagggacgtcagatttgcccccaaaccccaaagccaacaatacactccctcctccagacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatgtgagtaggggcaccgcggagttaggcaggatctgtgggacaaccccggctggacttcctggcccccgtgtgagcccctgcaatcctgtttcccagatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtgtgagcgaggcccaggcgggtagggagcaggggtgccccacggtccaggcactccctgacatcccccatggctgctttgcagcgccaccggagatggatgaatctacctgcccaagtcaccagacgtggctggaaggggctgaggcttccgcgctggcctgcgccgcccggggtcgcccttccccaggagtgcgctgctctcgg

SEQ ID NO: 1712 - DNA, 19409 bp, Homo sapiens
tgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagtaagaaggggcaggggcggagtggggcttcttgggggtgtgacctgaacccggggcggggctcactgtgtgcctattccaggctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcgtgtttttccagatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctgtgagtgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgatttttttttttttttcagagacggggtctcgcaacattgcccagacttcctttgtgttagttaataaagctttctcaactgcctcagccttgtgtgagttgaggggaggtgtcacatccagctggagtcctttctaagcagccacagcctgatcctcccacttcctcccccaagaaaacattgtgggttgatggccataccctgaggttctggtccaaatcggactttctatgaccttctgggtctctagtgaaaactaaagactcctctccagaaaaaaacatttggtttctaatgaggcctggaatcttattcttgacctggggagcggaatccctttttgcagtactcccgggccctctgttggggcctccccttcctctccagggtggagtcgaggaggcggggctgcgggcctccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgttgttgttgttgtttttgcgatcactttctccaagttccttgtctccctgagggcacctgaggtttcctcactcagggcccacctggggtcccgaagccccagactctgtgtatccccagcgggtgtcacagaaacctctccttctgctggccttatcgagtgggatcagcgcgggccggggagagccacgggcaggggcggggtggggttcatggtatggctttcctgattggcgccgccgccaccacgcggcagctctgattggatgttaagtttcctatcccagccccaccttcagaccctgtgctttcctggaggccaaacaactgtggagcgagaactcatctccaaaataacttaccacgctggagtgagaccacgaatggtggggaggggagggtcccacggacatattgagggacgtggatacgcagaagaggtatccatgtggtggcagccgggaaggggtgatcagatggtccacagggaatatcacaaactcgaattctgacgatgttctggtagtcacccagccagatgagcgcatggagttgggggtggggggtgtcaaagcttggggcccggaagcggagtcaaaagcatcaccctcggtcccttgttctcgcgtggatgtcagggcccccacccaccgagcagaaggcggactcaggggcgctccagggtggctcgagctcacacacgctgagtagacacgtgcccgctgcaccctgggtaaatacagacccggagccgagcggattctaatttagacgcccgcgaacgctgcgcgcacgcacacgtgtcctcggctcgctggcactttcgtcccgccccctccgtcgcgtgcsggagctgacccggaggggtgcttagaggtatggctccgcggggtcaaaaggagaaggatcagtgagagaggcatccccacaccctcccctagaactgtcctttccccatccagtgcctcccaaatctctcttagtccccaaatgtatccccgccctaaggggcgctggtgggaggagctaaatgtgggggcggrgctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgyctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagccccgctctggttcggggtggacagggcgggggcggagtccctggacctgagaaacggcctcctgtccctcccagctctgccctcgcctcgctsccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctstgctgtgcaccatggtccacggactggcatcttccccactcgcggtccgcgaagactccatctctccaactaccctgactcagaggcgctgttcccgctccacccagarccctggcaaccgggtccctcagctgttcccgcggttccttccatgagcccagccttgcgtcccggckccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatgsctctctgctaccacgtcccagagacaccctcgaggtttagactctgggagtgcgcctttaaaccggaggcctgggcasgacgcgggacgcctgggttctttccctggctgsagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctyggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggygttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggrkgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctgrtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtgkcccgagggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggcttcccggcaccactcctgaccctgagcgaacccagcgtctccgaggggcagatggtgacagtaacctgcgcagctgggrcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatgtgagttggtgataacccctcgccccccaccttctggtgacttccaaggacccgcctgctccctcaccgtgtcgtggaggcggagccatttcttacgtctaagcctctgtaaccccacgccctgcccgcagacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtgtgagtgggggtgcgcagrgtgcayttctatctggttcaaggtctggagggtggccagcctccagggaagagtaggagtagggtatgaggtgtccctttgggtgaggttttgggaaagggaagaggctggttagtggggttggagaaagatcttggaggatggaagggaccgggtgggcgtgcccctagcctagggcgtggtatttgggcggagtcgtggaaaggcgggcagtccagagtgtttaagtttttagrcgaaaaaggcgccactggtggctcaggaagctcccagacagagtgcatgsctcgactagcgtgacacctccttggatcggcgtccaagggttatgcagggacaacacttcgtggaagccttgccgcgccaaggagggtctagggacgtcagatttgcccccaaaccccaaagccaacaatacactccctcctccagacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgargggctgttgcgtgtggcccgggagcatgcgggcacttaccgctgcgaagccaccaaccctcggggctctgcggccaaaaatgtggccgtcacrgtggaatgtgagtaggggcaccgcggagttaggcaggatctgtgggacaaccccggctggacttcctggcccccgtgtgagcccctgcaatcctgtttcccagatggccccaggtttgaggagccgagctgccccagcaattggacatgggtggaaggatctgggcgcctgttttcctgtgaggtcgatgggaagccacagccaagcgtgaagtgcgtgggctccgggggcrccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtgtgagcgaggcccaggcgggtagggagcaggggtgccccacggtccaggcactccctgacatcccccatggctgytttgcagcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaatgtgagtgggggcagcaccggatggaggggacacggtcctcggaagaatgactcgcagcggtgggagcattcaagggcacctctcccaatcccattctcggggacagggaattccagcctaaaccagggggtaatgaaaattctagccaggcgcagtggctcaggtctgtaatcccaacactttggaaggttgaggcggatgaatcacttgaggccaggagttcgagaccagcccggccaacatggcgaaaacccgtctctacaaaaattagccggtcgtggtsgtgggcgcctgtggtcccagctacttgggaggctgaggcaggagaatcgcttgagcctgggaggcagaggttgcagggagccgagatcccgccactgcactccagcctgggcaacagagtgagactctttcttagaaaaacagaaaaagaaaattatagggaataggagcacggccctcctcaaatcctggattagaacactgacctgggcttcacctccttccattcggtgaagaagggcgaggaattttagccgcaacagcagcctgattgtcggggaaggaggctctgataggaggcaggatcctcttctgcccatcagaggcgcggtggtctcccatcgatcgttgtgggccggagcagggcatttgatcagtggctgggccggcgctaagccccacttcaccttctgtgcccttcagaccggccagtggtggccgaacttgctgcctcgccccctggaggcgtgcgcccaggaggaaacttcacgttgacctgccgcgcrgaggcctggcctccagcccagatcagctggcgcgcgcccccgrgggccctcaacatcggcctgtcgagcaacaacagcacactgagcgtggcaggcgccatgggaagccacggcggcgagtacgagtgcgcasscaccaacgcgcacgggcgccacgcgcggcgcatcacggtgcgcgtggccggtmmgtggcagctggggagaggcggggcgaggtatctgagagggggcgtgacctgggtcttggggcggccggccccgcctgcctccctctcggtcccggkagactagrcggwagtgggacagartagaagtcaaaggtgcctkagcgggtggggctgttgatcgcactttgaggggtgggagatggaggtggcagggggactgaattcaaggggagggaccctccggggctgtcactgctgcaggaaaggactttaaaacttgggctggattctgcgtggyggaaacttgacccaattcacaatccactgtggggaagattggggagggaccaaagtcattggatgwtggagggagagaggggtcaagatcgccttctctcacttcctgaagctcctggggctgggttctctctggggtcgggggaacctgacctggtcctgccggtcctcattttttgggggatggggagagttgacttgtcgccagggggctaagtgtggtcacgggtttatatccccatgggctgaagtgcgatataaatcgggactcgggtcgccctggcactgggagtggccttattgcatgggttgtctcccttctcccaaggccagacagtgagctccccggggcatgaggactgacttcgtgcctgtgggagtgcggggggcggtgggagaagccccccggagcttggccaccctccgcgagggtctccaccccgcaggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctsaacggagcgggcggcggcgctggcggggcggcaggcgcggagggcggacccsaggcggcggggggcgcggccgagtcgccggcggagggcgaggtcttcgccatacagctgacatcggcgtgagcccgctcccctctccccgcgggccgggggacgccccccagactcacacgggggcttatttattgctttatttatttacttattcatttatttatgtattcaactccaagggcgtcacccccattttctasccatcccctcaataragtttttatraaggaactccctgtctccgcttctgtttctgcaaggtggaacaagcccagggttccagtcgtgacctcccgagttattcattcaaaaagcgatttttgagagggcctggggtggtggcttaggcctgtaatcccaggacttgtgggaggcccaggtgggaggatcccttgcacccaagagtttcagaccagcctgggcaacatagggagaccctacaaaaaatatttttcaaaaattagccaaggccggtcgcggtggctcatgcgtgtaatcccaggactttggaaggccgaggcggccagatcacgaggtcgaggtcatgagatcgagaccatcctggccaatatggtgaaaccctgtctctactaaaaatacaaaaattagctgggcatggtggtgcgcgcctgtagtcccagctattcgggaggctgaggcaggagaatcgctttaaccccggaggcagaggttgcagtgagccgagatcgtgccactgaactccagcctggcgacagagcgagattccgtcttaaaaaaaaaaccaggcgtggtggctcacgcctgtaatcccagcactttgggaggccgaggcgggcggatcacgaggtcgggagatcgagaccatcctcgctaacacggtgaaaccccgtctctactaaaaatacaaaaaaaaaaaaaaaaaaaaaattagccgagcgtggtggcgggcgcctgtagtcccagctactcaggaggctgaggcaggagaatggcatgaacccggggagcagagcttgcagtgagccgagatcgcgccactgcactccaccctggcagacagcaagactccgtctcaaaaaaaaaaaaaaaaattagccagggccgagcacagtactctcgcttgaatcccagaactttgggaaactaaggcggggggggggggtcacttgaggtcaggagttcgagaccaccctggccaacgtggtgaaacaccttctctaccaaaaatacaaaaaaattaaggccgggtgaagtggctcacgtctgtaatcccagcactttgcgaggctgaggcgggcggatcatggggttagaagatcaagactgtcctggctaacatggtgaaaccccgtcactactaaaaacacaaaaattagccgggcgtggtggcacatgcctgtagtcccagctactcaagaggctgaggcaggagaatcgctttaaccccggaggcagaggttgcagtgagccaagatcgcaccactgcactccagcctgggcaatagagcgagactctgtctcaaaaaaaaaccaaaaacaaaaacaaaaaaatacaaaaatttagctgggctgtagtggcacacgccctgtaatcccagctactcgtgaggctgaggcaggagaattgctagaacccgggaggtagagatcttgccattgcactccagcctgggcaacagaactagactctgtctcaaaaaaaaaaaaaaaaaaaaaaaagtgttttttgagggggctgggcatggtggctcaagcctgtaatcccaggacttttgggaggcccaggtgggaggatcccttgtgcccacgagtttcagaccagcctgggcaacatagcgagaccctacaaaaaaacatgtttcaaaaaaaaatttttttttttgagatggagtctcgctctgtcgcccaggctggacagcagtggcactatctctgctcactgcaagctccgtctcccgggttcatgccattctcctgcctcagcctcccaagtagctgggattacaggcgcctgccaccacacccagctaatttttttttgtatttttagtagagatgggatttcaccgtgttcgccaggatggtctctattcctgacctcgagatccacccgcctcagcctcccaaagtgctgggattacaggcgtgagccaccgcgcccggcctcaaaaaaaaaattttttttttgagatggagtcttgctctgtcacccaggctggagtgctgtggtgtgatcttggctcactgcaacctctgcctcctgggttcaagcaattcccctgccttggcttcccaaatagctgggactataggcatgcaccaccacacccagctaatttttgtatttttagtagagacagggtttcaccatgttggccaggctggtctcgaactcctgacctaaggtgatccacctgcctcggtctcccaaagtgctgggattacagctgtaagccaccatgcctggtgtatttttcaaaaattagccagacatggtggtgcatgcctgtagtcccagctacttgggaggctgaggcaggaggatcctttgagcctaggaggtcaaagccacttccagctatgatattgtcattgtgctccagcccaggtgacagaaccagaccctgtctctaaaaacaaacaacgaaaaaatccaaaaactttttttgaacacctactatgcatcaggcacaatctaagctgtctttttctttttcttttttttatttttgagacggagtctctctgtcgcccaggctggagtgcagtggtgtaatctcagctcactgcaagctctgcctcccacgttcaagcgattttcctgcctcagcctcctgagtagctgggattacaggcgcgcgccaccactacgcccggctaatttttgtatttttagtagagacagggtttcaccatgttggtcaggctagtctggaactactgacctcgtgattcacctgcctcggtctcccaacgtgctggaattacaagcctgagccactgtgcctggcccggctggctgtcttttctcagtgtgacctagagctcgtcctctctcagtgcctgttttctgctctcttcacacccttgggcaggggtgggggcctcactccttcctcctacttatctcttccacccagcactgccctctgatccgggtcactcttggaggtgggggctaggtgcttcccccaggcctggttaccggcagagctgaggccgccttgccagggtgggtggaggccctctccgttgtgcccctgccctgagacttcggtgagaccttcctgggcaggcactggctgatgctatgggtgtcagcccttagcatgtcctccctgttaaagggggcacccctgccccgccctcaatgcctcctttgtcctgtgtccacccacagtgcttcagtttacccccaccctgcctttccactcagcccatcatgattcagaacagacacacacagggtatccgctgcaacccccactacacggcaccttcccccctcatccccaacagcataaggcacagcagctgggcctcctccccacagcctcctcctctgcccctcctccctcaaaagcaggaacacggagccctagagaaggaagccagtcccatgcaaacatgtaatgagcaaagatgagacggggaaatggcacaagagggcaggccagtgctcggtgctggagccaggggccaggtataacacccaaaaaggcaccagccaggtgcagtccctgccactaacagcacctcaccttttctgcctgtgccctccctacttaatgatctctctccgctcctactgacctcaaggtctctttcagagccttcagatgagatatttattttagtaggttggtgcaaaagtaattgctgtttttgccattgaaagtaatggcaggcagggcatggtggctcacgcctgtaatcccagcactttgggaggccgaggtgggcagatcacgaggtcaggagttcaagaccagcctggctaacatggtgaaaccctgtctctactaacaatacaaaaaaaattagccggacatggtggcacacccctgtagtctcagctacttgggaggctgaggcaggagaactgcttgaaccctgaagcggaggctgcagtgagctgaaatcacgccactgcactccagcctgggccacagagtgagactgtctcagaggaaaaaaaaaaaaaaaaagtaatggcaaaaactgcaattactttttctttttctttctgtttttttttttgtttgtttgtttgtttgtttgtttgtttgagacggagtctcactgtgtggcccaggctggagtgcagtggcgcaatcttggcttactgcagcctccgcctcccaggttcaagtgattctctcctgcctcagcctcccaataggattacaggcacccaccactatgcctggctaatttttgtatctttagcagagatggggtttcaccatgtttgccaggctggtctcgaactcctgatccacccacctcagcttcccaaagtgctgggattacaggcaggcatgagccatggtgcccgacatttttttttttttttctttttttttttgagacagagtctcactttgtcacccaggctggagtgcaaaggcaagatctcactgcagcctctgcctcctgggttaaagcgattctcccaccttagccccctgagtaggtgagattacaggcacatgccaccacacctgcctaatttttgtatttttaatagagagggggtttcaccattttgtccacgctggtctcgaactcctgacctcaagggattcgcccacctcagcctcccaaagtgctgggattacaggcatgagccaccacgcccgacctccttaactcttttatttccttgcacactttttctctgtagcccagctcacaacttaacatcctcttagacatacacctgaggttttttttttttttttttttgagagggagtctctctctgtcacccaggatggaatgcagtggtgtgctctcagctcactgcaaccttgcaaccactgcctcccaggttcaagcaattctcctgcctcagcctcccgagtagctgggactacagacacatgccgccacacctggctgattttttgttttttagtagagacagggtttcaccgtgttgcccaggctggtctcaaactcctgagttcaggcagtccgcctgccttagccttccaaaatgctgggattacaggcatgaggcaccgcgtcctgcctctgagttttttttttttttttttttactgtctcctagaacatcagccccagtagagcagggatctttgttctgttcaccactgagggtcctcattgggtcctagcacacacagttgctcaataaatgttgaataagtgggtaaagacagccacgagcttgcagatatgtgttcaaggtgtgtccttgcagagagcttctctatacttggcactggagaggcctgtcgtgggcaaggacatagatgtggcgacctcagacttgagaactcctggggcagtaggggagatggatgtggataatgtaaccataagccttcctttctattttagactgagtggtcaaggaaggcttccagacaatggaaattctgataggttctaagagggagaccagcaaggagctgaaccggaggctgacacagggtgagagtgggaatgtctattttattttttttttggagacagggtctcactctgttgctcaggcagcagtgcagtggcacgatcgtggctcactgcagcttcaacttcccagactcaagtgatcctcccacctcagcctcccaagcagctgggaatataggtgcatgccaccacatccggctaatttttgtatttttggtagaaacggggtttcaccatgttgcccaggctggtcttgaactcctgggttcaagtgatcttgctgccttgggctcccaaagtgcttggattacaggtgtgagcctgtgagccacatctggcctattttattttttaattagttttttgtttttgtttttgttttgagatggagtctctgtctccaaggctggagtgcagtggcacgatctcggctcactgtaacctccacctcccaagtagctgggattacaggcacatgccaccacgcctggctaatttttgtatctttagtagagacagggtttccccatgttggccaggctggtctcgaactcctgacctccggtgatccacctgcctcagtttccca

SEQ ID NO: 1713 - DNA, 110300 bp, Homo sapiens
ttgatggtagctttaaaactacaaatatcagaaaaactaaatttacagtggattaaggaaaatggggtttattttttctcccataaccataagtctggagacagggctggcatctctgaggatctcttagccactttctcaaggttgcaagggagacaggtgctgggaatgactgttagaaggtcagctatgtgagcagataagtatttgacttcaaaagaaacataacacttagtggaactatgttctttgcagagccctacctaatccattcatctaaaagtgttgcaacataggtaggagaatacgttgtctgggaaaccacaaattacagtactatgtgcatcccctcataatttcaccttaacaatttcgttacagaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactggtaagtgctacttaattatttttctcattagcattttggaaataaaataatacttagttgaagaatcaaaaactgggaaaaattttggcctctagaaggcaaatgatagatgttttaaatcatggtgtgatcctgttgagagtcaccctgggtcagtgttctctaagggaatataaagaacgtgccttaccctaacaacacacactttattctagcacgtgggcttcctaagaaaatgtcagacaaattccttgaaggttaggaaggaactactactacacttgacctgatctgcatgtgaagcggtataagcaaggatgagtatggaatcatgcgacagctttgtggtcactagcttcctacaacagcacaccacagattaagtctcaacacagcactcattgttttggtattagcagcaggaattgttcctgccctgacttccttaaccctcagggttttggtcctattaaagtacctccaattttagcattgaggagagagtctgttttttggaacataacagacaatacaggaaattcaaagaggactcacacaatttgatactcccttagcactttttagtccaagatactgtatgtttgggttcatggcaaaagatgcaaggattcttgaaggattgtagctaggctttgacaaatcctcatcccagatgctctccagacagtggaagtgttacatcaacagccccattcttgggaagggactaatttttaggtagtagcttgtttcttagtgactcatttttttttctggctctcttaacagaataaaatatagtcacattacaggagctagcaattgctgatgacaaatataagattatttgcattctctgaaaatagcccatttagaacataaatgtacttgatacttgagcttttttcttctcaagggaaaactgttaaggaaagcacctttcaaaaatattatctttgaagaaataaaaggaaatttatcatgatttgggaagtagaattagtctaattatgcttttttttttttgcatcactgccagcacacatatatgttgagagccattacgtgtaaaataccttgtcaatggatgtttaaagaagcattaggtaaaatcctgccctttaagagaatgtgttatggttagggagctcaaccattagcaaatgttacaaatagttgtactctaaggcgacatagagtaactactaaatacgtggcacagacagtacaactcacttctaactagaatatcaagggatggcttcactaatgcattcagagggaaatgctgagataagtgaggagataaagtagttactgtccttgaggaatttacaatctattaagggggggaaaaactacaaataataaagtgctgttgatgtcaaagatcagctacattttagacaggcattgaaagaggatttctataggcagacagggaaggaaggaccttccaagcaaagaagttggtgttcaccataagaggatgcaaaagtggagggtgatagcatcagaaagtagattaggttggcttctgaaggggtgtgactgtcagataaatttgtatttcattatgtagacaatggggttacattaaaacttattttttgaacaatgagatggcataaaataatatccgctgataaatctcttgagtttttcaagaaggtaacagtgtataccatgatgctagttccaatttccgaaaagttccagataagtgagaacttcagaatagatttgacaaaatgaatatcaacagacaaaatgaagtcaaatgggggtcttagttattatcctgctccataccagaggcataatcttttttgatttgatgaatctatggaagtcattagacattttacacaagaagaaaatagaagttgtgagaaggataagaagtgagtcatgcatgcattaggtgtttgtatgtgtttagaaaggttggatttaaagtttggtgataattttgttcagaaatggagtacctctaagcctttgagatgtagttatacttcattttccataataaatgagttcccaaaaaggcatgtgataatttttttctgcaaattaatatatttatttatataaattatttcaatatattgaaatagtttatgtttaaagccacccaattgtgattgccataaagtgcacatattttaaattaatttgtttaccttatttatttgccttttagatgaatctagattttctacctgtatactttgattcaattaatgtatgattattttttagaaacttctacttgtcatgtttcaaagctgcacattaactgaaattctatatctttttgcttccagtctctagtagccagtgaagcagttcgtgctattgagaaaactagtaaaaataccaggtatacacatggccatggctcagaaaccttatgtaagtatttcttcttatgatcttagagaactttgagctactaaagaaatctgtgtgatctgtttttctttgtgtatttaatttttctgaattaaatagggtcacatgtaatacaactgaattgtaataattaggaacagaagcataatagctatgacaatgctgaacaaagctatattaataaatgagttactaaaaagaagccaaaatcctatttaagaaatcatatttatcacaatcaagtaggaattacagaattggcatcatactagttgagtgaagcagaaaagttcataaaacttttgcatgattcccagggccaccatggaaggttgtgcaggttgtacactacactaatctagggcatgccatttgcatcaagtgttttttagtgttagcctgttcccaagagtatagctcataacacattacagttgattgtctttaatatatattacacacacaaaacttgtgacaaactcttaacaaaaagttttgattaatttttgctgaaagatatttagtgagtaactcctatctacacacagtgggaggacagactgattttgcccttttgaagtttgaagggagatgggaaaagaggagcataaaataaacctgtaaccaggcatcagaaaactacagcctgaaggccaaatccaggtttttccattttttttttttttaatgattagaaaaaaacaaaaagaggccaggtgctgtggctcatgcctgtaataccagcactttgggaggctgaggcaggaggatcacttgaggtcaggagttcgagaccagactggccaacatggtgaaaccctgtctctactaaaaatacaaaaattagctgggcatggtggcaggcgcctgtaatgccagctacttggttggctaatgcataagaattacttgaacctgggaggtgggggtggcaatgagctgagattgtgcaactgcactctagcctgggtgacagagtgagactccatctcaaaaaaggtcgaaactgtatttatcatgaacactaaaatatgtacacattttagttaacatgcattaaactgtaacaagtcttctggcaattgtagctttcatgagatgcttcccaaactgtattagatagatgctaaaattataaattaaaattttgggtcagactttgccataaacctggactcaatttagcacccccccaaaaaaagtcagattattcaattaatgcggttggaaaacctaacaagttacctagaaaaaaattaattggattattaacatgtctttcaccaaagtaaattccaggtacagcatatattttcatatgaaaaccctgcataaaccaagttgaaatctcagtaaggagaaaaaattcttgtgaaaggagaaatgaatgaaaggagaaaaaaaggtctacatgccaaacaaagctaataacactaatgtcgtttttataagcaattgataaaatgaaccaagtagacaaatgaggaaggacaattgataggaaatataaagatagccaataaatatgccaaacaaatgtgcaactcactgataatcaaaaaacataaattaagacagttggatattatttttcgcccataaaattatcagaattcataattcctattgatggtatgggaaggggaaatgggcaaattcataccctgcttgtggaagtataaatgaattcagttcttttgacgtccatttgggaacatgccgtaattgcaaaaagtacagagccttagactagcaaatctattctagggaagaatattctaaagagacaaagaagcaattatgtataaacaagggtactcattgtaaagttgtttatattagttaaaaactgaaaaaaatctaaaggtatacaaacaaataaacatttaaatcaaacaattcccagtttgtaaattaatttgaaacgtctgtatttcaacaatttctttcttcttcttttagacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgcctttagaaatacaaccatgcattccgtttgctccacggtaattaggcgatggcccagaaaggggaggggtgtcaaaaacgacaaacatagcctctcattccagctcagctgctcaataaacactgttgaacgaatgaatgagtggctctaggtactgtcaacaaatgccgcattttgcgcatttacaacagctgtttatggtaaggaattatgtaataaaaagagaaaactcacttaaattcacttttaattgggaattttagttctcccgggctcccagtttcctttcctaggatctctcacagagcacagattcgatttccaagtcccgccgcactcttaccgctcgcatggaaccttacgcctagagggcgtgtccacgaagggtggtgtctgcgcactgacgactaatctgacggccggaagctgcctgggtctacagaggaacagggcaaacctctgacttccggcggcattttgaggcggtcctcctagcggcctggtagtgtttttgttgccttttcttaatctacaatctcttcgttatttttcttcctgcgacccagtttcgcttgaccctggagaggcggcgggcgggttggttctgcttctcagccatcccgggggctcctcgctagccaagagccggttcccgggagccgcgcgcgcatcgctttctcctcgtcgtcgtcctcctgggtccaggcgcggggacagagtcgcctcccccgctcctcggagcggcggcggcggtggtgcctccggactgcacttgcgaagggagcttggggaggaagtaagcgttctgtgaattggtgtgggtatctggggaaggcattgagcggacccgtaatgcggaggcccgggttaccymcccccgtctttgcttgagtcactgggattttgagctttccttgagcatcccacccttaactctgcaatagccccctgtgctcaggcgtaatttctcactctgattatgattctggcatttgtctaagggcgataagtagactcagacaataggctgtacccctcgttaccatttgatgtaagcacgggaacccttgtatggtgttcgtatttgtgtgcgatggaagggtgcagcaatttgggcttaaatttagaatcttcctctatactcattccagatctgttagagaaaaacatcttacttgtgattggtcttgttttttttttttttttttttccctcagcagtgataacgatttaggtcctgggaattgagtgctactttatmttcacaagccttaggtaggtagttttggcaactgtcagaaacgggggaaagtggaatagaaagaagagagtctgtttggcggcattatctctctgtaataggctaacgcaatttatgtggtttgaaaattatttagagttgataatacttgaattatgttggtaagatgttgtttgtgaagggtagtcttaaggtatttggttatactatggggctttcaggtaattcgaactactttgaaaattatgggagtatgaagtctcttaagatttttggatttttaaagtagttttaaaaatttggaaaacatctttacacctcaagttttcgaagtccgcgataccgttggagaataaatacttatgcagttcagtctatgggtatatggtgccagttagcggggtctagttctgtaacatttgaaattactggctttagtacaatatattggagcgttttgtgaatacaatctatagattttcaaataatttttaatttcttaatgaactatttacattataacagatgacagtttcaactagagactagcaaagttgatgcaagcttgtaacaattgcggctttaaaaatagttgcactctgaaactaaggctttcactctgtgcatctggtaggattcagttttatcaaatgtatgcctcttactggcttcctgattactggtcattctaaatgaacattgcatattttgagatttgcaagcttatgtgattttcatatttgtaatatgaatttaacatactaaaaatccagcaagtggatggtatcttaacatctttacaaattattaaaattgtaatatcatcagtatttataatatgcattggcatttacatagaggaaacacattgtttaacttaaatttacttagagagttggttttcagtggatgatagtcttcctcacctcctcatctctcccaactccatctcatatagaggtggagctatttctccagctgttagtagtagttgaagcattaactgctgttgatatagaaagagtcttttattcttttttttttgtatttttgtatgatgcagttctttttacttcactttagagtaggtaccagcatgggatgttttctgtgcagtctttttaacaaattgttttttctgcatagtactgcagtgttgctttgctaattcctatgtagtcagcttagttctgtcagttgtatttggaatttagtttggaattgttttagcattaaatttacggaagcaatctgaaagtttgttttagaaagttctttttaaaaaattctctcaaactatgcatcaaataaagttaatttttctttctaaaaatatgaagtataaatgtgaagataccttatttttagtatcacctttttaatcttagaaattcagagtatagggatttatcctactagttagtacattcatgtagttttaattgcctrattgtttgaaatttccctaatattatgccgctactcatccggattaaagtgttatgctttcacttatgcttccagtagatgagacctggaaaagataattaattatggattgaagtgaagatactagaacgcatatgtgtttattgacaagattttattaattgagcttctggagtcattattcaaaaagagacccttttgtatgcttctcctttctcagccataattataatgtgaaccttctgagtacagtgttattctaagtttctcggggcaagggagcagttcccatttaagaccctcttttgttgtgtctttattaatagactcaaactttgtgtcccggattttctttttctttttccattttcttttttaattgaaaagagattataaagacttcagatattcatttgctctgcaaatggagaggagaaataggaaaataacgaaataggctttcactagtgccactctgtctttgataatgctcgtgtttgagaaagacttgatgatgtgggtggaagtgtgatggcaacttaaaccaaataataatttgaaaacaaaaatggaggaaaaccttcatagaagagtaaattagtaagttattggtatgaccttgatttctattctctatgataggaaagactttagtatttacatttttatcttatggtttctaatttttctcatatactttgaagcatttacttgtcatgttcagcctgttcatacataatttgaaaaagtttcccgccccgaaaatctacattttaactgttgtggtgttcattttcctttacgggcccaaagttttaaataggattgaaaattctaattgtcacattagttggtaacatttagttttaatatatgaaaaaggaaatgtttttctgctgtattgtagatagtgtgtatatttttagataaatgggatttttaaagttatatattgtgttctttacaagcatgaagcattttgtttattcaaattcatgaatgtctcattagtaatatttaagtaacattttattgttgactacttgtggaagtttttacatggatgatcagaagaattttttcagttagaaatcttcagtttctgcttttttcttttttcaccagacgttttacacacacacatatatatatcacattaaagaacattttattaagaatatgtgtgtgtgtgtattattgttgtcattattcttgttttaaatgttcagtccaggaccttgctgtaacccagaccgcatactcagatgctgtattactttaggacaaagtatggtactcttggagtctgagaaaaagtagagtacatcttttttttttttttttttgagacggagtctccctctgttgccaggttggagtgcagtggcgcgatctcggctcactgcaacctccacctcccgggttcaagcgattctcctgcctcagcttcccgagtagctgggattacaggcgtgcacckccacacccagctaatttttgtatttttagtagagacggggtttcaccatgttggccaggatggtctcgatctgttggccaggatggtctcaatctcttgacctcgtgatccgcctgccttggcctcccaaagtgctgggattacaggcgtgagtcactgcgcttggccacatttttacttaatttcatttcttcgctaaattgggagactcagtacagtagtagctgcaagtgaaattcctgggataattactatgtaggtgaatcttgaatagttcttgatgtcactggtaaaagcaattttgtctctgtggaaagaatatgggcgtagggtgagggaggtgaggaggtggatcattagtcttcacttgattgtctttcatagcaagtccaacccttgaaatcttcaaagttttttttttttttttttttttttttgaggcggagtctcactctgtcacccaggctggagtgcagtggcgcaatctcggctcactgcaagctccgcctcccgggttcacgccattctcccgcctcagcctcccgagtagctgggactacaggcgcctgccaccacgcccggctaattttgtttttgtatttttagtagagacagggtttcaccatgttagccagcatggtctcgatctcctgacttcgtgatccgcccgcctcggcctcccaaagtgctgggattacaggcgtgagccaccgcgcccggcgaaatcttcaaagtttgccttagggagtctaggattggagagaagctctcagaccagcaaagcaataggtcaagggaggagagtagtgcgaatcaggcaacagaggacagaccagaaaaagaaactgtagagttaatacctggaaccctcaaaaagtaaaaagaaaggagatgatagatgaccaatgttttaagtataataagtacgataataaatagcctgtcgtcctaactggaaaccattaccattgaattttttgaaggagactgagctgggagtggaggcatgttgggggtagtagagatgttgggggcagaactaactcatttccagtgacagtggagggaaaaataaaaaattagtgttagtccacttgaggcagtgtggtgggagggtgtgcctgttttctaagttctacataactagcaaataaggaaattttggaacctattcaattttgtttattaagaaatgttttaaaaattgaattattggttgaggattactctatatttgtatattaatgtagcaatatataatgaaactttatgtttttctcaaacttcttatacattgtgatacatttacttattattgaatcatgcttggatatatattgttaaaaaagtttttctcaaagctctacattttctagatctttctcagctccacttagctttcagttttttcgtgctcagtaaatcaaatagacataggaaattttaccagcttctcctccgtatgttcacatttcagctgagaatgagtctaagaaaaattaaatcaaagattatcttataatgctaacaccagtatgtagaattggtgtgtagttccttacttggagaacaattaatatttaattgattttgtgttgcagcaaattattgtttatgtgatgctctccactggttcttaaatttataattactgtgaagtaattctgtttttaaaatcactaaaaattaattgctattatatcaaaagaattattacattttatattgataaaaatatagattttccaatttaaaatcaccatatattatttcatattttccttccttgatgcaccatcttttattkatcaaatgttgttcttagtctttggattcttttaaaagtgtgacctgaagtacctcattgaaccaaacactgtttataattttttattgctgtttcaattaggtactaccacgatttaatttcctttaaagtgatatgtctttactttgaaaccacattaaagatttgtgatctttatagagactaaatgaaacttttttagctgctgtggttcattctagtaacttttgatgattgataagatttcaactaatatttagtttgtataaagcgggatatagtatggtgttttttttccttccccttatgaggcagtttctaccctcttcccacagtagtgtatgctctggattgtatcttggtctagaatttaatattgttttctaatgtcataatatactgtcattatctgatacttgcaaatctagttgaattacccaattatgtcattggattagatttttactatagtttcagtttttgaatgttttatttacatacatatatatatatagagagagtttttttgtttttttttgagatggagtctcgctttgtcgcccaggctggagtgcggtggtgtgatctcggctcactgcaagctctgcctcctgggttcatgctattctcctgcctcagcctccagagtagctgggactacaggcgcccgccaccatgcccagctaatttttttttttttttttgtatttttagtaasayggagttttgccatgttagccaggatggtctcgatctcctgacctcatgatccgcccgcctcggcctcccaaagtgctgggattacaggcacgagccactgtgcctggcccttaaaaaatatttttatgtttacatcaaatctaacagagcttaaacgtaaaataaaataaaaatatttttacaatttgccttttttgttattactaataatggtaaaatagtctgataattacttttaacacctttgaattttatgtcagtgtagtatagattatagaaacacctcgactttttctagttctacagtctgtcctgttttgaaagttgtttctatcaacattgagttttgttttgttttgtttttgtgttactggaaaataaatatgcttgatcagattgttttgacttctgtcaggcaaagaaaatactaaaatatcattcatttttctcaacctgatttttggaacataactgctgttgtccctwaaacttatgaaacataatttctgctatgaaaattttcacccaattttatttttccattttctttagcataactctttttcagttaaccagttgatggttaacaactttgagttactaaattttgaagcaatttttgtaagtaacttttataaagtaaacattttgtactgtatcttctgaggttgattgtactatgaaaacttcactgtgtgagtaggatcatattcgttcactctgcagaagaggtacaattctagccaacagatctcacagctgttataaattcaccagtaaggcatgttttagaagatattatctctgtttacctgtgacctctcctatgctttttttttttaatctcccaaggaaaatctcctgtaattttacactgttacctatagttttatctacttgtaagctgtgggctcagttatttaaaactgaggaattttacagttttgcctctttcttttttggttgaagtagtacaaaatgtcaaaaattagaaggaaggtcacagtggaaaataccaagactatatctgatagcacatcccgaagacccagtgtatttgagaggcttggacccagcactggcagtacagcagaggtgagttgtcactagtatagtcacaggggytctcttagaattctattattgaaatgcttatttgtatcataaaggtgaacaggttgttttattgtaggaatgtttgttcagtaaattttttaaagtgtgttttataaaaagaagtgaaaagggtgataaggtttatgggtttttccatatttttttcctgaagtttttattatttggggrgtaatatatcacaggttagctggaattttggtagcatttgttttaattttgtcccgctagcattttttttttccagaaataaatatgaaatttacatagtaatatctgtctcttagacacagtgccgtaactggctgaagactggcaactgcctctatggaaacacatgtagattcgtacatggcccttcacctcgtggtaaaggttatagcagcaattatagaaggtaaactgagaactttgtrttgttcatgtactattagaagatggcttttgtaatttatctagtrtaaaaatctgaaatacaaccatatatttggtcagattttctatattggtggtagtcttaccagtaattgaagatcgacaggatctttttgttattttcaagattaataaaatgtttgctttcaaattaacttatttgttcattatttatttgttttgacagtagatctttttgtagtatgtgtatggcttactttttcccccctaattatgtattaaattgctgcttaagacagcagaattccatggtgtctgaatttctttttagtgaggctatttttaactcttaaaatagtaaaattcaaatagggtataattttagctgtttaagatgttctgaattcaaattttgtacaaattctataggttaaaatgcatttgccaaatcccttagcacagtatgttaatgaaaatatktatttatatgtggatgaatatgctccatatttcgaacatcgttttgcctttaataaaggcttggctagattaaacttgcttaataaagaccttttatttttcttttggttccctcatgatgattattttatggtatttaaagatgtaatatacataaagtttgtcacaaaaacagttttaacttgattggtaaagaaataatttacctagatccaaaattggttacrctgattgttttggctatagcatagcaacactataaaaactgaacattagcaattggawttttttttttttttttttagttgaatgatttttttkggggtagtgtatgggtagattttgtttaggagaatttaaaattcaaaccctcaacattagccaacttctttttcacgtaaacattgtacattttagtttatttgtgattctgaatactgttttatttgtatttagattgtcatttgtcacttccgttaatgtgggaagattagtgtttattgtatatgtgtgtttacttgtatatatacacgtagatacatacctggtgaaactatttcgatamttttaatgttttgctttaatactatacttttgatacattttaaaatttatctttgaaatttattagctgactcagaatttttattcaagaaatcattttgagaaaaatggtcagagaaatttgtctaaaatgggaaaaagtaatgtcattgctagacttagaataaagaatatttattataattttgctattttgtgtatgattttccatctgataacttctttcgtatttgtgcattttttttgtcgggaggaaaaacatagttcataatgcgagtcaaagataagaaaagcaatgtattttacagaatgcttatttatatgtttatatacaagacttttacataattaattgagaattcgctgtgtgtaaaacattcattctgttgggtgctgtttaggatagaaacaagttcatactaaagtgttttattatataaaggaaaccagggcacataggatttacatgtacatcattataatttagagcacttaagtactggttcttagtaagagattccagtttcaagtttagctttaactgttaaaacatttaatataaatctattacatgtgcatgtaaacattaatgagatcctttaaagtgaattaactcaaattatttctttactaaccttatgatttatattcataaaatcaaggaaytgatttgattgcycaatgactgcttgaaatagatgtgaatatttatgtgatttgtttatatcttttttatatatagtactttttggtagtcaaagaggaacagagcattccttaacttcttttgccctgttttaaaggtgttgtagaaatagtctttaaaggcagtctgttttccatctctcctttgttttttcccactgatagtgaaaataattgcatagccatatactgtcaaatttctagtataaataataaagccttaccactgttgagtataaatatgtatttttcctttagttaaaaaatttacagcagaatatgaaaatcactgttgtaaaattgccttgaatcctttatctttattctgaaataatttaaaatttaagataaattttaaagctcctatatttgctttgattcttacttaaggtacataaaatattttctcagttattgatgttgcatccaaccacaggcatgtgtatacaagaaacttatttcttgtaatatcttcttatatctttcagtataaatgataatgctgctacctctagattaattttgcaactttgtagtttaaaactttgtgttactactacattttgctcccacatataactaatatatttatgtgattaataggaaaacaagtcaagctattagttcctttttctcagttcacatataatttcttattcacatcaccagtacctgccacttcgtggaatttaacatatacattttgattgttattgggagaaaaactgtaagtgttgctcgtgttttgcatattaatatttaaggtgaaatttttcagaaattcaggagtcaaggtcagttagaaaaagtgtattgagatttgtgaggttatttctgtaaatacattcttataaaatgttattaatatataaatacagakttttgttgttttgtttcgttttttgttttgtttctgtgttttggttcaaaggtcaccagaaagacctacaggggatcttagagaaagaatgaagaacaagcgccaagacgtggacactgagccccagaaacgaaatacagaggagtcatcctcacctgttagggtaggattgaatttcccaaaacaaagttcaacttcagtagtgatttgttaatttgagtttcattttaaatattgtgtgctaaatatatggtaaatgtgtaatacggcattataatgttctatatggataatgtaatttagagggaaagagtcccctgggaaaactgtgattggttcagttctttatggtagttaagatgaaagggattagttggcagaactcaagctgaacttagtagggattttgtgtagggatcccttagtagggatccttgacgaggatcatgagtatctttaagttttcagaattcagccagccatcacatctgcttccaagaaagattgaagtggcttgcagtagaacacttacaaatgaaaacaatgaaagcaaaacacatggggttaacaaactgcactagaaagttgaggtaaaagaaagcacatatgaccacaaattttagctgtgaatttgttggcagtgaagccaagagaaataaaatttataatgtagttcattgaataaaagaaaagtgtttgtcaggaatggaaatctttcccagagctaatttttttctagaaatttatcataccatatttcacataccatacagttcactcattaaaagtgtacgcctcagtggtttttagtattattagagttgtgaaaccatcatcacagtcaattttagaatattttcattgctacgtaaagaaacgccaaacttttcagcagtcgccctcctagccaccagccctaggcaaccactaaatcctctttctctctctagagatttgcctatatatttcatataaatggaataataaaacatgattttttgtgactagcttttttcacttagcataccttttcaaggttcgtgaaagagtatgggatgcatcagtattttattccttatttttgtcagataatattacattgtattgataatatcacattttgtttatccactcatcagtgatggatatttgggctttttctactttttgactcctgtgtataatgctgctatgaacatttatgtacaagtttgtatatggatatgtttttatttctattgggtttatattgaggagtggagttgacaagttctacggtaactgtgtgtttaaccttttaatgaacttctagactttcattaagtggctgtatcatttcacattgttgacagcatatgaaagttctagtttctgcacatcatcaccaacacttttgttatctaactttttgattatagccatcctgatgggtgtgaaatgatgatctaactgtggttttatttgcattttggattctaatgatgttgagcatcttcttgtgtacttattggctatttgtatattttctttggagattcttttcccattttaaaaatcgagttgtctttttattattgagttacaagtgttctctttattttggatacaagtcccttatcgtatatgtaacttgcagatcttttctcccattctgtgtgttatcatcacattcttgatggtgtcctttaaagcatacacatttttaatttgatgaaatctgacttacctgtttttgttttttttgttattattgttgcttgtttgtgcttttggtgtcatctaagaaactattgtttagtccagggtcacaragatttacgtctatgttgtctttgaagcattttctggttttagctcttatatttaagcctttgatacattttgagctaatttttatttatgatgtggtaaaggttcagccttattcttttgcatgtggatatccagttgtcctctattatagtctttttatgaaagttactgaattgtaactgaatcaaggaagcaacaacttccttgatcacttaaattatgtagaagttttctgcagctgtttttgacccatggtaaaaaagccctgacagcattataatttgtgaaacttatttcttacaatacagttttaagtatttagttttctaatgtctaatgttatacagtgatacagtcttaaaaatcttaaatagttctcagctggaggtttttatcaacattccttttgagggaagatctttttcaaaatacacatgccaatattccacccctaatctactgaatcagaatttctgggttggggctaagcgtgtgtattacattttgaaataacctattgattcagaataacagatgcctcagcggtctgccagtaaatgtaccgctactctgaaaaaaagaaagccatgctttctagggtttgccccttcttttatgtaaatactcccaccatggtcagtttcaagctttcaaagacatcactgacagatgcatagttgggaagagatgctaagtgacattgtatacagtgttcccgttatgtatattataaacagacacacaaaatgtaaataacctcagaagtaaaatttactatgagttctgagtacttattatctttgtttttaatacagtttatttgttcaatcatggctgtgtttaacagtggcttccagaattcctaaaaatttaaatcagctcttatgagtcagtacagactgactctagcatactactagatgaattgttattagtataaggagcaaacatctggaatccatatttagagcatattactttaggaattgttaaactcttcttcttgtctccttatccgtaaaatggaaatgcaggctgtccatgttgctgtgaagaatatacatgtaaatgatttactattccatgatgacacatgcgtaataaatggtatatactggtattgaaatggcacttagctttttctaatataaattgtctttaggctcttatagaagatgaacatcagccttggagatttaggttgttgacagttaactgaatgtaagtgtgttgtttatcataagggtttttatgttcatcaaataaagttagtacagtaaagttggcattttgttaagaaatttaaagcctgattcttgctttccctagatgagaaagccctcaaaggcactgagcatcgtgtatacctaagggatagagttacaaatttcaacagtgatcaggttttaggtaatacactatctaaacttaaacagaactgttaataacctgggacaccaggatattaattattatttattagtattcttttgagacagagtctcaccctgtctcccagactggagtggaatggcatgatctctgctcactgcaacctctgcctcctaggttcaagcgattctccagcctcagcctcccaagtagctgagattacaggtgcgtgccaccacgcctggctaattttttgtatcttcagtagaaatggggtttcactatgttgggcaggctggtcttgaactcctgaccttgtgatccacctgcctcagcctcccaaagtcctgggattacaggcatgagccaccagcaaggtattaattatttttagtgttatatttgacaggtaacagatacygatcatttttatggtgcattcttgctgcaacacatgactgttgatcttcatgtaatgaatttctctaggaagatcaggcctatgttaggtaagggcaactgtggaatagattacataggcatagctaagatagaatgggtgtgattttcagcaaattagctgtaattcctcctcttctctgtcactgatgtcaactccagtgtgtttgaattatgaggttggtaacccttgatcttgtggttatcaaattcataaatggataacttgtaattctgtagcatgtgatagtgtgtcagaaagatacgagcaaaatgcacaatggagagagtaagtaattacctggagaaccagggacctcttcagggaaaatgacacttggactggtgttgaaggatcgacgcggtgtcagaggggagggaagaagagaaaaccaacacaagaactgtaaggagttttaaaggactaatgtgtttgaggagcttgtgaagctgtgtgcctaggttataaaaatgataacatgtggacgtgagatgaaggctgaagtagattaggaccagattatcagtggtcttgtgtgccaaactcacagtttagcaatagagaaaagagacatgctgagatctgtcttgctcaccagtttacctccagaccctggaactagtaagttcacttactgaattaatggaaagtggttctgatatgcagccatgattgagaaaccctgctgatgtaaggtctgtgctgtcaaatgtgggtagtctgaattgaagtgtgctgtaaatataaaatacatagtgaatttcagagacttagtatgaaaagaaagtaaaatatctcaaattttaaaatgtagattatatgttgagaggacaatgattttggatatgctgggttaaataatgttatcagtattttaattttacctttatctttttttctttttaatgttacaacaaggaattgtaaaattacttaagtgcttgcatcatgtttctgttggaaagggctggtctaggtgatgtgaatcagacaatayggtggaactgaaaagtgagaggcttatatgaggtagtcagtaggaaatagttgcatttaatcagtagaggttttcagattaaaatggaattgtattttcattttrtattgcagagacttgttattttatggaatttgagcacaaaagataaattagctttgaaagcaaaattagacccctaaatatagtcaggaagaatattcaagcatttattgatgacggagacatacaggtgctgtagggcatccttatctcttagtagaagctttgtggctgcattcaagaaagaattagataatttgtcactgtgggaagatacctaatttaggagttagaggtgccctatgagtattgcttacctaagtcttacatcagagcaaatgggcaagagcagtggtctaagtttatttttctttattgatctttgtttttattttcatttttttattgtggtaaaatgcacataaaatttactattttaacaattttttgatgcacagtttattggcattaagtacatttacactgttatgcaactgataccaccattcatttccagaactttttcatgatctttgtttttaaagtgtttagttttttgttgttgtttattcgtcctcatatacaatattaaaacaattgggatagctgagtgtggtggctcacgcctgtaatcctagcactttgggaggctgaggtgggcagatcacttgaggccaggagtttgagaccagactggccaacatagcaaaaccccgtctctactaaaaatgcaaaaattagccaggtgtggtggctcatgcctataatcccagctactcgggaggctgagccaggagaattacttgagcctgggaggcggaggttgcagtgagctgagatcatgctagcctgggtgacagagtaagactctgtctcaaaaaaacaaaacaaaacaaaaatgacaattggaataatattttaactgatgttaattttctaaatgttaattatttcaactggttaaatactttttctttacctgttattttaataactttttctggttcctaaaaagtaatttttagaggttttgttttttttcttttccacctcgaggtttttcttttgagacttcacaatgttgttctctttcccttgtccactgttttttcaaaggaccatttctgtcatttgtttatgtttcctaccccaccccaacctaattgcttaccttcaaacagatcatttgtttagacttgatatttatcctgaatttatttaagatgactacactcaaattactttttcaattctcagtctataggtggatctcaagttgattatccaactttaaacctattccaggtgtcttattactgaattgaaaatgtatttctagtatgaagtttactgtctctggaaaytgtacctcctagaatgcccatgcaattattagttttgtttcacagttgcctcctcagttctcttactgccccccgacatcccctatcttgttcttttttttttttttcttgacacggagtcttgctctccctctcgatctaaagtgcaatgatgcaaacatgattcactgtagcctccacctcccaggctcaaacaatcctcctgcctcagcctccaaaaatgttgggattacagttgtgagccactgcacttggccttaccttgttctttttctgccatcttgatatttctgtctagatgagaaaaaaaaatggcactgactctagaggaagggataatactgtagctgttagaattagcaggactcctgcagtggaggacttttaagttagaaggccttaacattgttactaactatatcttgagtaagtctcttgactttgtcttttaacttgtaggatagatgtacctgccccagtttatcacaagttatggtgagaaccaaatgaagaagtacgtataaaattctttggaaataataaaacatagtttaaatgcaaaatagaaatagtagaaagtcaccaaagtaaaaatttaggaagctgatcactgtaggggtaaatagatcaaatgagtgttgtttgtttatttcaaaagaaaaggcttagaaggataagagtataagtagaggtacagtgtatctaccacctggtggaaatttggtaatgaatatgtagtacggagataattatggtgattttccaacatagctatatattttcattttatatggaaaaaacttttaagtttagcctagtatgatctgcagatgtattctttgatagcattaagagttgttccagttgctattccttgatgtaaaacaaccatttattatgtgctcaaattctgtcaggaattcagaaagggcacagcagggatgtcttttctcttgatctgtgggcctcagttaatctactggaagcacgtaggctggaatcacttgaaggtttatttactcacctgtytggcagtcgatgctggctgtcagctagaggcctctgtttgtctctatgtggtctcttcccttggatagcttgggcttcctcacagcctgataactgaattccaagggttagtattctgagacacatgcacactggcacacacagcaagggaatgagcatgtgcttgtgccctggtttcttttattgtagaatggtattagtaaccaaaacctgggcgttagctgtgtttgtgctagtggggtattgtttcttttaggacctctcagctagcagagcaaataaatatatgcgtgtatactaastggtatatataaatatttctartgaccatctgttatctgtattaagctaaccatgagtttttactgatttctctaactgtaatccattcccactattagtatttttatgcccagatgtcccttccttagcttgtgggtgatctttgtattggatcctgagccttttttttwaatttactttattgaaatataattttcaaacattgaaatgcacccattttaagtatacagtttgagtcttgacagatgtgccacctgtataactaccaccacaatcaagatacagaacatatctgtcaaccgaaaacatatcttcatgcctttttgtcatcagtcgcctcccaaactcactcctgataacctctgatctgtcactgtaatggaatcatatatattatcgtgtcttgattctttcagcatagtacttaccagattcaaccacattgttgcatatgtcagtagttcattccttttattgctgattcatgttctattagatggatatatcaaaatttgtttagccattctccagtggatggacatttgagttgtttctagttttcacctattaagaataaagctgctatcaacatgtgtatatatgtttttgtgtggaaaagttttcttttggtaaatatctaggggtagaactgtgtcttatgtatatttttaactttataagaaactgctgaacagttttctgaagtggttgttccattttgcatctccacctacactgaataattttctctctgtattcttaccaacacttggcattgttggtctttttcatgttagcccttctagtgggtatatagtagttttaattttcatttcttaatggttagtgatgttgaacatcttttcatatgtttattggctgtttctgatcttatgtatatcttttattggctaattgtttatttgttaacatcttttgctcataaattaggctctttgtcctattaccaattggtaatattctgtataccaatcctttgtgagatatatgtattgcaaatacgttttcccagtgtgcagcctgcctttttatttttttttgtggtgtctttcaaaatgtctttcaacttgaatgaagtccagttatatcatgttgttttgagaccactttagtaatcctctgtagtttctttgtttctctgaagatcacgtattcccagcacattgtgtatttcatactatatatgtggaatcagccattttcctcaaaaaacttggttccttttactgagagtacttgaaagcttttaccgctagattagtcattgtctttggggcttttcattaggcatacctaggaaatgcgtatagatcttctctttaaaacagacaaacatgaattcaaataattcagatttggactgcaggacttttacttaactttgattttattgtatgatttttctcttctgctgaaaattttggtccctgttgacattattcatttgcctgaccttacattacatttaatagtttcagaatagcaactatattattgctaatagtgttatactgagctcaacttaaggtttctatatagttcttaagatatatcctattaagataatattgttaaatctgtctattaggaatatatagtcaaattcgtacattttaagttacttgaaacaggtcttctctatgtggttaaaccaccaaattgatacttagttgggttaactgaaataatcagataattacaagtaattttgaagtttttagatttcttttttctttcattttctaattacataaaacgtttacatgatttcaaagctaaatttacaaaacagttttacattcagaaaagtctttaacttctgtcccatgattgctgtacccttttccctgtaggtaaccacatttattagtttttgggtaatccggctgttttaatacacacatatatatwtttaatatttacatatatatgcacacaaattagtgtatatataatcaccttttttctttttcttagataaaaggtagcattactgtatacatttttcttcaccttgcttttttaacttaacactgtaccagagatcattctatagcagtatgcaaagctatatcttaagcttttttatagttacatagtatttcattgtatgattgtatggtacattattcaaccagtcttctattagtggagattttaggttatttcagtcttgccactaaaagcagagctacagggaatatatgcaattgttattttgcatttttgtgtctgtgtcttagggaaatataaatctctagaaatggaattgctgtgtcaaagggtaaatgcctacataatcttactacataatgacatttgcattgttgccagcagcacacagagccaaattactttatctttgctttgttagtatgtgttttcaaacttgtctttttgccartttcatagaaaaaaatgttatttcatcatagttttaattatgtttctcttgtgagtgaggttgggcatcttcatgtatttacaggtaatttactgtatcccctgcccattttctctgtttttttttttttttttggtctttttcttctctgttttaaaaattctgtattttagggaaaatattttacttaagatatcaagtacagataattttacttgtcacttttctggttttagaaaaacactatgttttatacagttttaggatcacagcaaaagttaatggtaaatacagagatttcccataacacttcctcccccagcatatgcaggacttgcaccactatcagtgtctcacaccagtggtgcatttgttgcgatcagtgaccttacactgacacattattattactcatagtccacagtgtaaagttcggctattctgtttatttgtccattgacctaccaaaggacatgttggttgcttccaagttttggcaattatgaatacagctgctataaacatctgtgtgcagatttttgtgtggacatatgttttcaacttctttgggtaaataggagtataattaatggatcatatggtaagaatatgtttagttttgtaaaaaactgccaactatcttctaaagtgactgtatcattttgtatttccaccagcaatgagtgagtttcgattgctccacatcctgccagcatttattgttgtcagtgaattgaattttgactattcagataggtgtgtagtggtatctctttgtggttttactttgtatttccctattagataagctcttgagcgtcttttcatrtacttatttgccatctgtatatctttggtgagattgttcaggtcttttgcctatttttaaaaacaggttgttttcttattattcaattttaagagttccttgtatgtttttggtaacagtccttattgcatatgtcttctgagcttatttttcccagtctatggcttgtcttattattttgatggtttttttaatagagtagaagcttttaattttaatgaagtccagttatcagttatttctttcatggattatagtttgatgatgtgtctaagatgtcattgccatacccaaggtcatctagatattctcttatgttactttctaggagttttattttttttgtcttacattaagatctrtgatccattttaagttaatttttgtgaaggctgtgaggtctatgtctagattctttttatttatttatttattttttttgcatttggttgtccggttgtttcagcatgatttgttgaaaagactatccttttttcattgaattggttttgcttctttgttaaaaatcagttgactatgtttgtgggagcctatttctgggctcttattattttccactgatctgtttgtcatttcttttgcccgtcccacactgtcttgattgctatagctttataggaagtgttgaagtcaggtagtgtcaatctcatgacttcgttcttcagtattgtgttggctattctggttctccatatagaatgagtatgtcagtatctacaaagtaacttgctggggttttttggtggggattacatttaatctattaatttgggaagaactgacatcttgacagatatgtagtcttctgtccaagagcatggaataactcttcatttatttagttctttgatttctttaatcaattttgtaattttcctcatgcatgtcttatgcatattttgctagatttatccttaagtatttcatttttttctatactgatgaaaatggtattgttttaattttaaattccacttaccgttgtatataggaaagtgattgacttttatgtgtattagccttgtattctgcaacctgaactaatctatttgtcagttcttttgcccacccrcagtcttgattgctatagctttataggaagtcttgaagttcttgaactttataggaagatcttgaaaaaagaactaattcctgaagttcttctgttagttctttcagaatttctacatagacaatcatgtcttttgcagacacttttgttcttcttaataatctgtattctttttatttccttttcttgtcttattgcattagatagaaatttcagtatgatgaaaaggaatagtgagagggaacatcctttccttgtttctcatgttagcaggaaaacttctcatttttcaccattaggtatgacgttagccgtagggttttttgtagatgatctttatcaagttgaggaaattcgccgctgtttctaatttaccaagagtttttattatgtctgagtgttggactttatcaaatgcttttcctatagctattgatataatcatgtgagttttctttgttagtctcttgatgtggtgggttacattaattgatttttgaatattgaaccagccttgcatacctaggataaattcttcttggttgtggtatatacattgtgggatttgatttgctagctttttattaagtttgacttttaaaattatatctaatttgcataacatgttatgatacaaatatatatagtgaaatgattccttcagtcaagcagatttccatatccatcattttatatagttactttttgatttgctaatatttttgataaggatttttgctattattcatgagagatattggtctttagtttttttgtaatgtctgtgtctggtttcagaattaggataatgctgacctcatagaatgagttaagaagtagtccatctcggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaagaagtagtccatctcttctgtctctgaagagattatagagaattggtataatttcttccagaaatatttggtagactttacctataaaccatctggtgctttctgttttgaaaggttattaattattgattcaatttttaaaatagatatatacctatttaaattgcttgtttctccttgtgtgagttttggcaccttgtatttttcaagaattggcccatttcatgtaggttgtcaagtttgtattcatgagttgttcatagtatacctttatcatatttttaatgttcatgggatttgtagtgagatccctacctttgtttctcctattgataatttatgtcttctctctttttttcttaattagcctggctagaagctgataaattttattgatcttttcaaagaaaacagcatttggttttgctaatttttctctattgaatttctgttttcgatttcattgacttttttcattctaattcttaagtttattttcttctgcttactttgggtttaatttgttctttttgttgttttctaaggtggaagcttaaattaatgatttttggttgtcttttctaatatatacattcaatgctataaatatctctttgggtacagtgtttactgcatccaacaaattgttgtaagttatmtttttattttcatttagtttaaaatattttaaaaatttttttgcaatttcttctttgaccaatatgtttattaaaattgtgttgtttaatttctaagcatttggggattttcctaatctttctgttacagatttctagtttaatttcattgtggctgaaagcagacattgtatgatttcttttacatttgttaagtgtgttttatggcccagaatgtgatctgtcttggtgaatgatctgtatgagcttgagaagaatgtgtattttgctgttgttagataaagccatctataatcaattatatcaattttgttgatggtgctgttgagttcaactgtgtttttactgacttcctgctgaatctttccatttatgatggaagggtgtgaaatcctcaaccataagagtgaatttctctttgcaattttatcggtttttgcctcaggtattttgatgctttgatggtagggtcatacacataagaattgttatgtatttttgcagactggacgtctgtatcattatgcagtgctcctctttgtctctgataacttaccttgctctagagtctactctgtctgaaattaatatacctactcatactcttttttgattagtgttagcagtatacctttcttcattcctttacttttaatctattaatatatgtgtttatatgtgggtttcttgtagacarcataccattgggtcttgtttttccatccactccgagaatatctrygttttaattggtgtatttagaccattgatgtttaaagtrattgttgatgtagttgaattaatatctacaacattcgttactgttttctcttcattgccattgttctttgttcctgtttttgttctcacttgttttgtgccttttttggtttaaaatttgtggttttaattgagcatttatgtgattctttgttcattcttttttagcatatcaattatacttctttctactttttttggtggttaccctagagtttacartgtacatttacagctaattcaggtctgctttgaaacagcactatactacttcatctataatacagataataacaaaatattcccagttctttactctgggatattttaaatgcatttagattttctgctctttaaaggattggtaaaattcccctgcaaaacccactgggtttggtactattttatgaaggagttctttaactggctttattttttctttgaaaaatgatgtagacttttggttctgttaaagtcagttttggcaaatagtatttttctagaaatttcagccgtttttcatgtaagttttcaaacttgtttgcatagagttatgtaaagaaatctcaccagacacagtatctcaccaggcacagtggctcatgcctgtaatcccgcactttgggaggccaaggcaggcagattgcttgagctcagaagttcaagatcagcctgggcaacatggcaaaactcccatctctacaaaacgtacagaaattagccgggtgtagtggtgtgtgcctgtagtcccagctacccgggaggctgaggtgagaggatggcttgagcccaggaagcagaggttgcagtgagccaagattgcgcactgtgctgcagcctgggtaacagagctagaccctgtctcaaaaaataaaaaaaaataaaaaacacctcatagttttattttttcattttgctttgttcttagagatacttttactttgtcatttaggattttgaatttgtgctttctcccttttttcttgtttaggttagccagtggtttattttcagagaatcagcttttacatttgtatattagttccttctttgtgctttctaacatttatttctgggtctttaaattccttctttggttgcttatttttttgttgttgttgaatttgttgaacatttgttttcatttttatttatgttctttaatgctgtaagttctcatcagataactgctttagctgaatctcatgaatctcatatgtcaaactatgacagttattttcgggaagttctcctctttagatttggattccacccattatctaagaattgtttaatggaatgttaaaattttcaggttggagggccttttgttttttacgtgtgtatgtgtgttttcttttgatttttaaaaagtaactttcatgtttttcttcatatttttgaatttgatgagattttctttgtagcctaagacagtcactttttctcaattttccacccatgctttaaaaaaaaggtgtattttctagttcttggtttttaggttctataaatatatataaaacatctattctttgggcatcctatatttttaagattcttctttatttgatctattttggtttgagaacattatgttaaagtatcttagtagtaggtttctgtctcttttactccatatcctatagtttctgctcttcactactgtattattaggtacatagatacagaagtattaactatttctttttcattttaattctttttgtactttttagagatgatgttattttggttatctgtatatttcttacttgttttttctgagatgagctaatttaatttatatgagcacttcataaaaagattctccaataatcctatttgggtatttttctttagtataaacaaaataaactacagtttcattaagtgtaggactaaattactctctttgtttctataatattgaaaggatctgaaactgcagatctgtgaataatttcaaaatttcaaaatattaggtatatatattctaaaactgtatatagactgagcaggctgttggtctaacgttcaggccaaagcacaacaatgaaccattctactagattaataaagtttttttttttttagctttaatcagatgtgtccaattataaaggtttgaaaacattaaggtcgaaaaccctaatctttttaaaattaataatagttgcttcacttgttaataattttgggataccacatgacagtaaataacagagaagaaaaattggtattaacattaattctagagctgctcaaagaaaatccaggaattggttgataatgttagtgttctktgaaactaagtttatttttagagcaataggatttgaaatagcattattcttttaaaataaaatgagaggttagacctggtatcgtggatcacgcctgtaatccctgtactttgggaggctgaggtaggaggattggttgagtccaagagttcaagaccagcttgggcaacatagagagaccctgtctctacaaataaaaaaattttttaattagctgggcgtagtggtatgtaccagtagttccagctgtgggaggctgaggcaggaggattgcttgagcccaagaggtcaagactacagtgagctatgattgcgtcactgctcttcagcctggatcatagaacaagaccctgtctcaagtagatagatcgatagatgggatagatagataagatcaataagataggtagatagatggatgataggagaagaaaacaaagttttgcgtaaaacattgaatgtttaaaatcctctgatgtcaatataataaatatggaattattacttgaatgataactttagtagtggatagatttgtgtagatgtttataagtgaatattagtagcaggtgagaatgttattgacatacaaataattgagtcattctttgactaaatgttctgagataatttttgtatattaacttcaaaggaaatttctccaagtaattgtggaaagatgtaagtaaatccaatataagaggtgtgattatataggaagctcagaaactgttagggataaacatggaattgattttaggcatagaaagttaattgcactggtgtagaatagggtgacttgacctgacaatagttgccagctgaagaatttctccagaattcatcacataaagagaagttatggaaagtattgacaaggtttaaaaacatgggggaaatacttagaaaattcaatatgcatctagttggaaacccagaagaaaaaaaaaaagaatgttggagaagcaacattttaagaaatagtagctgagaattttccgtaattgatgaaccacaaatctacagatacgagatgtgcagtacatgagagatagaatattataatgaaactgcaaagcatcagagacatagagaaaatcctagaaacctctagatacagaaagacaaatccccatgcaaagaagcaacaggatgacatcagtaacaaacaatggaagctaaaaggcagtgaaataatattttcaaagtactgagataaacctatcaacccaaagtatgtaccaaagtctggctttcaggaatgagaataaaataaagaccttttcaaataaaattgagagtgtttactaccaacagatcttcactaaatagagaatatttaaaaggatatacatcaggaagatggaaaaagaccttagaagaagggtcggaaatgtgaatagtaaaggagaaatttttattaagttggaaattctgtcttgttatagcctttgaagttatcaaaagtgtagcattgtaccatgaggaagtgaagtgtactatgaagtgccaggcagatcactttggattccccagaacccgttccaccactttttcattttgtatcagcattgtgatttggggaattgatcccactttcatggctgggccttgattagtcgaatccagttagaataatcccattctccttgctaattcaattgattcaggaagcaggcctaagccatttatcccatggctattaccttgatagttattcattcataggtggccatgtgactgaagttggcctagtcactctgaaggaaggaattcttatttgtgcttgtgggagagatacactgaggagacccagattgcttcttattatggtaagagataagctttaatgtgaagtcaacattaggcagagcggagctgtgataaatgaaaacaagagtgaatatttggtctttgatgatttcactgttactaagtcacttaggcctgaagtttaccctatatatagacttcattttatgtgaaataatagttcaaatttgtatagtttaggagattatagtttcttagttgaagctccatttttctctgctaaaacaagttagacttcattaatacaagtataatttcaattctaagtcaggggagttggaagctgtatgctttatgctgttctgacaagactagattaatttggggtatcatgtttcattgaagcacactagccgattaatatgcccagagaagatgacagaatgatgaagaaagggctagcacgtgaaagaagtattagatttgttttgcataattccagaggttagaactattcccaatcagtagaaattgtagggaggtagaacctctagagaggttaagaaagatgcaatgggcataagaaataattttctaataattagaactgtctggaaatgggaagaaagggtgcaacagcacagagctaagatttttgcccccaagagtcttgtaatagagggcttccatagctatacaaatattgtggaaaattgttctgcatagggtaggaggttggattatattacttacacagcctcctaaccatttttatactctagttactaataatggttctcaactctcttagccttgacacttcctatttcatattctttgtaatgcttgcttttyatctaaaattaatgatgaacataatctgcccacgcatataatgttcaagaaataaatgtgcatatgagagtggaaatgaaagtaatataaacatctaaaatcatgtattacatttctgaaatwcaaaaaacttcaaacatttttcctaagacacagacatttgggagcaaaacctggtcttaattgaaataaatttaattacagtttttatacaagtggtgaatttctgtgttttgctgcaaaaatgttagtatgtttggtcacaggctactgttccagactccactggaacagtagtactacttaatatgctttgaaatgcaaaaaaaaaaaaaaattctgaactcttaaaatatctgatcccaagggttttggctaaaatactgtggttcttcaagtatttcaagacttagatgttccaggatgactaatttacaacacatagtaatcagtaggttatacttttaattaatatgtttggatttaagagaagatgagaagccattctgttcaagaaatacagcaaggtggaatagtagaccgtgctacactacattggacgagtaataccataccctatttatttgaatataagagaaaagggggaataactttgtttgataaaaggcataacatacctaaacaagttacacattgttgaagtgggggaaattaggaaataaggtattttttaaattagctagaccttcttaataaatgttaccaaaataatttcctatattatgatttgaggtaagaacttgaaattccatcacctatttaagcctgcattcagtctctagtacctaataatagaagttatatatgatctctgggagtagcatcagagtcatattggaaaacatggacaattcaaaaattataattttaatatttagggtaaatatgaaatatttacagacatcattattaatgacatttattgatacaacatttctggctctaaatctgataaaaaatgttacaaatttatagattgattttgcagcaccagcactactgctctgacaccctttttaactagacttrcaattggattttacatacttttaagtggacagaaagcacagaatatgttatttaataatttggagataacctcctattaaatatttttggtatagttattcagtaatgtatatttacagtgggtttaatccacagaacattcaaaaattgtttgggatgtaggatagttcttcattgatgttccacataatatgttttaagagtaaaagtaaattatatttcttccttttgtcttctgttcaagtagaggcccatttctgttttcttgactcttcaccatttttttcatgrcaggttttattctcatataacttacaaattattttcgtcagcctctgttgtcttaccagcaatcaaatccaaattttgtcagtaatatttacagtatgacttcatgcctaaatatgtagaatttaggggcagttatatatactagagttctttaagaagaaaactacaaagagaaattaatttgtgttttaaagcagccaaattttatgattagtaatgctcagaaagaaatttgagcacttaatatccttgtgtgtaagtgtctttcatagtatttacaatgttagtaaaagtaagacttctgctgtggtggaagataacaattatataacwctggttacttttattttcttaccacctagtaaaatatgatttggagttcttatgtaataggacatttaattgacttttataatctgaattaattttgtccttttttgtgtgtaagctgcttttatacctggaataaaatgtaaaacctgttttttagcagcagtagtgaggactaatttactattttaggtaccatttggtttcatcaaaatgggtaaaatatatttttgtaaacctttataatactattaaatgagtttggatttatccttgggtgtctaggaaaatgacaattacttgaatatatgacaagtcctagatcagttatttttagaagtctgtggtgaatggtttagcccttttttgacattttaaaatataatcacttacaaatccttccattgtattttattcattttaaactgtcttttccccagtggttttcacgtggaaacttactgtgtagctgaatgtcacaagtttgttaaagtattagatttgcattgtatatttttacatcttagctactctttaatatttaaagtttttgttctttagtaaaatagatgtagtatagtctacatctcttttagtttttgttgtttagtagtttttgttctttagtaaaatggagtatagtcttttcattgtggtgctaaactagaatttgtcactttctctacttagtggataagtgactatttacaaaactgattctttgatgaaacagagatgaatgaaattaaaatgttctcttattacaataaactacctcataatttttaaaaatatagtaatctgaatgtatgtatgtacttttttagaaagaatcttcaagagggagacatagggaaaaggaagacataaaaatcactaaggaaagaactccagaaagtgaagaagaaaatgtagaatgggaaactaatagagatggtgagtttcagaatcttggtttaaatggcgaattcttgattatttactttctagagttttcgtgggcttcagaacacctttcgactgtgatccctctcgtttcagaatcattttattgacatatttctatcttactgaattataaggcaaaaactggcatatagtagctgtacaaaggcagagaaagtggtttgcattgcatatttttattttcccttcctagttttccctctagaactttattgtgcagcattacagcccttcaggattgtattgcatatgtaaatttaaaaattcctaacgctaagcttaaaatgaaatctatatttgttttacataaaatattataaatgagatttttaaatcttaaggacttgggaaagttatttccaagaaatgtttgacttttatctttcagaagaaatcaaaatcagattaagatagagacctggatttattaataaaaaattagcaaaaaaattttttttcttgagacatgctctcactgtgtcacccaggctggaggacagtggtacaatcatggctcactgcagcttagcctcttgaagtcaagcagtcctcctgcctgttatctcagcactttgggaggctaaggctggagtaccactttagcccaggagtttgagaccagtgtgggcaacaaagtaagaccccatctctacaaaaaaacaaagaaattagcctgacatggtggtgcatgcctgtgatcccagctacttgggaagctgaggtgggagcaaaatcatttttgagtcatcaataagcatttattttccaccccttgaatgttttctccacctctttgatgttctgaaagatgggcactgtaatgtcatattaccaaacacagagaaagagaacttgtatttgttaaatgcattgagtgggggtggacaatttaatgtaatttatataattgtcttattatttcaatagctttgttactctacttacagatgacaaaactaaagatcttaaaaatttaagcaactttttcagtgagaagctgaaaacttagaccagggattagaaaactagagtgtgtgggccagtcactggtttttgcaaaaaaagttttattggaacacagccatgtccatccatttggttacatattgtctgtggctgcttttgagctacagtggccaagtcgagtctttatgacagagaactgagaagctacaagactacaatattaactactatatttcagaattatctctgaagacttaatagactaacagttgtaaagtattgtaaatacatctttccagtaattgttacatcagtacttaaaggaaacctgttccatctttggacagtgctgttaaaaaattgcttctaagaacaaataggaaacttgtttatggttactcaggatttcataatccaacctaataccgcttctacaaaatagcaataaaggcagctatactctcccattttagttgactagtatatttaaataaaatattataaaccataactgttcaagtttggagagctaacttttcctaaatactaaggggttaccttttaacacacccaagcatcctttcttttcattttaatttttttgcataaaaaacattttaaaatgtatttgatacttcttatctttaaaatattttcagttgtcattacaataattagtagttgttgaaaatataaaaggttcagaaaagcccaagtctgttctttttcttcctggtaggtatgtcaaaccttctccataaatctatgctttcatttctcttttttgctatctactaagcagagacaatggaaatctttaggaattccctcaacttcctcctaccacaccttcaaactaagtttttatttgtgcctaaacttttttacttccctcttattctgtgtaagaggcctccttcctgctgtataaggttgatgaataattcccttgtattgtagatctgatttcctcctgcctcagcaatcttgttcatttgtgatacactctcttctatatctttaacatccattttctctcctccctattttactgttagtcactatcctgcttatccccacttaacaactaaattcttaaaacagttctgtgccttactgtttctacttgatactgtttcacctgatacttattattcagtcttctgacccaactctccactaaaactgcttttcaaagtcactaatgacctcctcattgcagaataaatggagatgtacttgttactatcctaaatggcccttctgcagcatttgacacatcaagagctcctgttttcttgaaaaagactcttcttttggcttctatttatcactcttcagttttgtatcttcctgttcaagcccttcagtcttacacggaggctccttgtattctgtgtgccccttaaatgttkattcccaaggatttgcacttaactatattcttttaaaaaatctaaagtgattttatttcaagagccttttatataggaaattcttttaaaaggtgagtgtaaatgtctttaataagaatttcttatgcttttccttgattgaaacgcacagtttttgaccattgtgtatctctgtgatttgaaartatctgttgagggaatattgaagcattgagttaagtgccccactccctggatagtgagactaaactggtttcatagacttaccttctgcattgttattctatctggaataacaattttagctggattcagaaaaaattggtatatttataaactttctggtttttaggccacttttatatgctttttcagaacccccaaataacttttatccttgtgtattttatgtttccataactgccatattatgaacctgagaaaattttttaatatttatgtattcrttcatttaacaatgacatataaaaatccattatatgcttttatgaaaaataactattttgcaagcaaaaaataataattgtgaggaggtggcagtgttttgcatcattttgyaaattgttttaatatctggcttaatagttgataggtagattttcttacctgcttctacattccacctgttaaccacatcacatattctgggaaactccactatctactcatgggagaatgagtacaccaggcaaacaatgtagtgttatagaaatagtctgattttgtagaactcctgaaattgtctcagggacctcctaggtatcctcagaccactctctgagaatcacttgtctgtaagaacagcttttaaaacttggttgttttcctgttacctagccatcttcttttctcactttcaatttttccttctagatgaaatcatgcacccagtgcttcattaacgtcgtacgtgtagtgactccaaaatctggagctctcaatttagcattgaccaactgggcatctccatctgagttatgtatcttaagggcatcacttttcctaccagataccaacagtcctgagagtcatcactgacacttctttccctccacccaggcattaccagatagatatttttatgtacccaataccattgaaaaccatctgtttctcttgatatactactaatattctagttcttaaggtatttatttattgcctataaatagattttaccaaaataacctcctaatcccatcccttgcttatagtcttgtctcctaattaatcccccactttaaagcaagaataatctttcttacaaagtttttctactgaagtatactatacgttcagaggaatgcacaatacatgtgtccaacccattggatgttcacagactgaacacatttgtaaaaccactcaaatcagtaagtaggaaattactagtttcccatagtccccttgtgttttcttctagtcactcctccctaccctcacccctcaaaggtaactactgtcctgatttctagcaccattgattagttttgtgtgtttgagctccatataaatggaattgacagcatgtactctttttgtgcctagcttcttttgttaacagtattatctgagattgtactttatttcacatatcattcattaattgttattgcatcattcttattgctatatagtgttttattgtatgaatatgccataatttagtctactgttgatgaacattcaagtaattcccagtttggtgctattatgcataataaggtgctattactattcttaaacatattttttggtaaacatgtacagacacatatcaatttctcttgagtttatggttcgaagtggaattgctgggctgtggagtgtgaatgtgttcctctttagtagataatttcagatcaaaaatggttgttccagttaaccatacggtgtttttgcctttttcatcatagctgttctaaaattttgtagtagtatcttactgtggttttagtttgcattctcctaatgaagttgaaaactttttcacatgttcactgaccattgtacaccctattttgtgaagtgtctgttccaaatgtctgccgttctgctattgtgttacctgttttttttttcttgttaattagaggaattctttatgttttctggatatgagatttttatcagatatataaatatattgttagtgttttctcccactctatgagttgcagaacagtcttttaaaagaataaattgaatgttcattttattttcctgtttcaaattccctaatttcccattgccttcaggagcaagtacaaattctaactacgcctataaaacttttgattatctggttactctttgtatttccaggccccactccgaagtctgtggtttttatttggttccttaaacttcttgtatttgttcatcatgtgttcttaaggaccaatgaagtaacataaaaagtaaaagtatcattgcagtagaatgtgtgaaaatattttggtaatcttggaggttagtacatcctccttaaatagggcataaaacccagaagccacaaacatttgattacataaaactaggagtttctgtgtaactaaatgcagaagttaaaaacagatgaaatggtaaaagaaaatacttgacatgtgtaacgtgtaagcattagtaaagatactatatagacatataatgagtttctacaaatacataagaaaaagacggcctagttaaaaaatgagtaaaaatatatatgtatcagataggtaactcacaggagaaatagaactggccaataaatgctcaatcttactgcagggaaatactgatgaaaataaagagatatgattactcacccattcgtttggcagaaatgaagaacattaatgttttcaagtgggggtttacattggtaaaggagttttggagtacagtttgttgttattagaaatagaaattatacttattttcagtctagcaatgtagtctgagaaataatgtcatagaaaaatacttgcacttgaaccaaagtatatatcaaaatgttcatataagtcttgtttttaacagcaaaatactggaaacagttcatctgtctttaagaaggaaactcttttaagtaagctacgataaagtatgatcatattaatgaaatgctttgcagacgttaaaatgaagatagttgaactctatgacttggaaagatcttgtttatagggcagtgttgaatgttaaagggaaaaatgtaaagcattattttcatgcatatgacactaaactgttagcagtgttatcactggagtaaggatggctgtaggaggaatataagggaaatttcatattttactctgtgtattcagaattatttaagactttagcaatgagaatgtatcataaaggcaaagtacaaaatatagaatggaattcaaaaacaagtgtctgaaatcagttaatgaatttagaaaacgtctcagacagcttgaggttaaaaactgatacacataaatgatactaactcattggaaaaaggttaaatataattagcatgatgtaacaaggcaattcacaagtatttatagtttttaatccttatacataaaccttttatatatctatgattatttttatacaataaattactggaagttgctgatcaacacagagaggggaacatcacacaccagggcctgttgtggggatggggggtgaggggagggagagcattaggacaagtacttaatgcatgcagggcttaaaacctagatgacaggttgataggtacatcarcctgtacctataggtacaaaccaccatggcacatgtatacctatgttacaaacctgcacattcagcacatgtatcccagaacttaaagtaaaataaataaattttaaaaaaagttgctgtattaaaattaaagttatgtattgatgttcttaaggcttttacccatattgacaaataattttacaagatagatgtactagtttgcattgctacygccagagaatgagtatgtcctttatttgtacctttaccaacaattaatattataattagaaaaaatggctcctgaatacatgaaaaaatatgtgtatactttcttcatttctttctctttgtgaattgccttgtaatgtcctttacctgttctgttaattagtaagaattctttatatagaaagaatcttaaccttttcttatgtgttgcatatatttttctgttgtatattcttaaaaatatctaccttgttaaatatacctttctaattatacttgatatttttctgatgacttaacaatcatttatgtgaatcaatttttataaggcaaaattgtagtgataacctgaagctacatgagagacattttctaaatttattaactggcttcagactcttgtttttgaattccatcctgtattttgtacttcctgttttttcttttgttgtcaaaatactgtcagttgcaatgtgcctatcttgtagtccatctcttacaggttaggaaaatatctgagtttttattatatgcgtaaaataagcaccttcagaataaagacctgagagcttttcttctgagcaaactatattagttatatttactacattgactagactttttatttattttgtttttttttttttgagacgaagtcttgctctgttgtcaggctggagtgcagtggcacgatgtcagcttactgcaacctccgtctcccgggttcaagcaattctcctgcctctgactcctgagtagctgggactctaggcacgcgccacctcgcccagctaatttttgtatttttagtagagacggggtttcaccgtgttggccaggatggtctcgatttcttgacctgatgatccgccctcctcggcctcccaaagtgctgagcttacaggcgtgagccactgcgcctggctgacttasacatatattttaactgctcaggcctctcccccttggttggatagttgaaaattgagaactgaaagccagcttcttctttcttttatgtgttctgtattggtgatatttccagttgcgaatttttagattggcagtgccttactgataatacagtaccgtcagaaacactgttaatcattcttctcaattaactactctttccgttgttttacctgggtatttggttatggaattttattgaatttaggaacataatcaaaccagaacattgactcctattattcaytgatgtaaagtatctcaatagagtacaaaataataactggagatagctagtattcacttaattaaattcagtgtcttcattttatctagtgaaaactacttgcccttaattaaatatttagtaattgctttctgactgaaaaacatgctttagcctatttcatatatttactgagaaattgtcattgtactccaacataagatgagtaatcaagcttagtcacacaggtagtgaatatatatagttacccwctcagtccccaagcatgaatggatagttgtcattctaatgcatttgagcaatatataacagtgatgttcattttcttgggttttaagcagtcaagtaggacttcttatgtttgttrtttttttagttcttcattttatttcttttcccaaggttaagatatgatctaaagtgctagaagtatatcttgagaaggcacctcagtttgtggtcagtcaagtccatcgtggtcaatgaaattcccacctctaggctcctgggcatttatggcaaatgagcgtgatgggtttgggtgctagtgccagcaacttctatgtattttaatgaaatagatctacacaccactcttgattttttaaccaatcttcatagcttttcatcagaaaatataaatggaaatagaaatatggcatcagatccgttgagacggacagttgtgatctaaggaaatagtacaaatcacttgtaaagaaaatgtcataaatcctttaaaaattagtttatgtacacattagtactaaaattactttagttttagatattaatcatttgtctcacaaattttaaaactgaaaagcctatggaagcaatgttgcacacgtaatataacctcactttgtatgatgtattttagtagcgtatctttaggaaaatcaaggagataatgagtcgcatcgtatacagcatgaaatattgaaggctttggtatctttaaggcttagaaattcagctgagtgcattttgtcttttaaaattccatctcctaacaaaaaacccaacttccaaacaacccaaaattgtttccagaaaacccagaaacttccaaaatatttggcttttcatgaagaaatcaaccatggtgattttaatcctttatagaaatggtatctatttcttttatcttttagaagtatgtgatcctgatgaaagactctgctatttagatttgtgtaagaaattagttgaaaaaagtctgtatgatttttggcatagataattatgctagtttctaacagtaatgcaattttattttaaagattctgacaatggagatattaattatgattatgttcatgaattgtcattggaaatgaagcgtcagaagatacagagggaattaatgaagctggaacaagaaaacatggagaagagagaagaaattatcattaaaaaggaggtatgctatttattgcaataaatatgttagtacttaatagcagcatttgtattgatcagataactcagcttcttgctacatcttaaattatattagtatactgatatattgatcaacccactgtatatgtactactccatatatattcatttaattttcacattattctattagataagtagcaaatatttatgttattgaataggtgagcaaagctaagagtttgttgcctagagtcaccagctaatgtaacatggggtttgaatctgcctatgtctgtttcaggcccatgctatttctagaatgccttgtttcttttctaaaaagtgaagatacagttaatttaaatataatttatgatttttctgaggagattttgaaattttatgattttaatttactttattgaaactggtatatgttaggacagttatattgcttaaaatcatggattcaggagtcagactaatatcaacagatagtggttattataattttgttatttttatttttatttcaaactttttttgtagggatgagatctttctctattacccaggctggagtgcagtggcactcactgcagccttgaactcctgggctcaagggatcctcccatctcagcctccctaatagctgagaccataggcaccttccatgcctggcttttttttttttgtataagagatagggttttttttatgttatccaggctgatctcaaactcctcacctcaagcaatcctttcacctcagcctctcgagaaactgggattacaggtgtgaaccactgcacccggcaataatatttaattttaatctgaagtttggtgtgattctaaaatactgtaagtcttgttgtaccataagtggaggaatttctgaattgacttactgaatttttttaaaggtttcaccagaagtggttagatcaaaattgtccccgtcaccttctctaagaaagtctagcaaatctccgaagcgaaaatmaagcccgaagtcgtcttcagctagcaagaaagataggaagacatctgcagtatcttctcccctgttggaccagcagaggtcagtagggtgataaatagtatcgagaaaatagctttttctgaagtgatactaaaaagaattagtaggttataaaagggtacttttagtacattttatatttaatgtaagcttttttgttctaaaaagaaatttgaaatgtttcaattaaaaagacaattatagagaacaataaaacaaacatctgtgtaacatccacatatgcttcagagctttttattttttaagaaataaaaatacaagatacatttcctgttcctctcttaaatctggtgtttatgatacttgtgcatgtgtttatactttaactaatatgtgttctgcaatgtatagtattgctttcatctattgtaatagggatatatcataaccttctgcacattgctttttcactcaacattttttatgtttatattgatacatataaccttagttcattcatcttagtatttatattataaatttgtctgcttttctgtggaacatttatgttgtttccgatttttaaactgctacaaattatacacaaaaaatttttgtctttcagtatatattatcaagagattgaattctttataacttagaattactgtagaagccagttgaagaagtaaaaatagaaatgattatattcagggactaagaataaggagaagatacattttcatttaaggtcactctgaactatttatattttattttaattaaagtccataccctaattttatcttaaaaaaaatgaactaaaaatatcttctacctaagatttaatcagttaacaagccctgtctrtttgaacctgtaatgaaactcatatttatctccctccttctagttcctagaaactaaccctatttcagactctacttaactttttgcctagattattatatcactaactatattgactttatgtagtttctacccaccacccacacaggtgaayattttcattcagctacctcaacccatttattttgtagatgctgtcagagaaatcttaaaaggacaattccaattaatttattataccattgaaaaactcagtggtttttcattctgtagaatgaaattcagattccttagaatgacatttacactttggtcttttctttcttgtcagtagtttttgtccagcttcctcctatctacccccttctatctcaattcttcaatctctagctcaaattttaagttttcccatttctctttatggaacataagttctgttccctttaggtacctatcagattttgcttatacctccatgttgataataattgcctgttgcattatatttcagctgtgacttatgttttataacctttattaaatttaagctccttgaagattgggatcttggttattcatagttctgtcttctcatagtgcctacttgacatagaactttgcattgtaataaggcacttagtaaagttgagttgatcctctccctcatattgcctacttggcatagaactttgcattttaataaggcgctcagtaaagttgagttgatcctatcctttgttcatgcaattgagtaaatattgcaaaggtatattgaagaagttgaatgaacagagagtgatacgctccacttcacttgctcttatcctcttggctaaccagctatgtaactttccctcaattctattcatttccccaataaactgcatactagaaataccctttcttccttgtcttatctgttctgtttatagaatatttgaaacttawtcttttcatagaaagttttgataactatttagacaaagggttagtttcatcttttacatacaatctcttttgcttctttattagtaacwcatcctattataaatatttgtcatgaataatcattcacactggtttaattactrtatttcttatattctactatgttgttgactttacgatgcaccgttaatttaataataaaagcaaaaggacctggaaaaacagtatattaaaaatacaaagaaaacatttaattgagtatagcatttcttttcttttttttttttggagtataacatttatgcagtttacatttcctagagtgtgtcaagtaatcatcttttaattttattgctggatcatactatcaactmagaacatactaagcacatgtaaggattagaatttcagttaaaactcagtggagtattttaaccagtgtcagccaactgaggtgtgataatcaggtaaacaaatttcttggtggtcttactaggttatcatattgaatggaaagatataattactgacaaattaaaacttacacttttccctgaaagctggcatttttctttgtttgacatttattttgagatatagtctgatagtaagatttgtcctgatatatgagatatggtataatctaaaatcataaatatattacctattctgtccatctgcacttttaatcttagtttttattaggtgaatttttctttatagctctttgtacagagaatattaagtatgtcaaaagctaatctaaaacaatagttttgaagagagagagaaaagattaaaaactgataaaagtaaacaggtgggctctttgccacaagtctgaagtaggctctgtgccactgaaacaacaattagttgrctttttaaatgttgaagatcttggtgatttcagaatacacaaaaccagttttggcctcttcagttggaaagcactgtaacgtaattgtgttttctaaccacatataattttgatggtaatgtgaagaaatgctgtactttagtaagtatattagaatagtccagrttgtgattatagccaagtcccaaaatgtcggtggtttaacacaacagaaggttatttctcacgtaaagtcaaaatgagtgtttctgattgacagatggctgtcctatatatggagattgagtaacccaggctccttctgaccatgattccactttcttgggttttcaaggaaaccaaagaacgggatgtacaaagaaaaacggaaattgagtattgcagttatttagctctatagtttacaattgcctggcatatgagagccctttgaaatttgggcctggaggtggtatacatcatttccactcacgttcctttggccaggtcttggtcacttggccatgcttaatttcaagaaagtgtagatagtatggtttaccactgtgctcagaagaaaagtttggtaaaccccytgctagtctctgtcacaggtgataatgtaaaaatagtttgtgtcaagaattcctttgttgtttaatcatgaaattttaaaagataattttgatacagatgcyaattattgatccgtttttatctttaaagtagaaaagtatccagaaatacagatatttatcacatatctgttagggtgcataagaagattgagtcatctcatgaatatgcaatgagatatgtggctaatatagttgttggcagaagacaaggatgaaaactagatttagtcgtcatattttagtaatttcctacttgtttacatggttaacgctatgagtgataataagacatagggatgaggactaagagagctacattttctcaatgctatgagtcaagtgcttttaaaatattgccagcaattttgaggtagatactatctcatatatatatatggctaagaactcttgggacttgagaattctgagaattcagcatgataggaaataagttctaggattttaggcttaggtcttcatttataaatatcagtagatagtgagattagtagatagtgaaaactcaccagatgtatgaaaagggttacttgcaaacctagtaccagactgaacactctgagcagatggcttacacagaaacgttaatacagtaaacaggaacaaacttaaattataaattcatttataagtttagtgcaatttgtgaggatattgtatttagaagacaaaagcagttgattatgggaaaaaaactgtgaacaactatatttttattttattttattttattttatatttttgcaggagactggagttttattaatcaatctccctgagcatttggggatcagagttttagaggacaacttggtggcggggcagcagggagactgggggaagccagtaagccaggagtgctgactggtcaagtcagagatgaaatccgagggagtcgaagctgtcttcttgtgctgagtcagttccttggtgggggctacaagatcagatgagccagtttatcgatctggttggtgccaggttgaacaactttttttttttttttttaggacagagtcccactctgtcacccaggctggtgtgcagtcagctcactgcaacatctgcctcctgggttcaagcggttcttctgcctcagcctcctgagtagctgggattacaggcgtgcgccaccacacctggctaatttttgtatttttagtagaggcggggtttcaccatgttggtcatgctggtctcgaactcctgaccgcctcacgatccgcccaccttggcctttcaaagtgctgggattacaggtatgagccacgtcgcccagcctgaacaacaatattttaaaagagaaaagagttcaaatggaaaatcatagaataggacagatgcagtggtctgaggtggacagatcacttgagcccaagagtttgagaccagcctggataacgtgataaaaccctgtctctacaaaaatatgaaatttagccagttgtggtggtatgcacctatactcctagctactcagagggctgaggcatggggatcactggagccctgggggtcgaggctgcagtgagccatgattgtgccactgcactccagcctgggcaacagagcgagacactgtctccaaaaaaaagaagaaatcaaaaaatagcagaacaacgagattgccaaatttagaattagcaaaatgagtactactttaaaaattactgaatataaagacagatttaagatcctggaaaagcaggaaaaatggaaatgacagagacatctaacatggaggagagatccaagagatacagtaactgtgtaataaagagaactgcagagacttgggtcataaggaaaagttwtgaaatgaaaatagaagaaattgagtaaaaagtttgaagtttcagattgaaacagtccatttagtgctggaaaagattttttgaaaatacctggatttagtgaaaatctttttccagtgagtaattttcaagggataatgttcataagcatgccaacagaaaaaccagcttacctgaatagtaaaaaatttgattttctttggacttctgacctgcaacgttaaatgttacaaaatattttaactagagctctgaggtaaaaggattttgacatgaaaatgctatattcaattaaactattgttaaagtaagaggcaaagacagccagttttgaatgtgtatgggatcaaagttatactatttacttaaaattacttaaattgccaaaaagaggcacttaaagaacaaaatttgtaccccaaaatcaattacaagtagattaaagacaaatgtgaaaggcaaaattacaaaattttaggagaccatctttgtgacctcagagttggtaaaaatttcttaaataagattgagaaatttatgatgaatatatactgacagtggttgatatttcatttgtagatgatgtaattgtgttttttgaataatgatgaaaacctggaagccacctgaaaaactatgaaattgttttagaaagttttggagcatctattcagggaaattctatacagtcaataaaaatgattacctaaatctgcttttttaaaaaaaattttattttgagttagagtcttactctgtcacccagactagagtgcagtggcgcaatcttggctcactgcaacctctttcttccgggttcaagtgattctcctgcctcagcctctggagtagctgggattacaggcacccaccaccatgcctggctaatttttgtatttttagtagagatagggtttcaccatgttggccaggctggtctcgaaytcctgacctcaagtgatccacccctcctctgcctcccaaagtgatgggattacaccatgcccaacctaaatctactttttgttacggaaagatgctcacactatgtctatattcagtatttgaaaattttgcaaaatattgtaataggatatcccatgaatgtatgtgacacacacacacacacacacacagagttaccatttccaatgatgagagaaaatagttgtgactatatatatatatgatttgcacatattttctcgcattctataagttgccttttcactttgttgattgtgtcctttgacatgcaaaagttttaaaatttgatttagtctcatttgtctatttttgctttgttgttacctgtgcctttggtgtcatagccaagaaatcattgccaagtccaatgtcatgaagcttttcttctatattttcttttcggatttttatagtttttgcttttatgtttaggtctttattttgagttaatttttgatctggtgcaatgtaaaggtccagcttcattcttttgcatgtgaatacccagttttaaatgaatagacagagaaagtaagatatatggcaaaagtatgtaaatattcaagatgttaaaaatagttctctttgagtagtagaattataggtgatttttactttctttgtctacttttctgtcttaaaaaaaaacagtttaaacagtcattgtattaacatcttttctgaaagtgtcttcctatttcacctctatcttttctcagaaacctgcccctttaaagttatataataataagcagtgttaacaaaataagtatcaagtaaattaattcttcagccatttctgttagtttttttttcttcttgatattggttagtagtatacaaaataataaagggcaagtaatgtaaaggaacgctgctgtttttaagaaggctttaaaaaatatccttttggcatatttgaacctctaatgatagctttttgttaycttcagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtaagtaggattgtatgtttttaacaatattaacttttgtagaatatagaatatttacttttcagaagccgttgggcattagcatattgggttttttagttttgtttacaatagtgtgtatatttattttaataattcccataataattattattatgagtcatggataattcagtaagccttaatttttacaatttatttttcaattttttattgtggtaaaaaaacataaaatgtaccatcttcatcattttaaagtttatagtttggtagtgttaagtattttcacacttgtgaaacaattctgcagaactttttcattttgcaaatctgaaactctgtatctgtcaaaaaataactccccctttccaccttttcccagctcctgttaactatcatcctgttttgtttctgtgaatttgactgcttcagataccttatataagtggaatcatacagtgtttgtcttttttgacaggcttatttcacttagcagaatgtcctcagggttccttcttgctgtggcatgtgacaggatttccttcctttttaaggctgaataatatttgattgtatgtatatgccacattttatttatccattcatccatttgatgggtgtttgggttctttcacctcctggctattgttgatagtgctgctatgagcatgaatgtgtaaataatcccttttgagaccctgctttcagttcttttgtatatatacccagaagtagaattgctgggtcatatgataattctatttttaatttttttgagaaacctgcctactgttttccaatgcagttgcactgttgtacattcccaccaacagtacacaagtgttccagtttctccataccttcaccaacacttagtttgtttgttttatagtcgccattcgaataggtgtgtttatctcattgaggtgaggtgttatcccattgaggttttgatttgcatttctctgatgattagccatgttgaacatcctttcatgtgcttgtcggccatttgtatatcatctttggagaaatgtctttccaattctttgcccattttttaattgggttatttgattttttttctgttgagttctaagagttcgttatatattctggacattaaccccttaacagagataagattttaaaatattttttcctattccatatgttgcttttttttttttcactctgttaattgtgtcttcttgacatgcaagagaacagttaactgaagacttcagagttcttaagtatgttttcttagactatactctatattttactcagtccagcaggtgtgtttgtgaaaattacatgtaaatgtttttggtgattgacattctatcagtaataaatgtttttggtgattgacattctatcagtaaagcctttagttttccctaatggttctttgtacttttattttggtattttgactaagaagtctctgagagttggttcttaacacctgttgctaggtagtttatcatttaaatggtaaaaacatttgtgttatgaggagttgaatattacacaggcttatccttcattttccagtttttctcccttggttatccctaaatggtatgcataggactcacctgttatttagtatgtagacaaatctgaacttggtttttaaatttatttttattttttattttttcatctaaggacatgaaacaacagagctaggaatactggaagattatataaatacctgatctgcacgcactggagttctaaagccatatgtgacaagacattggaaaaagacattttggtttaggaagagttaattaccaaggttcttaggtggggctgttattttcatttgtctccattactctgaatgaagaaattacaggcgcaccaattttattgaagctcacagatgttgtgtatttttacaaatggaaggtttgtggcatccctgcattaaacaagcctatcagtgccatttttccaataacatgtgctcactttgtgtctctgtaattcttgaaatatttcaagctttttcatcattattgtatctgttacgatggactgtgatcagtaattgtcgcattaccattgtaattgttctggggtgtcgtgaactgcacccatataaaacagtgaacttaatctgcaaatgtgtgtgttctgactgccctactgactggctagtcccctgtctctcaccatctccttgggcctctgtattccttgagacacaacaatattgaaattaggccaactaataaccctatgtgtagtggcctctaagtgttcaagtagaaaggaagagtctcttactttaaatcaaaagctagaagtgattaagcttagtgaggaaggcatactgaaaacttaggtggcaagctagatctcttgtgccagtcagctaagttgtgaatgcaaaggaaaagttcttgaaggaaatttaaagtgctactccaatgaacacatgaatgagaagaaagcaaaacagccatattgctgatgcggacaaagtttgagtgggctggataaaagatcaaagcagccacagttgaaatcagccacaacattcctttaagccagagtctaatctggagcaaggtcctaactctctttaattctttcgaggctgaaagaggtaaggaagctgcaggaaaaaagtttgaagttagcagaggttacttcatgacatttaacgaatgaagccatctccgtagcacaaaagtgcaagatgaagcagcacaaaagtgcaagatgaagcagcacatgctgatgaagaagcagcggcaagttatccggaagatctagataagataattgatgttggccacactaaacaaattttcagtgtagttgatacagccttattggaagaagatgccatccaagatgtccatagccagagaggagaagtcaatgcttggcttcaaagctccgaagaacaggctgactctctcgttaggggcccgtgcagctgggggttttaaggtgaagccagtgctcatttaccatcctgaaaatcctaggatttttaagaattatgctaaatgtactttgcctgtgctcttaagtggaaaaacaagcatggatgacagcacatctgtttacagcatggtttactaaatattttaagcccactattgagacctattgctcagaagaaaagattccattcaaaatactactgtttgtttatgatgtgcctgtttacgcaggagctctgatgaagatgtcaggagagattaatagtttcatgctcgctaagacaaaaggcaccctacagcccatggatcaaagactaatttttacttttgagttatttaaaaaatacattttataaggccacaactgccatagatagtgattcctctgatggatctgggcaaaataaattgaaaactttatggaaaggatttactgttcaagatgccattaagaacattcgtcattcacaggaggaggtcaaaatattaatagttacagaagttaaaagaagtcaattacaacgttcatggatgacttagagaagttcaagactttattgaaagaagtaactgcaaatgtggtggaaatagcaagagaactagaattaaaagtagatcctgaagatgtaactgaattgctgcaatctcagatcagacttgaacggatgaggagttgcatcatatggatgaacaaagaaagtggtttcttgagatggagtctactcctggtgaagatgctagaaacatttttttaaatgacagtgacaccaaagaattcagagtgtcacataaactttgttgacaaagcagcagcagggtttgagaggattgagtccaggtttgttttttgtgtatgtgtgtgctgttttttgtttttcttctcactgtaacccaggcttaagtgcactggcgtgatctcagctcactgtgtctcgctattacccaggcttaagtgcactggcgccatctcagctcattgtagcctccgcctcccatcaagtggtgaagtgatcctcccacctcaccctcccaagtagctgggcttacaggcttgcgttgccacactcagctaatttttaaaatctttttgtagagatgaggtctcgctatgttgtccagactgatctygaactcctggactcaagtaatcctgccttggcctcccaaaacattgtagttataggcttgagccaccatgcccagccgactgcagttttgaaaattctactgtgggtaaaatgctagcgaacagcatcacaagctacagataaatcttttgcgaaaggaagagtcaattggtgtgacaaacttcatcattgtcttcttttaagaaattgccacagcctccccagccttttgcarccttcatcctcgtcagtcaacagccatcagcatcaagataatacccttacccacaaaacggttaaaactctctgaaggcttagatgggtgttagcatttctttaacaataaagtattttaaaaattaagttatgtacttttatttttttttttgagacggagtttcgctgtgtcacccaggctggagtgcagtggcacaatcttggctcattgcaagctccatctcctggattcatgccattctcctgcctcagcctcccgagtagctgggactacaggcgcccaccaccacgcccagctaattttttttttgtatttttagtagagatggggtttcacygtgttagtcaggatggtgtcaatctccttaccttgtgatcctcccatctcagcctcccaaagtgctgggatgacaggtgtgagccaccgcgcccggcctgtacttttttagatataaatctattgtacacttaaaagactacagtatagtgtaaacataacttgtgtgtgtactaggaaaccaaaaaatttgtgtggctcacttaactgtgatatttgctttattgtgggaaccaaacctatgtttctgaggtgtacctgtattaattttaaaactaaacagtatctttgtcactgtcttcagattgataaggaatgtaattaaaggttaatgtctaaattccttttggaaaaaattgccctttaaaaatactttaaatgtcataatgggcgtattagtagtgttttgtttactagtaggtgttgtgcttaagtaaaattgctaattcattcatccaacagttacttaaatacctgttctaaagctggtattgcagcagtgagcaaaagtgtttccaaaagttttgttagtacaggtagaagtaatatagtgatggggtgtgtgtgtgtatgtgtgtgtttgtaaaatagtgtttccaaatacgtgggttttggctttgggtttgtttttttttccttcaagtatgacccactaggcttactggatataagcggttgcttacatttcttaaaggatggctctctattgagttacccatttacatggcataggtgtgcatacacatggcataggagatgcaacaatgctacacgatcctctgactttaaatccttctagctgttctctgtgtctcagttgtccaaattcaaaaataaattgtaacagttaatgcttactgaattatccattactcataatagataataattgtgtctcagttgtccaacgttctgtatcaggtgcttctaacccgaagtccactggtggattttaggggtctacaagtttcttgagttatgtataaaactttgccygtgtatgtgttttggtgagggagagtgcccatacccttctagaaaagttcatgattttcccttctccaaaaaaatgttagaattatgaatcattcttgaagcctaggacactaacctgatgtcaaggatttgagtactttcctcccaaactgtcattggcatatcaagtttgttaaaaatgtactcttcccagagtatttgtaagtttaatacgaaattctatcatgtggttaatttttaattgaataatttggagacttcggcccttaaatgaatgtcatcagtgtcttccaacttaactttactcagctttgatttatttattcaatgttgatcaaaacctgagtactactcatttacgcagagaaaaagccttatggatttattactgtgctttcagaaaatatagcaatttcccataatatttttttaaaataaactttccgtgacctactctacagagaatagtaaaatactatttctgcccctcttatcctcagggaatacattccaagacccccagtagatgccagaaatggcagatagtgctgaaccttgtatatactgtgcatgaatttcttcttctttattcataatttcatgtatagactattccttcttattgtagatttttgcaacctcagcatacagtttttcttcttaagaactttcatgttttcactcaaaggaagtactttatggctttttttttttttttgtacatattcaaattgccagcatcactcttctttgcactttgggtcattattaagtaaaataagggttactcgaactgcataattactgttattgccaaactgcaagtcaatctgataactgagatggctacaaagtgatcagcgagcaagtgcatacagtgtatagtggttgcggtagagtggaacgacaaaagatttcactgtgccacttagaactgtgtgcaatttaaaacatatgaattgtttatttctggaagtttccattagtatatttggactgtggttgaccagggaaagcaaaacagcaggtaagctgggcctattgtagtgggaacccaacaaactaattttttttcctgtaaattgtttagaagagatgtaaatcaaagggaaattaagtttattttaggtatttagtcagaaagataattttcgaagggaatactctgtgtcaatattcctaacctattatgtctagataatcctaaattgaatatttataatgatcttttggtagatgtaatacttgcttttatcagtgtactcacttatattagtatatattctttatagtttcccatgctaaatcaggaaagtaaactaatacattagtagtattttaggaacaagggtttaaacacaaaatcttcttggataataatcagaaaaattatctgacaattgcatgtagctcattctgccagatattttggtttcagtatgattctgctgacaggtgatatgttttaatcataatgctaggttgtaggactttgtggtcaaatgaaaaaatagtactcagagcatagctaactaaaaacacaatcattccaacacaattacctgagtgtagaaatctgcttattacttgatagtagttggatcaggttgttcttgtattgctataaagaaatacctgggacaaggtaacttataaagaaaagaagtttaattggctcatggttctgcaggccgtacaaacatggctccagcatctgctgctggtggggcctcagaaagcttactaggaggaggtrtgctgaagtaaaagtgctaattcatttattcatccaacagttacttgattacctgttctaaagctggtattgcagcagtgggcaaaaatatttccaaaagctttgttagtacaagtagaataatgtggggtgtgggtgtatgtgtgtaaaatagtgtttccaaatatgtggggtttgtaatatagccaaacatgattatattgcacactaagcttacgaaaggcttgtgttaagaatgaaatcatgttataaacatcaaaacaactcattcacaagggataaaaaagaagcctttcacatttagtcaaattaaccaaggcttggactgtctttagtaggtgtgatgttgggaaaatttgttgaattcaggagagaaactcatatctagaaagagtttatgaccctaaataattgtacttttagcttttgtccaacttgctttgcaaaattggagacttgaggaaggctgttctcaagtattttcagagaggtttttagtagcagctggtggttcggaagtttaatcctattccaataattgattcagtcagaaatgcataatatagagtcaattctgtaaagaatgtagggctgtgttataatgacattaataaaatagcctctacctgcactgtcaaaatccatcctaatctggctgtggtctggtgccaggtggtggcgtttttgttttttttttttcactgatagttaaatgaccgtaagaagaattttggctcctgtgactagatgggacttccaggccattggcagggatttcaaaaatctcccttgcttggcacccagtggcctgatctgggaaggtattatgtctgggaaatgcagattggggacttctgcaccttcctcttccaaaactggattatctactgtttcttggcctggtttggtcctctgcttcatattcttgccaccctaccctatccccagcagaaagtagtaactttaactggttccaccaagcggaaggagccagttgtcttatgccaatgtgtgttgtttctgggttttattgtattttaaatatcgattctcttactctgggagcttaaaaacaatccacatgcgtgcggcaggaataccagctatttgtctttttctaacccttgatcacattggtaggtacagcttttagttcaagccatgttgttgaataagtctatgtaaggctcttaccttgaaccacgtttcataaaagtattagttgttaaattattctggatttgaatagcattaaaggatgggttaatttaagggttgtctttaacattttttattctgagattgaaactttggaaattacagttgacccttgaacaatgaaggggtagrgggtcaacccctgtgcagttgaaaatccttgtataacttttgactccccccaaacttagctactaatagcccactgttaactggaaactttactgataacataaacgtttgattaacacatattttktatgttatttgtattatatactgtattgttattacaaagtaagctagagaaaagaaaatgttaagaaaatcataaggaagagaaaatatatttactattcattaagtggaaatggatcattataaaggttgtccctttgaggaggctagaagtgcaaaaaggaggcgttgttcttgctgtctcaaggctggcagaggcagaagtaaactcacacgtaagtgtggaccctgtgttgttcaagagtcaaccatactgcgtttgtgcatgcaaaaatgaaatctgaacaaaattattagtaccttagtgaatattttcttgtattatctagaacttacatgagggttttttttaatcaaatctgttttacaagtatcattatgtatttatggaggagtgatcttttaaaagattcccacagacaagtgtcctcctagttctgtaagattgttcagttagaaatgattccctttccagggagtatttagcctgctgcaaaagaatagcaagctactaggtgtaaaacaaatcacacagaagcattttcttttttcatcttacaggtttatttagacgagtaagatcttgttatattttaaatggcacttaaccacctatcactctccagtgctttctctcatgcttagaataaaatccagacttttaccatgacctgtggcccacatctggctctgcctgctttctgattccctcatgagactctgttctctcataaattgtggttccacttggcttctttctattcttatacatcaagatccctcctacctcctttgtgcttattgatcctaaagctcttgcctcagatcttcagcacttggctcaaatatatcctctagtaagggtcctttccttaccaagcaacctagagtagtcaccctgacatagttttttgtgttttgtgatcaagggctagaaaaagacaaatagccggtattcctgccacacacatgtagattgtttttaaactccaaaagtaaaaagcacatactttttgtgtttttttggacctaacagttctattttgttgtccttttgtataaatgttgttacattaattagcagaaattgtcttgctttgtcattgttggtttgctccctggaccatagactctgttactagatagactggtttccagtcctccctcgatgtattagtcaaggttttccagagaaactgaaccagtagaagatatgtctagaatgagatttacttaaggaattggctcatgcaattatggaggctataaagccctgtgatctggctgcaagctggagacccaggaaagctggtggtgtaattcagaagcgtgagaggtagaaagctgcctccattcagagtgtaagacctgagaagcaagggcagatcaacgttcagctcaagcagtcaggcagagaatgtaaccttccttcacctttttgttctgttcaggccctcagtagatcagatgatacacacattggtcagggccatctgctttactcagtttactgatttcaaatgccagactcttttaggaagccctcacagacgtgcccagaaataatgtttagccagatatctgggccattccatgacccagttaacccagttatgtcagaagttgcaaatttttttgtgaaaaatcagaccttggccatgagaccttgagcagtaggatataaataactcccacaagtttagtattccaataatggaacactaggcataaatggattaagttgacacataaaattaaccatgacattcaattaccttattagattgtcataaagattaagtgagttaatatatgacaagcacytaaaatagtgtcacacacatagtagcaatataygttacttgctattattaatgtcattactattattatgttagtggttttgttctcttcatttctgtatcctcattgccaaaaataatgcttggagcttagtatgtgctcacttaatatttgttgagtgaattaaaatgatttaataaatataaacttcatatgtaaaataatagaacctaaatatttctacttgcaaaatgtgtattatgttgtattttatcactgaaaacagagatgattttggtagtgcccatattacctttgtgttttaaaaatgtatacattttacatgattttaaaggttaaaatatgaatgttagtgcattatgtaagcatattttcatatttgagaaatagaaaccattttttgaaagaaacattggtgttactatttttaagtaagtctggggtaaacctattagtttgcaggtgaaattacttgcatcttgaatgagagtttttatttttaaatttcttaacttttcacattttttcccaaaatgaaatataccctgaatattctcattccacaccacatcatatcctaattatagcagcactaaaaagtgtttgattggaatctagtcagaccaaagatcaactttccctggatacaataaatcacagtgctcttgattacattatacaggtttttgttttaaggtattaagcttctcttcattaaataaactttccttttttctttatttgaatttcaagtttcactaattttttccctcagataagaaaccagccaattataaagcataagacgaattaatctgaagttacttctattctaagtggaaatgtactttactatagctctgtaatagtctatagccaaagtactattaattttcaccagatttcaagacagtttcgttgcttagaatcataccttttatatatgcagaatggacgtaggtgaaggttgagtaaaaagaaaatatgattaaaaagttgaagccattatttgacaacccattagtgttctgaccttaatgtgatagcccgattatcctaagtttgaagttttttcttccatgctatagccatcaagttgaatagaaacatgattggaccctaatgtgttttttaaaggtagtatatgtgaactgttttgtttttttaagttttatgaactaataactcaaggctattgtagacattcttgaaacaattttaagtataccccagaaataaacacagaagtaaccaaaatatcagttcaatggagaaccattcattctttagttttttaaattgacgagaaccatcaagcatggtggctcatgcctataatcccagtactttaggaggctgaggcaggatgatggcttgagcccaggagttcaagaccaaccggggtatagtgagacctcgtctctataaaaaataaaacaaagtagctgagtgtggtggcatgtgcctgtagtcccagctgctcgggaggctgaggtgggaggatcacttgagcccagaaagccaagagtgcagtgagccatgatcatgccactgtactgtagcctgggtgacagcgagaccttgtccccccgcccatccccccaaaaatttactagaacctaatgacattgaaattgaaaacaaccagacaatactgactctaatttttactcttgcagtgatttttctgttcagtaggatgcatttagatgggcattgatcataaatggttttccaaatttggctaagacccgttgagtatttccactcatattagctgttaagttaataaatttctatttagagtcaattaaattttagtagcttatggcttatctttttatgttagaaaggaatcactattttattaaaagtataaagctttaatcaagtcacagaaaacttgatgtttaagtgagtgtagtgttctagttagcwgacttttcatttactgtcacccagaggtatttttatttgcctaaattcttttctgcatattctttctaatatattagatcacattcctgacttagtaacatagtttatagattgaaacctttttttgataaaaggtttactaaggcatcatttataaacaacatagtttaaggtagtggttctcaactgggggtgattttgcctggtagaggacatttggcaatgtctggagtaattttttattgtcataacttggaatgggagggatgctactggcatctagtgagttgaggccagggatgctgttaaacatcctatatataatgtacaagacactccccctcctccgaagagttacccagtacaaaatgtcagtagtgctagggttgagaaactggtttagaattagtaatgatttgtgccatcactgcacatactaaaaaaatgtttatcatagacactgaagataattacagaaatactttgacttaaaaaatcagaatttttttgaataagcttttagctcttgagatgattgctttgaggaatatttatctgggcatgtctagaatattatattttaaacattatttcctgctgcttcttagttattgcacaaaagtttggacaggacccaggtataatagactctaggagtgattcagatgttgtgcttaatgatcacatctgtttcatgaggttatgtgttgtttctctggtagcagtgaaagaaaatgatttgaagggaataggggaggccttagttgaaccaagaactatgaactaactctcagtttgtgctgcccacagtgaaggcagattacttaagttaaagacagtatatattttgttatcctttccttaattctaggattctttcatagtcctaaatgtcaacccatgcagcgtggactttttgtttgccttagctgatgctacctccccttttaccatagccrtgaatttacaggcattctcaaagccactttctctctagatctcagtagtatgttttgccatagtttgtgggttttctccctctaagtatttgttcacactttcagagattatcagagtgaattccatactttaagttagggtagatggtgtatgttggaaaatgcagtgtactttggcaccaaagcctgggagaaaagcactgcatatctcttcttgaactgttgcttctagttgacttaaagttaagtcacgtcgttaaaaaagtgacttacttagaattttacagcattgtgaattaaaatttattctgaagttattgtctatactttcatattcacttttttgtttttaaagattttcctttggctagaaatgaagctcttgaatacatgttttattgttattgttttcccttgtaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcrtctccccagagaaagcagagtcctccaagacatcgctctccaatgcgagagaaagggagacatgatcatgaacgaacttcacagtctcatgatcgacgccaygaaaggagrgaaggtgtgtactgtactttgatttttttaattgaaaaattgaacatccagctttattgttgtactaagagatggagaaagactttgctatgttaagtcttctgtaacacacagactagaatttttgagggcaataggagatgcttaacaacatgggaatgttagctgttaggtgtatacaagttggtatttacaggtatactaagctggtgctttctttagttaagatgttctggccrggtgcagtggctcacgcctgtaatctcaacactttgggaggccgaggtgggaggatcatgcggtcaggagattgagaccatcctggctaayatggtgagaccccgtctctactaaaaatacaaaaaattagctgggcatggtggcatgcacctgtagtcctagctactcgggaagctgaggcaggagaattgcttgaacccgggaggcggagcttgcagtgagccaagatcgcaccaccatactccagcctcggcaacagtgcaagactccatctcaaaaataataacaataataataataataaaagatgttctgctgagtaagtactctcaagttctagaaatttttggccatctgattcttagagcatccttttcaatcactgagttaatgtcttttgaaaacaaggaggtgaagggaagaaaagcaacaaatcagagagcgtagtttgaaagcatcagaagtgttttgataaaggagtgagggctggggggaattgttagaaggtcattgcaaaccgagtcatcaaatttctaggtcataataaagaagtaagcgaagcagttttcctttctagatccctgagaattaagttaactttggatttgctactccctattcaagctgagattttattgttacctggcaataaagcctgtttaatagctctcatctctttctttacttcttgtctaagcttctggtcttcgtagattcaacttaataagtctgttttctaacttctcctgtgttcattttttaacatagtaagtactcaggaaatgcttacttggaacaacatttatatttaatatgcactttaagcgcctcttggtgagtggagtacggcagtctcctatgaaacatgttgaatgtagtattctcttcctatcaacaatgcaagcaataatcagtcgggttcttttgttcaagaaaatggcggatgagaatgatattcaagaaaataggcagggactggagaaagcacctatttgatagaatttttttttttgtatgtatgattttggaactaggtcagcacagcagtgtttatgaaacattggtaagatgggaaaattctcttatattgtacctttctataaattttaataagatatttaacaactagagttgaccaggaatatagtacatatttaatgactacttattgaatgaaaactccattaacattattaaacatactaatgaagggaaaataataagcaattgagtctcataggaatgcttgtgttaagaagggacttaaatcataggcgttttaagttctttgtaaggaagatgtctgtttaactttccatacgggagatttagcaggcaattgttcctctctatttagatgtcattttctgaaataaggataatttcggtggaaggatagggaggtaggtaaagaagaaaatacagtacctagacgtatttgtaaagacagatgggcgcatcatgagaaaaagatctggcactaagtgaacacattttcaggcacagttggtattgggggaggaatagaagtgaaagatattcacagaaagggatggagatatgtcagatctttgcctcttgcctttgtccttaaacagggtttgtggatatggatatatggacaaaggaattggtgggggagataggttattgatgagggtctaagggccttgtggttacaagatgtttgggtccatgagaaagtctgtgggcctagccattagggacaaagagaaaaggaggtaaacttataatgttttgggcatgaggctgctagagttgccaaaatagccttagactagggcaattccagagtataagagcaccttgcagaagaatctgataaaaagggcagaatttatcctttgaggttctcttgttaattctttggcttcatatcagatttgttataatcaatttgtgccctttctaaatatatgtaaagagtggtttctaatctttgcaaattatggggttgactaagccatctaagttttgggcctctatttctttattataaaatgacatggtttgtttagataatcactgtggttcagcttttaaaaagtgcaagtatttatttttttgtatgaaatgcttttttgttcgttcattttaaagagaaaaagtctcatcttcctatgttgcccaggctgaactcaaactcctggattcaagtgatcttcctacctcagcctcccaagtagctggcactgtaggtacatgccacgtcacccagctagaaaatgctctaagtagagaaagctttaaagacttgcacacatgaatgttataccattaaacagtgcaggaaaagagagtgaataatagtatcactcaaccagctagcttactaaccataggctaccctaaagtgcttaagtacatttgaggaggtcacagatggtctagtttagcctaacttaatagttgatagaaaagattaaagtaactgaagtgtctttgtatctaaaagtggtttctgaaaagtaagccgtcaatgataggagatgaacttatttgtttcagttgtttaggatctggtaagttggggtgagttggggcagtataggtaagttggggcagaggaaattcatgttcggagtttatctaatgaagaacattcttatcaggtgttaattatctttggaattttagcttctttattttttgcaaagaacacgaattgtcattataataaaatttttaaagttctgtattaaatatgttttctagtttcctgaaactttgtaaaagcaattacagtcaatttccaaaattgcattacagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggtaaggtttttgacttgtctatgaactatatcttatatagaaagtataaaatctcctaagatttctaatatgttgtttcttacatttrttatcattttgtcacagtaatttttaattaattgaacttgtagtcttccttataaattcctaattggaattactagttaaaatagcaaaagataaatggagcttgagctagaccccccctaagtatatccagtcatgcctatcatcttgattaatgtggaacactaagaaaatcactatcagacaaaaaagtagaatcacgaggaagttgctttctgttaaataggtataaatatgataaaatgttcattaaattaaagtaggattaaagtggtgggttttcagaattgttggcatcagaaatgactgatttgtgtattcttcagtatttgtacttgcttcagaccctgtcaaactgccacacgtcattatcttgagccatttttcttttcataaaaagtatttgccatcacccaaatgacttaaatatattgtaactatttccaaactgctgagacttaattatcatgacctctctttacctccacctgcttttctcccctctccccaaacactgctgcagaactttgatcacttttattctttccattggtctgttagtcaatccttggtcagtattacagcttcatatttgtgttgagggtcctttagcttctttgagctgccttgtcttttcttgaccttttactttttcatatcaattttagaaaacagtttttaatttcataaaaaaactgttggatttttatttcaatgcatcaacttaatcaatttataatatttctcattaatattttttacattttttcctgtgtatcctctattttttattgccattttaaatagtacttttacattttgtaagatgtaaattatgtatttacatggttcaaaattttgaatgtataaaaggatatatagtgaaaagcctccgttgtaccctgaccactcttttgccagctttgtatgtattcttcccaaaaaacattttacacaagcaaatatatatccatttgttttcccctctggttttacaaaactaatttttaaaaacactggaaaaaactatgtactgttttatatcctactattttcaactagtaaaaatatctttcatgtctttctttgtggtaaacagctattttcttcttttggtacttgttctctattgtagaatataccataaagtcagcaagtgctgcattactgggtattttggttttccaatctttatctctttcaaacagtgctttagtgaataactgtgtacatatgtcactaaatggtgtcttttaaaacattgcattttctaatgctttgttggtacctggaaatggtaattggcatttgtgtattaatcttacatttaaatgatgttgctgtattttcttgatctaattagattctctwaacagatgttcctaggaacacactgatttggctcttcttttctgattattaattttctgtcagtaaccttctgagcatctttatcaatacagtgttaaatataagtagaaggggccgggcgcggtggctcacgcctgtaatcccagcactttgggaggccgaggygggcggatcacgaggtcaggagatcgagaccatcctggctaacacagtgaaaccccgtctctactaaaaatacaaaaaaattagccgggcgtggtggtgggcgcctgtaatcccagctactcgggaggctgaggcaggagaatggcatgaacccaagaggcggagcttgcagtgagccgggatagcgccactgcagtccagcttgggcgaaagagtgagactccgtctcaaaaaaaaaaaaaaaaaaaaaaaaaaaaaaatatatatatataagtagaaggggctttgctttgtttcagattttaaaggattgttgctggcattttattactaagtatggtgtttgtagattttttgcagatactttttattgtgttaaggattaagttctctccccccattttagttgtcagaaaatactctgttgaaagtcagttctttgggatatgtatttgttaactcttattttgtggctcagtggtctgtttttataagtgttctgcatatgctttcaaaggagttgcatttgtaatggttgaatgcaaaatgtttctctaagataaagtttgttttaactacactttcaaatctacatgtaatttttcttagtctgtttgttctgtcattacagagaggtgagttcagtcttccactgtgattgtggaatttgtagatttgttgatttctacttatagtttgatcatttttttatttgaatatttgaagctttgctattaggtacacgtaaattgagttatttctttctttattcattatagaatgactgtttatgccaggttcaggttgagcatccctaatctgaaatgctccaaaatctaaaactttttaatgtaattttttttgtttttgttttttgttttttctatagccactagcaactgataaaatccagactttttgagagctgacataacattcagaggaaatgcttattggagcattttggatttccaatttttcagattagggatgctgaaccaatataatgcaaatattccaaaatccaaaacacctgtggtcccaagcatttcagataaagggcattcagcctgtatttttcttgaagattgttttgctggcagctgtcttttggttagtatttgtttgatatatctttttccatcctttcaggcttaatttttttttaaatgtaactctaaacaacatatagttttagacagattaaatctcctcattgtatcttctttcattcttaactttcaaatttttcatctctttatctgtttcgcctctaggtcatattctcaggcttaccttctagtttaccaattttttcttagctgcatctaatctgatggttaatccattctttcctagatgttatatgtagcctttttgtagtctgtaaaaatgttttaaattttttcttcctggtctttaattattaaaatatttttcacagctattttgattattaaaatacccgtagaatcatgctgtaattcttttaggtctcaaaagcctgttacatttgtattctttgtgtttttgtttgttttttaaatcttggggaagtgccttttgattctgtctttgggtgggttagtttgtcrtatgttcttttttttcttttttatttatttgtttatttatttatttattattttattattattatactttaagttttagggtacatgtgcacaatgtgcaggttagttacatatgtatacatgtgtcatgctggtgtgctgcacccattaactcgtcatttagcattaggtatatctcctaatgctatccctcccccctccctccaccccacaacagtccccagagtgtgatgttccccttcctgtgtccatgtgttctcattgttcaattcccacctatgagtgagaatatgcagtgtttgattttttgttcttgcgatagtttactgagaatgatgcatcactggccatcagagaaatgcaaatcaaaaccacaatgagatgccatctcacaccagtcagaatggcaatcattaaaaagtcaggaaacaacaggtgctggagaggatgtggagaaataggaacacttttacactgttggtgggactgtaaactagttcaacccttgtggaagtcagtgtggcaattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggtacatatacaccatggaatactatgcagccataaaaaatgatgagttcatgtcctttgtagggacatggatgaaattggaaatcatcatatgttcttttaagtttggagtgaactcatctttgtcaaagatttatccatggtaattctatgaggttgagggcagggccctcagagtttctgtctttgtttttgccagatattcctaaattatcacagccccagtactgtttctctactcctaaccctcactgctcaaaaaaagcttttttttwaatttcattttgttttgaagtaattaggaattcacaggagattgcaaataaatgtacagggaaactttgtttatccttaccccaacttctccagtgttaacatctaacatcttatctatagcatagtatcaaaaccaaacaattgacattggtacaatccatagagtttattcacatttcaccagtatacatgcacttgggtgtatgtctgtatgtagctttttgtagttttatcatatgtgtagcccatttccatagtcaagatactcatctataacatcctaagattcctttttattacccctttatagccacaaccctcccctggcccctggccccaacccctggcaacctcttatgtgtccyttgtyttgtaattgtctcgtaaatggaataatgctatatgtatcctgttgagattggctttttcactcagcataattttttcttggggttcatccaagttgttgcatatatcggtcattcatttttattgccgaatagtattccatggcatgcatgtgccacagtttgtttaactgttcatccattgaaagacattagtgtactttgcaggttttggctgttatcaacaaagccactgtgaacatttgtttcccacatctgttaatgaaaattttcacatacagtttaatgttgtcattaaccttggtgttctatgttggaatgttttcactgtaaactgtatttaagcaataatacgtacccatttttttctttcattatttttatatatctgtgaattaaatatgaagaaatagtttttattttttgttttttttggggggacaggttaattttaatgaatcttattattttatgattttatcatatgacttttatataggtagggaaaactgggacttcgtctactcaggtcagtcattggacaccttggttgttctgattcattgcttgatactcttttcaggagtgattaccacactttggaatattaaatatatatattagtgatgtttaggaggaaagattatgactgatgaaatttgttgaataaagtgtatgtggtaaacatttgtgtgtctatcctttgtttaggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagaggtttgtcaaacagaattttattaaatagtgaacaatatcaattgggcgaattgttttttcaaacagttaccaatttactttttaatataaaatatactttaaggcttgtgctcgatgacacatttgaaactattatatatactcatataatctttgttcacatggtttaggagggattatgtcaatagctagtgaccagtacctactggcaacaaagtgcaaaaacttgggtgccctactgtgtgtttctcatcttacccaaatagcttacaaacctttaaagaatgtagatggttgggttctattccaggcaattctgattcaagaaatacctaaacctttacatctgagtatcctgtctactcactcatttgctatgatcaatagaattttataaggacttccagaaaggaacagtaaaaaaaaactgaatgatagggctggggattgtttagagaaatattttatttgtattctgtcctgagaagatatggtatttgctttagctaattttacgttcttatatgtcttaagctaaaactttttctgttcatctatcaggtgatctcttaaatgaattttgaagcaagattactaggaagcacttaagaagggttgtaaatactttctttggcaagcttttatttctgtacttattagggcctttaaacattaaaaattttatgaaggtcttactaaccttggctgaagtaaggttcactataatgctgagattaatatagcatgaaacttgatggcccagagaattgaatattgatactttactatgggctgaatcaaagaggtaatattatatcttgattggttagtagtgggagaagaataaagtttctaaggcatcatctacttttgggagcatagataggatcagaagtaggagaattgattaggttgagtttataaggtaagcctaatgcattttggttaaaagatgtgtagaatttccttagttacagatagggctggagtttctatgttctgtgttgatatctgaaattttttcttccctgggacttttagaactggtgatgcttttttttaaatttcttttttcctttttttctattttcatatccttgctcagatttttctcatctcatgcctgaattcaatagtaacatttggtttcaatcttatggttagttcaaccacatgtattgatcttctactaggtgccaagaactttgatagttgctttacatatattctgacttagtctttacaatatccttgtaagtgtaggtatgataaaataattcatgttttcacagttttggggattagatctaagagtagtaagattacaatattatagagaagtaggttccagagctggaattcaaactcaggtcttctgaccagaagttcagttctctattttaattttactgtaactacttcaataattatgagatgtatgattgaaataaaaatatattttggaggctaatgaatattttacaaatatttgttgagtacccatgtcaggcactttgctaggcacttgaggtacaataatttcttgtccttgtagaatttaatggggagagggaagaactccccacccaaaaaaacaaagtgtgataaaatgctactactgtatataaaagttctgtgagaagacaaaggagcaaacacaattctgagcaattccaagaaagctgcctaaagaagtgacatctgaattagggcctgaagaataaaaggaaactatagaaggagcactttacagggagagggtgcagcatgtacagacaccagaactgaaagaaacatgtgctttggagtagtaaggaattatgagattggagtcagagtatgctataattggcaaggtagaaaagaaaccagggaaaaggactgatgaaagactataggccaggtagtaaatgacctaagtttagcctagtcaggctaaaaaatttgattttaattgcctttcactgcctacaagataactacttttaaacagttggaagaaataattttcatcaaaaacatattaagggtgttgggaaagattgaaaacaaggataccaattagttagactgtttgatgacataggcatctaagaagacctgatcaaggtctgagttaataactatagctatggggacaggaaaaggaacaaagaaatattttagaagtgaagttgattgtacttggatatgatgaggcttagacaacccagagattgtcagctttaatgaattggtatgtcatttattaaaataaggaaatatgtaagtagaagcacatctttgaataacacattttgggggaaagataggggaagataatttagacattttaaagtgatgttcttatattctttccattttcctttgaagaaagtagcattgatattttggttgggaaaatacatctcccataaaagcatgtctgaatagtctatttgctgatattgctgtaattagaaatttaaagtatgatttgctataagttaatggtattgaatttgtttcaggttatcttgtaatgattatgatgttggtatgactcctccaaaccaggaattcagacaatacaaaagatgggtagatagcattctaggaatccaaagtatggtacagaagaaccactttaagttggtttcagcaaaagtgaaagggtttaagaaaactgacttctaatgcatctaccatctctgtgacattgggaagacaactctggaccataatttctgtttttaaatagaaagggggagaagcaactgtgtaggatttcattttgattcagctttaaaatgctatgatcatttgtatctgggtctataacctctaaaatagtaaagataagataattcttgtcttttcaatcagtgattaggaagggaaatccagaatactgtattgaacccttcctagaaacatcctaaaattrttctgcttaatgagttgatgttagatgttccacttaccaacctgttggcctgattataatatgatctttatcaaaaaccagtagatatatagtatgtaaatggaaacatcacagtatcctagatcagaccgcagtagttgctttcaaaaatggctgtctctttgaaaaagttcatgccatcctcttaaacgtttttttatcccagactaattttctgctcaactgggtatttgggcagcatgcattcatttactctgtgtttatgtgatttgtgtgtacatggaaaaaatttatataaaatgtgatgaggttatcagttaacattttaagaaaacagctcttcatctgagtaatcatttatgtaattaaagctaatttattagtaattggttattaattacaaatatatatcactaatatgaaacactttttacatttatttcaagattgctagacatcagtacccttaatattacagttcatgttatattgcagcaacaaattctgacatatgttttgttctactatattttcctcacataatagctgcactttgatgtgtatatattttggcctgaarttagaggtgtgacttacgagggaaattttttttttccttcagctcctatgttctacacctcctgctgcccctatcctttgccaccagtgttctcaggtcctgctggggggacagagaagatcagaggtgaagggtagagatggcagaaagtggggttggagcagtgggctggaggtagggtagggagcatgcagagaaagatcaaagattgatcagtgggaggggggaagggggttgacggggagcaggaaacatggtcgttagagggcaaataaaaattatctttaaaaaatttaaggtctagkggcgattgttacttggatattaagttaaaattaaatatgctacttggtttgtaatttgttgccagtgtgaccctatacacagataaaatttaagatttaccatgctgtcttaccaataggttatctgtcaaattaatcactgacaaaacttgattttcattgtagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagtaagaataattatcagttattaataacattttacatttcaggaaagaattcaaagtttcatttaatgcttttcaatatactcttaatttcctgttaattttttttctctgtatattttcctgtttttcaaatttagtatatgtatcggtgtttaaagtttttttacccagcactttgggaggccgaggcaggcagattccttcaggccaggagtttgagaccagcctgggcaacatggcaaaactccatctctacagaaaatacaaaaattagccggacatggtggcacgtgcctgtatcccagctacttgggaggctgagatgggaggattgtttgaacctgagaggcagaggttgcagtgagccaagattatgtcattgcactccagcctgggtcgagaccttgtctcaggaaaaaaaaaaaaagttttttcagttgtctagaaaaaataatttttaaattaagacaggaatcagtgaacttgtatcccatcacatcccctagactagtcaccaagggatatcacctgtgccattctgatgatccttcatgacttttatgtgcttgtaattatggagtcactacccccaggctacaggaagcattcacaatgtcttggaactgagggaatccttgtaatcactgcatggttcgaagatgagagaaaaggaagtgtcttctcttgtgctgtggagtagttctttggggtcaaaaaatgtgttcttggcatctgatatacctaagggcattctcccacctcacccccttttaaccagaaaagaacttattgctcaaatatctaggaagttggagattagcttttgcttgttctgatgtggctatatccagattctcaaacaaagcattagcagtttccatctctccagtttccctctgtattaatttcagtctcagaaaggttttctccatatgatggctaagatggccccagagttgtccctgtcagcttagcagtcctctctgagttggggctctcattagttggtgaggagacagttattgactaagctgatcacagtgttcatgagaattctagactcagattggtcaattttgaagttctgtgggcacaaaaccaaacttactagagttaactacttttttgcctccaactgggataaacactgtggtttaccttgccaaaacatactgagaaaataatttatgtatcttcaattttcttgctcttacctccaactcatttgccacagggcgaatacagggtccctgctttaggcttttttcatcctcactattgtggattatggttagggccaaacaacacagcacagaagtagaactttcttcccttaggtcttggctgttctttaatctacagccatggttttctgtagtacactccttggattactttcctgcttccctctccttacattttgaaaaatcttacctgaacataaacttcagagataccttttttaacacatggaggcacaggtacatattcccaccctccccacccgctacttttctgacctctttattttctaagattaaaattctgaaatctttgttatttatcttttattcagtcctctgctttcattagtacagattgagcatcccaaatccaaaaattcagaatttgaaatgctccaaaatctaatgttttttaaacactgacatggcactcagaggaaatgctcattggaacatttcagattttcacatgaaggatgcacaaccagtaagtacaatgcaaatattcaaaacctaaagcatttcatggataagggatacgcaacctgtatttttttcatgcttctgatatctgcttataatagcaaaagtttttctggtttttcatggttagacaatctaagagttgacaatgaccccagaaatttagaagttgaataactctataacagaaactaattacatgagattaatatcttaatctttcattaactgtattgtcatctcagtagttcaatttatccagcactttttttaactgctcttatgtagaaggtttgcctaattgctgtatttattttactctaattgtgtttatttaggtatttccttgaaataactttttctcatgttttaaattttcactttattccagtctgtcagttatctcttgatatataacacatcaccacataagttagtagcttaaaacaacaaccatttatttgctcatgattctgtggattggcagttttgcctgggctcaatagagtggttgttctgttggtctcacttggagtaactcctgtatcaacattacatctgacaatgcagctgggcctggaggcccaggattgtctcattcatgtgtctggcaattagggcatcttgtttctcctccacttgaccccctggccttcagtagtctaaacgctgctttgcatgtaatggtagaaacaacaagagggcagaagctgaagcagcaaggcctcctgaatcctcttcacatttgcacagtgtcactttcaccacattctcttgtcatagcaagtcattagatatgaaaaatggggaaataggccagttattgatgggagaggagctttggataaagtagtacacaagcttgggcctgtgagttgtcatattacacctggggccttctccacatggttgttcatctatataaaggagctgtctatgatatacatgtgctggtatgtttttgttttatttttatttcaatagcttttagggtacaagaggtttttggttacctggatgaattcagagattttagtgcacctgtcacctgagtagtccacattgtaccaaacatgtacgtttttatccctcactccccttccaccctcccccttctgagtctccaaagcccattatatcactctgtatgcctttgcatactcatagcttagctctcacttacaggtgagaacaagttgctgcaaaagacattatttttttcctttttatggctgagtagtagtccatggtttcatggtgtatatataccacattttctttatccacccattggccaatgggcacttaggttggttctatatctttacagttgtgaattttgctgctataaacatatatgtgcatgtttttttttttcatataatgacttcttttcctttgggtagatacccagtagtgggattgctggatcaaatatctccttttagttctttagggactctccatactgtttttcatagaggttgtacttatttacatacccaccrgcagtgaataagcattcccttttcaccatgtctatgctaacatctcctgttttttttactttttaatggccatttttgtaggagtaaggtggcatctcattgtggtttttaatttgtatttccctgatgattagtgattttgagcattttttcatacgtttgttggctgtttgtatgtcttcttttgagaaatgtctattcgtgtcctttatccactttttgatgggattatttatgtttttcttgctgatttatttgagtttcttatagattctggatactagtcctttgttggatacatagtttgcaaacattttctcccattctatgggttgtctttgttatttattttgctgtgcagaagctttttagtttaattaggttccatttatttatttttggtttcgttgcgtttgcttttagaatcttggccatgaagtctttgcctaggccagtgtccaaaagagttttcccagtgttaatttctagaattttaatggtttcaggttttagatttaagtctttgatccttcttgagctgatttttgtttgagctgagagggatccggtttcattcttttacatgtgacttgccaattttcccaccaccatttagtaaatagagtgtcctttccccagttatgttttgtatgcttttgctgaagatcatttggctttatttctgggttttctattctgttccattggtccatgtatacaatatgtttcttaacttttgaccatagtatttataaacaaacaatgttagtgaaaaaacaggtagtcaaattttaatgaaaatgggggaaaacactagaataatttaagtacccaagagatataaaacgctactcatttaaagctcaactaaggaacaaaaaatataatgaacgtatgaattattttattaatttgtcagcaagaaagtgatttccatgaaggggaaaggaactaattttatggtgtacccacaacatatttggcactgggtttatgacataactaatttattccttactgcaattttatgaaatggactctcatttcccacccattcagccccacccaccattttcagatgagaaactaaggttcagtgacttcaaggaacttacttaaggctgcgtaataactaatgtagttataagttgaactcatagcttttttacttcaaagccaatattaggttttctcattcagctctgcagcataaggcatttttatatcataagaatgcaaaattgctgaatgtttatatcagagggtacattaatatattggtttctgtgctgcatgttaccaccttacagtatttaaatctggcaattttcacttgagttattctacatgtataakgaagaagaagaagaaatgttgtgtattttaagttcacaattcttagcaaatgaagtaaagaatttgtattaaagacactgaatatcctttgtatgatacactctggcaatattgctttcctacaattatatgttccagttatagtaaagagatactagtaaaaacaaaaaaatctctttttttgccccctagaattttataaaytgtgtttgcttgtccaatttaggaagcgctatagaaatgaagggagtcccagccctagacagtccccgaagcgccggcgtgaacattctccggacagtgatgcctacaacagtggagatgataaaagtaagcagactctgttttctgtctctctatattcatattcatttgtaaccatgaaaccatcctttcatactagtaggaactgatgaattaagatttttaaaaagttgtcttgctttgctgcctctaaatatctccttttgtgactaaagtatgtgttagagtactgtcattttctactatttatagtaaagccatatttttatttttactaaaattattgtcattttaaaagtttttaaatgatcttgatctcttgatctcatgatccacctgcctcggcctcccaaagtcctgggattacaggtgtgaggagaaattattataatctatatgtaccatgcagtggttactaacctggtgagagtgtgattgcttttatcttttatatagatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaamaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacractcctggtagtaccccttctcctctatcttctcttcttcctcctccaccgcctrtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcaggtaataaaattgaattgtgatctagtcactgtttcctaggttagtatattttatacacattttaattctaaagtaatgctaaattggttactttacatgctgccttaaattttatgcaactttttaaagaaaagtttagctgccctatcaaaatgttacctgttatcacattaataccaacattataatagaaatacatacagtagtgttaatcagtttaatatcaggattttagtagtatgtcttggtggaagggtttatgtgttcaagtcccttattgatgcctatgattttaaccttcctgctmttcttcatgcagtcaaggctgcctcttttgaccacagaaaataagataggggagtaggaggagatcaaataatggagtgattagttctattaatgcctaatcattttatgtacttcttggaagatattttatggttatagtggaaatagacaaggaaacttttttttttatttattagaactttgagagaggaatttttcttaaaatgatttatatatttggatatttatagagagaaatgtatatgtagaatatagaaatatatagaacatatagagacaatatggaacatagaaagttacatagaatatggaaaaaggtaaattatgttttaaaggaccttgaaatgaagcattttgtttctattttatcatgtgctaataactctttatatatggtatatttattttagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcawatagagtctgtgaaacgctgtgaagcaaaactggaaggtgaacatgaaagggatctagaaagcacttcccgagactctctagccttggataaagagagaatggataaagatctgggatctgtgcagggatttgaagawacaaataaatccgagagaactgagagtctggaaggtgagtgctacctctgttgtctgtgatactgctttatttcttttcagatttcgtgggaaacaactattttcttttgaaagggcacccactaatgggcaaattgactccattctccattcttctatagaggaagtagatttcagaaggaaaaggcctgtaagatagagatatatatatttttttaatgtggtccccttagcagtaccattaaggcagatttggttcacataaacctaaatgaaataaaagattgtttagatgcagtgtgtatagatgttgaagaataaccatcacatccttttcttagatgttaaaaaaataagattacaaaaattgaaatgacttcttagttcagagagggattcaaataattattagtgaatccctattttctagggcagttgagaacaaatatatgaaacaataacactacctaaaactgtatttaatgtaggattgactagaatcccactggtactccctagtcctagaataggaatgctaagtccgcatcaactcagagccagcctcagctatgtgaaacctcactctccatgcttctgttctttacccttcagcccccatttactagacaagctgactcatgcctttccattctctgcccttctttgtacccactcataccatttcctgatagacctttttcttttatctcatctttcttactcaaaattcaagtcccaatttatacattattttctcgatgaagccttctctgctcgaggcacttactgtttcaaattcatctcttcacattacattttcatctcaattttgagtataaatagcatcaaatcataaagcatggttctgatggaggtacaaccctgggatataattgaatataattgaattaatcattataatagctctcttgtgattggagtcagtatccctcatctctaaaatatataatttgctggttatgatcacagataatatagaatagaaatgtataggtgaatcacttgctatgtgatgtaaagtttttactcaaagtaggaaaatgagttggatcaacttgaaaagttgaaaatcctattatgtgcatttatgtttagatgtatgtttatatgacaaagttactaaaattggttacattagaagtgacttagtgaggatatggggagattattatagaatttaataacatggaaaatcactagaatgactagaaacatctcataacttcttatattttatttgctgcaaattcatacccataaagcatatggttacattttgaaacttagtattgtagattcagtgaaatgtatggttagctagtgattgtaaacgttaagtgtattctgtaattttaggaataagttcacaactaactcaccaagagacaaagtttagcataggtggttgaaaaaagttggtaaaataaaaaaatagaacatacactagtggaactaacaaagttatttttaattgtattaaagcatttttctaaaaattgtgttcatcaatgcaagaagatcattgagatagggaggaggaattgagatgttgagagagaattagacacttcttgtatttttacctcactgttgtaaagtttatataatgagctaaataatatgaactaagatttaagcttcgagtaaattttttaaatgtttgcaagtttttaaattactttgtttagataaattgtgaaaatttgaaaatataacttcaaaatcttttgaagttagatttgtctgagttttaaagttttaaattatcaaaaataatacacagtcaacattagtatgttagtagtagcttttatttgtcatatttttattgtgatcttataagctgttctcataattgctgtccagattgtattcttgctattaaagtttaatttaactaattaaattttatttttgttttcttttgataytatcaagtatttgaataattaagagatacagttttctgatgaaaagatgtttttcacattgttataatgtgtgtaccctctaccttttggtttgacttagtcatcctctccctttaatgttgtctttgatctgaaattaatttgtctatttagcaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccaggtaactatttgcagaggtggttaaacatgaaaattatctgttatatgatattaaagtattattaccttctactctgtaaaaattgacctaagacacttagaatttttccttttacattttacttaaggttgaaaggccaataaaatgaaaattatagcctatatgcctactcctttttaagtaggcattgtctatgaattagaaagggcctcatttaaaatagcaaaattctaaagtttattttccagaatttaagaatcatattatatgacttggaatctaaacaaatactgattgtctagcaatgttctttctacatggtagttatatggtacaaagcttcacaactgtggtgacacaagccaactttttaaacaacctgtcaaaaatttacagtagttgaaattatatttgaacactatatacctctatcaattttctaaatttggtaattattttgacttacagtactttgtgtgttgctggaactcattccagtgattataccatgaagcaacaccccttaatattcctcttgaatcattccaattagtgtctgattgttactaacaacttttttaaatcacagtgaggatcttttctttgattatataaaatatgaaatttttattttaatttgctcttatattttgcaattttttctactgatgtagaaggtatgtatgattgttatctttgttattttctggtatcaggtatttctaagtagaacattatttcttcaactgttccttcgcagtggatggattatttgctctcagtgttaataattgtcactctctgactcttaaagggatttcataatgaaatagttgtttttaaaaattaaaatgtatgtgtgcacacactgcaaacacatgtactcctagatttaacccttaaaaggattctggtaccaagtttcaaaagatcagacccaatctgagtgaaatcaatagagttctttcattggggatctcccatggagttaaaatgagttatttgtatgggtgggttgggttacctgttttcttttggtgggaaggttttttatttgtcagagtccttagattctgagtattatatgggaaggcttttattttaaraataggacatttttggtttaaagtacttttcattttttctgttttctccttgatttatgtaaatgtctatgtagataacaagactgctatttcttggtgtaaaacaaatcttactttttaactttttacagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaaggtagtttcattttactttaactatataatgtctgttaaccatttaagatgccatctgaaggggattctgatctgttcttatgtagcacttaacactgtgtagaaactattttttgagaaatcattttataatcattatttaaccctcatggtcaaagtttctctttaaaatttattttgagaagaagagttatcccacagaaaagttgggaaaagagtacaatgacctttttgtatgaaaattacttattaacaggccaggcgtggtgttgcatgtctgtagtcacagctactcagggaggttgaggcagcaggattgctggagcccaggaaattgaggctgcagtgagccatgattgagccaccacactccaacctaggtgacagagcaagaccctgtctcaaaaaaaaaaaaacaaattaaccaataagttctaatatcaaagtgctcagtggtttgcccttggctaaatgaagcagagccaggaaaaacagactacatatttttcatgtctaaagaaattgggtattttggcagccctttcccctagacatctacccaaatgcaggtgtgtaggttgagtctttaacaaagtgattaagagcttggtctgtaaggccggatgatctggatttcagtaggcacaccacttactggctattacttaatctgtgtgttagtgtcatcatctgtaagtcaggaataatcataccaccaacttcctatggtaattaggagcaaatgagttattacaggcaaaacacttagaacagttcctggcatatagtaatacccaataaatattaactgctactttgaaaatatcctatcacgctgatttttgacctcactgcagcaattttcagttattccagattatctagcttatggattctggtggtaggggttgtttggttttggttttcactgtctctgtctcatctagtacctaccttagtttattttgcaacttactaatactttattaatggggagggacgagtagatggtaaaaagaaggaaaaggaggtaaaaggtgaaaggaacaacattaattaacaattttacgtcatgtccctggacataaaagtttagttagtattaaatttttcactaatacaaaataaaaaaatattgttttatgagttttatgaattcatgcccttcctttactctattagcataagcagtaaatttttttattttaatatagcccaataaacctagagtatacatgtacaaaatacatataattgttaacgtgtattaaccgaaaaatgacccaagacttagttcttgccctactgtatctgccttgtttggttggttctgtgaccttaagcaaataactcctgtgagcctcaattttatttgtaaagtgatggaataaaacccctaaaatcttacccacctctaaagatatttgtttctgtgaccttttgctagtagcatttcaagttaaaatctggtttgattttgctacccatgaaatacagttcggcccttacttattgatgacttaacctaaacagtgaaaatatgcactgtaaagggtggggtgatgtggcttaacaatcagacttcttctatttttgctgctatggtggttgtattagagaactgatgtattatcttgaataaagactttgtcttgtttactgccatatccaaggtctaattatctayctatattttctgctattgcccagaaaagtgcctgacatacatagtaggttttcagtaaatatttatgaaataattgatactgatttttcttttccattttgtctattcaagtgtaccaacatgaaagaaaacataatcatatttcatatataatttttaaaagaaacaactaaagcttaaaacagaaaatttataagtgtactgaaattgaaattgcttttgtctgttttctaattgcactaaggttaagttcattttttttaatttttaatttttaattttcatgggtacttagtgggtgtatatatttgtggggtacatgagatactttgatacagtcatgcagtgggttaataatcatgtatggaaaatagagtattcatcccctcaagcatttatcctctgtattacaatccaattactgttttagttatttttaaatgtataattaaattgttattgacaataacagtttctacaacagggtgttatagtcaccctgttgtattatcaaatactaagtcttattcgttctttttttttttgtacccattaaccatccccccaactccccacccccacatctccccacccccacatctccccacccccactacccttcccagcctctactaaccatcattctactctctgttggttaagttcttttgagctaaacttttaagaatgcatttagtctgtttcttgagtaatttggtgctgctcagttcaaaactttaaagagactggaaatttagtcatgttttatactccctgaggaggtttgcaggtatgtgttttgtaatctactattttgaaagccaaaaataaggatcccaataaacagaaatgtgtggtaatgaacaattttcaaggaagggtgtaggctcaatgcatttcttttatattatatctgtagtggaatggtagttaatgttttygtttttgtttttaatcatgtgcatatatgactatatcattggttggtacaaacattggtatatctgaatcatctgaaaaaactgccccttttttcccttaaggtattctagtccaactatggtgattctcattctgcaaatctggtgatagagcccagggaatgttttttaaaaagctcctcagctgatcctgatagactccagtgtttgagaactagtttcgggcttttctatatatttacacctttcttatgttacacatctattgactaggtgtgttatttaagactggtttcttgttaactatctaatctcaatacttacactttgcagcccagaaaattgaaatcggctatgtattgcagcttcattttgttctcagtaaaatgtgtcttttatttttacccaggcgtttactgcttttctttgtgggttgtaaaagtaacctgcttgagcgtgttgtatgaatagaggcagtacctgctgtctttcgtactcttgaccgactcttatttatttggattactgactggtcctgttctgttattttgacttcctttgtgtctatttttaacctaacctctttatattttattctatctttccttaattcttctggggtttttttgtatgttcagtgttttctcccctaccttgcatgttgtgacttaaaactaagtgatttaaatttaatacattgtcccaggtttttatggtgaccaaatctaggacaaagtttgcaggttatctaacaatcactttcttaactaatttttttagaggtcacagacttgaatattgttataacatttgaatcttgctataataaagtcttgaaatctaaaactctaaatagtagttgatggtaagcagtatactgaattagagttcaatgattcttaacttgaacgtttctttaaaacatcctttaaaaacgttctttaaataaattccctggggctgggggcggtgactcatggctgtaatcccagcactttgggaggccgaggcaggcagatcacttgaggtcaggagttcaagactagcctggccaacatggtgaaaccccatctctactaaaaataccaaaaaaaaattagccaggtgtggtggtgtacgcctgtaatcccagctactcgggaagctgaggcaggagaatcgcttgaatccaggaggtggaggtttcagtgagccgaggtcgtgccattgcactccagcctgggcaacagagagatactttatctcaaaaaataaataaataaataaattttttaaaattaaaaaaaaaatttcctgggctctaccttgagatctacatacagtctgcttttcttatattttaagtaaatttaaagtggctatcagaatatttattcttgtttgagactaccaacataactacgtgttgaaggtgcttcacagagaatatattgcctttaatgtgaaataattttcaccaatgttgctaactttaataaagtataaaatttgtagaatattcagttaagtagttggtaacccttttctattttagtaaaacttaatgcatgtttacttttttttgaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaaggtactgttatttccttggaaaaaatacaaagtgaatagtgtgaatggcctatttttcatttggttgttttaaattgagattgcaatcttatgtttttatgagtttggtttcctaatcttttatacatgtaaaaagaagaatgccattaaaatgtataatatgctttattttacttcaacagtattaatgaattttgttttaataaagtttaaaatattccatttctgttaaacgttttttgtgaaaagctttcaacaagcaaacgtattacaaaaatttatttaaattgaaactcaaggaaaaaaatttcttagagtgatgaggatatttatgagagtagtatttatgagaatatacaaagttggaagaaagggaaataaagcgactctatataagcatttgagaggaataaagagattgagaagtaagaggaatagaaattagatttggaagagatctgttaatgaaatctggtaaacccaagatgaaaacattttagactctttaaagttaagaaactgggatttttggccgggcgtggtggctcatgcctgtaatcccagcactttgggaggccaaggcaggtgaatcacgaggtcaggagatcgagaccatcctggctaatacaatgaaaccctgtctctactaaaaatacaaaaaattagccgggcatggtggcgggcatctgtagtcccagctatttgggaggctgaggcaggagaatggcgtaaaccaggaggcggagcttgcagtgagcagagatcgtgccactgcactccagcctgggcgacaaagcaagactccatctcaaaaaaaaaaaaaaaaagaaactgggatttttatttggggtggtgagtggatgggtataggtagtacagactgagtattcctaatccgaagcttttgagcatcgacatgaccctcaaaggaaatgctctttggagaatttcagattttggattcttagatagggatgctcaactgggtaagtaaatgtaatgcaaatattccagaatccaaaaaaatttccaaatctgaaacatttctggtccaaagcatttcagttgaggactactcaacctggatgacaaaagagagttggtgtgattctttgcttagaaagtttagagtaatgataaaatggttaacttcactagctttttacttggggcagttaggaaaacagaattatctttgactatataacattgctaaagaaaagattacttcattaaagaaaaatactcagatttagggtagtgggtagggggrattcaatttttaaaaaacagaagaatgagtttatctccaaagattaaaatggaaacaaatacgaggaacaggagatttttaaaacatgtcttgactgtataatcaagttttcctcacttaaaagtctggttcaagattacttttgacagaatcactacagtcattctcctttgctccctgatttcagtatgcacttttctttgttttgtattttgtaacattccctggtcccttctctatgacaataactttccaaaaaatgctaatgtaactttaagtcacaataatatagatacatattttagtataagggaggtagtagttcttcagcatactgcatgattagctgtcttctaaaggatttattcagttttcgagctcactttttatgggacattgaaagattggtaaggagtatagaatagaatgtttggcttacagaaggaaaaactatgtgaggaaggaactcatggcacttaccttcatagaactgaaggattgtcaagtaaaggtaagattgaattacagtgtagcaccatagaagagcttttattccatcacatggaagaaatagtgccattcaacaacagaaygtgcagtgtgttttttgtttgttttgtcattggaaatgataaagtaaaaaccggttgattacctgtcagaaattgttgagaggattcctactttaagcaagaggttaaactaggtgccctctaaaagtttcttttcaaagattcattgagcccaaacacattttctaattttgctttgaaatccaataaagctaatttaatatccaaaatgaaatactcttataactttgatattttgggtagaggttaacctgcccatctttcctactaataatgtacatcttttttaaagtttgtttttgttttcttcaaatagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagmaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctggccacagaatttgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatrtgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtggataatattgttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctgttgtctttcagtttgaaatctttttgttatgtatgttgcaaaagaaaatttagaactattcctttgttcactcagtcacagcattcagagctttatgtttccagtggaaatgtactgttcagtctcaatttcttttaattcaaccattctcagtattagtaacatatacctataaaatttttctaaagcaaaatttttgattgaatttctcataaaagctcttggaccataattaaagtctcagttaaactggtattcccgaaaaacaatcttccagtctataaattgtttgctagtacaattaaaaggtcatctatctcataactgacggctcaggtctgtccagttgccataattgcacaactggattccagctgctggtaataaggaattgtgtagatagataaagggcaagagtatgtctgcaatccaaaataaatgagagttaacacataattagccttttgattattttggcagctatcctcaccatttagtaaagggtatactaacaatacccaactttatttaacaaagttttgtaagcatacctaagtagtaacttgatatgctgaaaaatctgacctgtcacttcgcttcactctgaccagtaattgcagattgtcgtcaccatcctagcctatgactacattaggattttatgacttattaacttgaaaatctgttctgtaagtggcattggtagaatctcccactttgctcctcactgtccaattgtgtaaagattaaggtacatactattgttggtgatgcttttacacctcaacttgctattttaaaaggttatatgaacccctcccacttttaaggatattcccttttactgattttcctagctaaaattatatagccatctttctaaatattgtatttaaatctgatctaggacttgccttattttatcatttttctttaataatctccaataaactttctttattcattaattttgttgatctttccatttcagtattttgaatgacactctggggaatccaagtttaaatggtgaaatatttttattaaataactttctacatgcatctgtaaacatactttctcaactttattgagctgtttctttcatatttttttttcttttttaaattatttttatagagatggggtcttgcctgggctggtctcaaactcctggcttcaaagccatcctcccgccttggcctcccaaagtgctgggattacaggcatgagccaccatgcccagcccttttttttttcagaggcagggtctttctctgacccccaggctggagtgcagtggcaggatcatagctcactgcagcctccaactctagggctcaagggatcctcccacctcagcctcccaagtagctgggactacaggtgtgcatcatcataactggctaattttaaaaagaaaaattaaaaaaacactttggtaggccaaggcaggaggattgcttgagcccaagagttcaaaaccagcctgggcaacaaagtgggacaccatctctgcaaaaaatacaaaaattagccaagtgtggtggcacgtgcctgtagtcttagctactcagggaggctgaggcaggaggattgcttgagcccaagaggttgaggctgcagcgagctgtgatggcgccactccattctagcctaggcaacagtatgataccctgtctcaagttaaaaaaaaaaaaaaaaaggtgggggggggatcttactatgttgcccagatgatctcaaactcccagcttcaggcagtccttccatctcagtctcccaaagtgttcggattacagccgatagccaccacctggttatactgtgatagaagtacaattggagtagcttaggtaaagatgggaagtaaatagacatgaataaaatgtaaattgcagtgattgcaattaaagaaaaaaccaaatgactgagatgagaaataagtgtagcgattgggagttgggtactacttcagattatcaagaaggtcttacgtatgagatgagtcctaaaaaatgaaaagaagctagcaaagagcaaaaggggaaggagtatttcaggcagagggatggggatatgcaaaggcctaggaaaagagctttggtgaattccaagacgaaaatactactatggctcaccactgggtggaggggatgggggttgctagagagaaggtctagaacagtgctgttcaacagaatattctacaatgatggaagtgttctgtaaatgctgccccccaaaaaatggccaatacaagcttcatgtggcttgtattaaacacttgaaatatagccagtgtgactgagaaactgagttttaaaattttgtcattacttttaaatagctgtatgtggctaatggctaccatttggggtggtgtaggtatatatcttggcaaagccttgtggaatatggaagtgtttcccacagtagagtataaaacaagttctgtatgttctagttactttgcatggcaagtggtactgattgttttagtttactgtggcaatataacatttctttttggaataaatgttaataactaaacaaattaagtagtcagtgtggaaataggacagaaattactggtgctcagataattgaagtttagaatatgtaggctatgtatgaagttggaatttcatttgaaagcaaaagtaataagtaataataaaaggataaaaggcattcaatcacgtcaaaacaggcaagcagaagagaaaaagcaatttagaacaggtgagacaaatagaaaacacacggatgtaagcccaaatgtattcacaaattatgttaaatgaaaacattcagtatccaattaaaagacaaagattatcaaaccacagaaaaacaactacatgttgcttatgagactgacctaaaacatagggagctttaaaagtaaaaggatagaaaaaagacaccatgtaaacatcaagagaaaacgatgttaatgttaatcagttatccctatgtatttcatatgtattgctgtaatgcttgccaaatgccggttttctaattccactgttttttctacacttactggaattcccttatccatttatttctcctttattcacttatttatgtcagtataaactcatagattcctattttatttcatgggttataactcattattgctcaaaatatccatgttttagacttgttaattaacttccgtgtgtatgtgtgacaattccaatatttaatgccaattcagaatctgtttctattgtgtgttgtttctgttggctctttttcatgttttcttccctactcttaggtctggttatctttcactatatgccgaaatcgtgtttgcaaagttgtttgtagaaaaaaagtggaggtctaagatgctgttgtccagacacaagttttttttgcttctggggtcactgtcagactgaaaacatcttaatcctgttttaggaactaagatgatctgaatccccagatgactcgcatcttggctgcagtatatgcatgggcacttgtagctcactgtcattcccagggttcagactttgaggtctagatccaaagtacaagggttcataagagcctccattcttggtggatcccatgtgccagtgttttctgccttccccaagaggacatcataacttatgattggttcctcagtctgttttccagatttttaaatggcatctgggcaaaattgaccccaaatgtcaggttcacccctgcatatctatctcctgaattttggcccaagattttttcatcatcttactggcttttcagtgttcaagcagaatttttaaaataaatgttttgtccagcttctccagttcttagtgtgaagttgttctgaattatctcatctcccattaccagaacagtttaacttttttctttacttccatttcattgcatttctccattttattacctgtactcatttggtttcccacagtgtgtatttttctttttgtataactcctttcctaagctcatattttttctttctgtgatttcatcatctcttccttcttgtttcttgttttgtggactttcttcatggaggcagttgaatcactagattttaatattcatgttgaatttttttttttcttgagatgatgtctctgttgcccaggctggagtgcagtggcataatcatgattcactacaacctccacctcccaggttcaggagtcttcccacttcagctttccaggtagctgggaacacaggcacatgccaccacacccagctaattttttattttaactcttttgtgccaacaaggtctccctatgttgcccaggctggtctcaaactcctgacctcaagcaatccttgactcgtcctcccaaaatgttaggattacaggtgtgagccaccatgcccagcctattcatggtgaaatgttgcagaatgatatccatctgttctgcaaaatttttcagatggtgaatattatctgttaatttttgctaatttctctagtttttttaatatagtatctttgtatcagtcttacggcagttcctttttcttactcaatactgaatgacttgtaatataccattgtttgcaggaaatcagccatggtagccttccagacgtcacacacatgcttcatcttttctgctgatgtcatagaagcatgctggctcatgtaaatagggctccttgtgattgcttgtgtaggtggcccttcctcctctcctcccctgaaccaaaccaggtccaggaggaccttcacagccaatctcgctcttctctgctcctaactgattgttccaaacaagggacatagcttttgcctttcaaggggaaccctcacattcaaaagcggtattttttgctgagatttgctactgcctggtccctctcaactcttactgcacttcctcctttcactgtctcctgacactacttctgctaaatctcagctgttctggcagcccttatgtctattttgacatctgaagattatatcttatctcctagattcactggaaataaactttatggagatttttacagtctttttgttgcttttatacaatttatagaagaaaaacagatttatgcagcatgtccctactaaatttctttccaagctaaaattcaatccaaaagtcactttaatcctcagcttggatagttccatcgggatgcattcttaggtgaacacctataatggattaatacttgggattatggtatcaatataaaccaaacacataaatgtgatttacaaaataaaggttatttgatgttatcctggtaggtaggaatcatattctctctttagtcacatttcctttacaataaatatatcacgtggctacctctaaaagcaaaggagactggcatattgagcatttcacttttctagcccccttactagaaatgaccagaaaggatgagggttgggttataggtgttagctttgccaaccaaccaatagtgttttccataacttcaggagaaacataagtaaggagaaataatggtacccgttaaggcctgttgatgccaacttcataaaactaaatagtccagaacccagaacaagttctgattctaactctgccacaaactggcagaatgaccctgagcaagccattgtactttggcttcctcatctaccaagtaagcaggtggtagagaatcctaggatttaaacagaaagctgacatacgatagctcagagacatgtcaaatgtgtgttcgtttccttgtcaggagctgagagcatcgtttagagtatagggtaggaaaatgtctcattgtttagtagcaagaggaataggacagtattttgactaaggaaatcctctaatgcttctcaaacccttctgtatcacagacaaattttaatgcagggtaggatttctaggtcaggattttctcctgatgctaacacagagtgtatatgtgtgtgtataaaattatgggcccctctccttgaatgtggactgaacttgaccaacttctaatgagtggaatgtggtaaaggcaaaagtatgtggcttgagagtgtaggtggtggcttgtttcttggaatattcattctggggaatgctcagatgctaggtcatgaaaacatttcaagccaccctgaggagttcacgtagtgagaggccaaggcctcctgccaacagtcgtgtgaattggctgtcttggatcctccaagccctagttaggccttctttagcttagttttttgttctttttctttttttttttaactggatttgttcctttatcagaaaaggtaaggaatatgactttttttttttttttgagatggaatcttgctctgttgcccaggctggagtgcagcgacactatctcggctcactgcaacctctgcctcctgggttcaagagattctcccacctcagcctcccaagtagccgggactacaggtgcccaccaccatgcccagctaatttttgtatttttagtagagatggggtttcaccatgttggccaggctggtctcaaactcctgacctcagatgatctgtccgctttggcctctcaaagtgctgggattacaggcgtgagccactgcacccagccgggatatgacatttaaatcacacttttttttaaacgtttgtctgtttatgtaaacgctttaaaataaactgaatctgaaggatagctgagacctgaagactcctggactataacttgagcatttcccattgtgcatcctatataaactcttaactggcagcagaattctatatccaagaaaactgagtcaaataacaaaagtctactcaaatgagataaacatgaaaattgctgtataaactgtgaagtactatataatgcaagatatctgtggccgtcatttccatcttaccagttctttgtagagaagtagtatgggctgaatcgtgccccccaaattcatttgttaaagtcctaacccttatctcagaagttaactgtatttggagac

SEQ ID NO: 1714 - DNA, 41626 bp, Homo sapiens
tcccttctcaaacctcaaactggcagtctgtgcctgaaatcctatacttcatgaaaatcctcccaggggtccttccaggcagccaaagaaaaccatctctccagtgctcccaggcactggctgccccttctggagcccttagtgctctgaacctggctaccttcaggggagagggagtggagtcctctcccacaactggggactgggctggtgaagtgggacaggatgagaaggatggtagggtgtcaacgggatgaatgggagccagccgctgtcagcaggactggggaacagatgtcaccaccagattgccctcaggtctgctttagagctttgcctcatctaaccctttctctctctggcccctcaagagccagatggacttcctggggttcggaacctggaaccagaggaggttccacaggtgcagttgaggggttctaagaaagatgataaagatgtttatgtgtacagtattctcttccttggatatattctgagccactttttcttaaattttgaaaatttttttcttttttctttttttttcaagatggagtcttgctttgtcacccaggctggagtgcagtggcgtgatcttggctcactgcaacctccacctcccgagttcaagcaactccacctcctgcctcttcctccggagtagctggggttacaggcgcctgccaccacacccggctaattttttgtatttttagtagagacggggtttcaccatgttggccaggctggtctcgaactcctaacctcatgatccacgcgccttggtttcccaaagtgctgggactacaggcatgaaccaccgtgcctggcctaaattttctttttctcactctgttgcccaggctggagtacagtggtgtgatttctgctcactgcagcctcaacctcccaagctcaagcaatcctcccacctcagcctcctaaatagctgggactacaggcacacaccacccataagttgcccagctaacttatttatttttgtagagatggtgtcttgctatattgcctaggctggtctcaaacttcgggattccagcaatcctcccaccttggcttcccaaagtgctggaattacaggcatgagccaccatgcccagacaaaaattcccccccttttttattttgttctgtttttagagatagagtctcactctattccccaggttggagtgcagtggtacaataatagctcactgcagcttcaaactcctgggctcctgggccacttttccacaagaagtgtgtgcttttgaatttcctttcagtttctgcccttcactatctctcctggtcttgctgctccccatcctagaccctagacagagacctcaagaaaggctcaccctaggggtgggtttggggaagcacagtgactggttccccaagtgctcaggagtcagagctactaggatttcagatcaggatggacaaaaaagctgagccagaaccccaccaactcttgccccttctctctcctccaagaccctagtcaactccaaggggcaaagcaagcctcacccacggaggctggcctggtaactttgtcatcatcagaggagttcaagtgtctgcttagctgctggtgggttgctgggggctgcttagctcaagaggaagggtagctctcaggaggccttccccagccccaaaccggttcacagagaggtcctgagcacagagaggtcctgagcccaacatgggttggacacggcgaggcccttctctgtcccttctctgtccccctcaccaacccattctgacagtccagcttcctctcctttacccagacagggatgtgtctaccccagtcagaacaataattttaaactcggggctaagggacctttattgggctgggggaaggagatgggaggagggagctacagagggcccggccatgtgggctctgactcctacagatggccaggagctgggcagcccagccagtactgagcgatggagcgtgggtagggagggtccacagtgtccactcgccgtgtgcgaagattgactcggtagtacttgtctggaagagaggaaagcagaggatgcgtgaggcccagcctggccctgcccactcttcccttgagaagtctagggtctctcccagaagggaaagtgaacatccatgatgcagctaaggacttctggcctggctttctgtggtcactacttgcaggctgcgttcagcccttgtgcaccagggacagcaaggaaaacccaagctagaccagcttcaggggtggcagcggctcctacctccagagaagaagaagacactctggatgggttcacaggtggcaggcacaagccagtccatcctgtagtcatcatagttgttggctcccaagttgctctcctcactggagaacaaggacagccacatggcgcgggatggccggcgggagttctggttgcggccacggctgtggcctcgttgtgaacggtagcctttgcggttgcgatgcctaaacctttgtttcttggccaaggaggggcggggtgccatgcctgagatgtagatgcggccagccatggctgcgtccacttgccctggcacaccgtgccagtcccggctaatgaactggggctgtctggtaccagctgtggcagggaaggggtgaatgagaggtcttgggggtccgaatcttgccccttccagcggggccattagagttcatctgctgcaccttgcccaaagacacacagcagcgaatggcagagccaggcctttgactctcagtccaattcccttccccctgtgctttccctccaccatatcactggtgtctcgaccccacccccccaggccccctaaactcctcagccacagcccctccctctgctggctgtgctctcagctgtgctaggcaaagtccaaggtgtggggtccaggtagagctgagctttccccaaaaggtcaacagaagcaaagtctggcctgagcaaacagactttgatcgatagctccacaaccacagccccctccagccggcctggctctaccaataccaaggggtttcagcccttttgagggagaagcaagacttgccctctctccataccagaggttctgccccagaagagaagctcgaagatgtcctcccagctgtcccgctgcatcatggcaaagtgttcaaacacagccgacagggagctgccttcacactcctcctgactgggctggtgctggaactggtactcccagtactgtttccctgaggagcggggtggtgggcattaggagggctgggccagggcaagactggagatcccagaggctgttgaagttaggatctcccagcatgaggtgggggtcaggggtgggcacatgctgaggcctgtccccagtgaagtgtgaaaggaatccaagactgctccactgcctgctcagtctcccaccaccccctgagtacccttgaagaagtagacccgctcccggccactgtagctatgggcagggagggccaaggctgcatccacgttgtccgggatgccatcgaagccgtcagagatatttcgggggtaatcagggtccaggacaccatcctcaaagcgccagtactgactaccctaagaggtggggaaagtgaaaaggggtatggaggccgctggctgggcacagaggcagagtcccttgccctaaggcagccgttcccaggtccaggttcactgcccaggacctggagtcttggggctgccctgtgctcacagagctcccaccaggtcctgcagggccctgggtccagcttccctgtccaccctgtccctgggagcaatagctctcaaaccctccctagatgctttctaccctggcccacagcccctggcaccttgaagaggtaggtcttcccctgacagttgatgcgggtgaaggcggcatcgatggggccctcgatgccccagacatctcggatgagcttggggtacccaggcctcactgccttttcgtccagttcatagcagtactgccctagagtggaggagatggtgtgagagcagggacgctcctggggcagacccgcatccccagtacctgccctggattcacctcggaaggcaaagagggaaccgttcttgaggtcggtgaaggcgtcgaagggcttcccactgcacagctcctcctctgctgggggctgaggtctccctggatgaagggtctcaggccttgagtctatcccctcaggcttagaggcgcccacctcaggcgcaggggcctcttcctcaggtttcagaacaggtgtctgctcaggattccctttggactgggcctggaggtcagaggtcagggaggggccccccacctgttcatggacagtggcattgtttttctcctcgccatcgtcatagaccgtgtactcatcctccggcatagtgaacacatccccgcgagtcactgcagagagtggatggtagtgagtctccagcagcagggggcaccccagcccacccacctgggctctgaacacaccttggggcttgcactcagccgtatagtctgtgcagcagctctggtagtaagagcagagctcgtcacactggcacttcttgtccacgttgaagccctcagtgcagcggcccttgcatgactctatgaggaaggagtgtcagtcggtgccaccaagcccagaccaccctcgccctccctacattgacccagatggccaccaacactcccctgtaccttggtcagccagagcaacccatgccagcagggccagtatgagaaggggtctcaggggtgccatggcagggcttctagctcagtgcctggcaagctgggctctggtctccctgaagtctccgctctgatgcctgaggaagggagggagaggcagagacagggaaggagggcactggagaagaggaactgccttttctgctgctctgtttgctcaacctccagcccatcccctctgccccctccagcggctgctgcagcaaaggtcacattcctggaacactgggcctgggcgagctgggagataagacctttgccaagctcagaatcattaggtcatcggaaggggaattagcaccgtggatctggagggcagaaagaaggctcattgggcaacagctttatctctctgagtcttagttcattttcagtaaaataggattaacaaagccttgcttcatggggtgttgggagattacatgaactggaccagacaaaatgcccagtagctggagcagccacaaattccttctccaaacatagctattgatccatgattgtttgatcagacacatccctggctgggtgctcattcgccattatttatttagggcaggaaaaagggagtgggaggagagattgtaagcactctggggaattttattttttagcataaaagaacaaagtttcatttctgggttcttctcttgggtgcatcaatctccccaggctggaaatttgggtaaatatcaacccactggactggatttaatttctgagtcttttctgagcaggccactccctgtccccaggctcagtctccccatctgtaaagagtgggcttgttcaacacacttttagactctcgagagaaatatgatccctctacctggaaaatgcccactggcatgaaacacctgattttgtgcccaatttcaggtgtccacagaacttctgaaatcctcccatcacctgaaaaaagtgatcctgagattttagctgactttttctgttctgtaatcagaggggactgtgatttgggccaatttcttcctcatgggcttcagtggagtcagctgtggaatggaacatcaattcccaccccataggcatgttgtgaggtttcgctaagaaacagccataaaagggccttaagagttatgatgattgttttaaccatttagtagggagggggcatccagcggtgttgctcccacgtaccgatgtcacgtggggcggggaggcggggcggagaacggagagcgtcctctcattctccacccccttcctccaagtccagcgcagggggaggtggctgcgactgactgaggggctagggaaggctggccaggggcgtgggcgtggctggggacggcttgggggtggggctgcgcaggaggctggaggagccccgcgggacccagaggcggggcgtcggcccggggaccrctgctcctccggggcgtggctgcaggaggctggaggagccccgcgggacccagaggcggggcgtcggcccggggaccgctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggcsgggcgccgagcggctggcggtgcctgggccagatgggggcggtggcacgggcccatggtgggctgcgggtggcccgggcccgcgaaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgcggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccggtgagcgcgccaggccggggttgggagagcgccgcgtggtgtggacagttaagcgcctgcgttcccgtgtgccttgcgccgtgcctttgcctccctcacctctctgactgcctgcactacatctctgttaggggtcagcctgtctgtttcacagataaggaaactgagccttgggaaagtttagtgacttgctcagtggatcacagtgaactaagatttgctcccagggctagtggggtgaggaatggagttacaggacaggagtccgtccctggctctatggatggagatggcatcctattgccaattctccctctcccccgccccccaagcccacagctctccttcccaccggcttgggttcccgtctatgacaccttctctcgccatcatcccatccctctcccaatgagagaagaagggaaacacaacgctcagaaaagagggagggagacctctcctttccctcctccccaggctgtaaggcgtgctggcctgaggctgcttactcccttcttgccgccccaatccaacttctgctccatccttcattctggttcttgcaacaggccagacatgatctcattctgcagctgctgatgggaaacagttttctgctgggaggcatgggtgggggaagaggacaccggggtgcagagcccggcggggaccaggcagagtgtgtgttctctcccttcaccccacttagcaccaagatgccgcaagagggtcaaacagaggcctggttgccactcttgcatgtctcttgggatctctcctggagtatgaagacctccaaggactcactttccctcccttctgatgccagagcagaccaagctgtcacactccagtctcatgctgaagtctccagcttctcaagcttagaagagtttttggaagagtcactttcagctcatgcagctctcacaagtgtgaagggagtgggttgggggtgttttccttgccattttcgaaaagaaaaaaattacctggtgattggtggaaagatacaactgtcaaaaatgcatgaatgaagcaatttaggttgggagaccaagatagggttctgcttatttggcaagccattaacctcccatctgacatccgttgccatgatggggataggccatgaatttggagggggtagcaaataaaatatgtgctcactgggtgtggtggggtcaaggctggtaggtgtgccctgcaggcttgctatgtggagtcaggagctataactacaatccctggagagtgagtacagccagcagcccaaggagaggagggttgcaagatgcaaacagtactgctatatctcaaggttaaaaatggcaattctcacctggttcagagttaccgagagaagagtcactaaccagtgtccctggtctcaagaaacgcacgctggtctcttcaggaccaaggacagagcacaacgtgcgtggttgctatcacaatacttccaaagaaaggcaggatccccgccaggcgccgtggctcacgcctgtaatcccagcactttgggaggcccaggcgggtggatcacctgaggtcaggggttcgagaccagcctggccaacatggtgaaaccctgtctctactaaaaaaaaaaaaaaaatacaaaaattagctgggcatggtggcgggcatctgtaatcccagctactggggagactgaggtggaagaatcgcacagaacccgggaggtggaggttgcagggagccgagattgtgccattgcactccaccccacgctggatgacagagcaagactcgtctcaaaaaaaaaaaaaaaaaaaaaggcactgtctataatcctagcactttgggaggccaaggcaggcagatcacctgaggtcaagtgaaacacaaaaattagccaggcatggtggtggtgcgtggtgtgtgcctgtaaccccagctactctggaggctgaggcaggagaattgctggaactcggcaggcagaggctgcagtgagctgagagcgcgccactgcactccagccttggcaacagagtgagactccatctcaaaagaaaaaagaaggggagggtccctgcaccccttgtaggctgcatgagaatggggctggaaagaagagaaggggagtgacacactgcgaatttatgaaatgtttttctccttcaccaaccaagcccccactgcctcatctcaaagaaggctcttctgggcaagcatggtggttcatgcctgtaattccagcactttgggaagctgaggtgggtggatcacttgaggccaggagttcaagaccagcctgggcaacatggcaaaaacccatctctacaaaaaatatacagattagccgggcgtgatggcatgcacagtcccagctactcaggaggctgaggtgggaggatggcttgagcccaggaggcggaggtcacaatgagctgagatcatgccactgctttccagcctcagtgacagagccagaccttgtcaaaaaaaaaaaaaaaaaaaaaaaaacaattccatcagtgtgcctacccctttttgccacttccctcttgctttcttcttctcaggatgctattgcacccattgtcaaggagcctaggtcacagttttcctgacttccaactaccagaagtccaacagaatatggctcttcaaatctggccccacaacacccagtgaggtccccatatgactgctagccctctatattcacagtccacccccttcaggggatcttaatgaagctatcctcagagtagttaaatggctttcccaggaatattcaatgaataaatggaggagacaggtttttgaaatcacagaaaggcggccaggagcagtgtctcatgcctgtaatcccagcactttgggaggcccaggcgggcagattgcctgaggtcaggagttcgagaccactctggccaacatggtgaaaccccgtctctactaaaaatacaaaaaattagccgggcktgatgacgtgtgcctgtaatcccagctactctggaggctgaggcaggggaattgtttgaaccagggaggtggaggttgcagtgagccgagatcgtgccgctgcmctccagcctgggcaagagtgagactccatctaaaaaaaaaaaaaaaaaaaatcacgaaagccattgcacataaattcaaaaaagtggaaaagcacacaaaaggtatacagttaaaagttattctcagccaggcatggtggctcatgcctgtaatctcagaactttaggaggctgagacagaaggattacttgagcccaggagtttgattgagaccagcctgggcagcatagtgagagccctgtctcaattttttaaaattaaattaaamattttttaaaagttcttctcaaccagaccccctctctggagataaaccactataacaagtttcttgtatatccttccagagagagtctctgcatatacaggcatttgcatgtatattatatagacatgtttgcaatatatatacaatcttcccctcctttggagctgggatttgaatccagacctgtgtaattctaaaatatctgcccatttcaccagacccacagcctctcagaccacagaagaactgggagctgggtgagtagttatcacaagagtgcagcacagttccactctgtaaaggtgccaggtgcatagggaaaagtgagggctggggcatcaggagactcaaaataaagtcctaggtctgaattgatatgttcctgagcaagtccttcccttcgctgggcctcaggtaagtcctctgaaaatgagagtgttggctggccaggggcggtggctcacgcctgtaatctcagcactttgggaggccaaggcaggcgaatcgtttgaggtcaggagttcaagaccgcctggccaacatggtaaaactctgtctctactaaaaatacaaaaaaaaaaaaaaaaaaaaagagccaggtgtggttgtacatgtctgtaatcccagctacttgggaggctgagacatgagaatcagttgaacccaggaggtggaggttgcagcgagctgagattgcgccactgcactccagcctgggtgacagagtgagatcctgtcaagaaaaaaaagaaaagaaaaagtaagggtgttggattagataatttccttcttatcttttgtttttgtttttgtttttggtagagacagggtctttctatgttgcccaggctggtctcaaactcctggactcaagcaatcctactgccttggcctcccaaagtactggaattacagacatgagccactgcattcagccagattaaataattttcttattttatttttcattttttgagatggagtctccctctatcacccaggctggagtgcagtggcacgatcttggctcactgcaacctctgcctcccaggctcaagtgattctcatgcctcagcctcccaagtagctgggattacaggcacctgctaccacgcccagttagtttttgcatttttaatagagatggagtttcaccatgttggccaggctggtctcgaactcctgacctcaagtgatctgcccacctcagcctcccaaagtgttgggattacaggcgtgagctaccgcacctggccacattagatatttcttaaacatatcctggctcttacattctaggcatttatgcagtcagatgtctagaaacgcaaaatgaaggtgaaggatcttgaactctggagacaggcagatctgggttcaaatctcagctgtgcctctcagaaactgtgtgactctgggcatgtcatgtaccctctctgagttttggttttctcattggtaaaaggaataactgggccaggtgaggtggttcatgcctgtattcccagcgctttgggaggccgaagtgggaggattgtttgagcccaggagtttgagaccagcctgggcaatataatgggatcctgtctctacaaagtaaaagaaaacaaaacaaaaaaaatcagccagacatggtggtacatgcctgtagtcccagctactcaggtggctgagttgggaggatgaatttaacctaggtggccaaggctgcagtgagctgtgagcttatggcatgttccggactcaggtaggttctgcagtggacacaaaatcacatgcactatggtcactgtggtgccctttgggcaaggactccattgctggctaggcctctacctctttggcagtaatgtcacctgtggaggacatcactttttttttttagacggagtctcactgtgtcacccaggctggagagcagtggtataacctcggctcactgcaacctctgcctcctgggttcaagtgtttctcctatctcagcctcctgagtagctgggattacaagcgcacaccactacacctggctaatttttgtaattttagtagagatggggtttcaccatgttggccaggctggtcttgaactcctgacctcaagtgatcctcctgcctcagcctcccaaagtgctgggattacaggcatgagccactgcgcccggccatctgtggaagacatcatttgtggaggtcagtaaggcaggaagcctgaacctctaccaggatgtggcaactctcccacctgctcagcaggcctccaagttctctctgttggatctgtcctctccaccacagccagagtgaattttctaaaacccaaatatggccaggccactcccctccctgagagttttcagtggcttctctttgacatcaagataaactacaaatgccttgaggtgcctcaraaggtccccaggtccgatctcttttcacactctccccttgaatcttctgcctcagccatggaagtgtgggcagctccccaagtgcaccagctctccaacacctccaactctttgcatatacctgtgcctgaaatgcaactgaaatgcaatctctccttctcctcctgactaatgcccacactattctcttgccctaactccataaggaaccattcagtatatctaatgtgtatctttctatctgtgttctgctaaaatctttaaatctttattcttggtcttgtgtgcatgtatttttaatgtatattaatagtgctgtgtcatatagcacattctatttcttactttttcccactcagtgttgggttttattggtttttttgtttttgtttttgttttttgttttttgggttttttgtttgtttgtttgttttgagacagggtcttgctctgatgcccaggctggagtgcagtggcccaatcatgactcgctgtagcctcaacctactgggctcaaactatcatcctgcctcagcctctcaggtagctgggactacaggcctgtgccaccatacatggctaatttttttgattttgtagagacagggttttgctatgttgcccaggctatgttgtccaggttcgtgttgctgtgttatcacctgctcagtcacttggacctccctgcaaatcctacagagtaggcacctgcccatgttacctgactctccccaagcttgatactgattgcctccaacttcctcacactacaaatgacactgcagtgaacatccttgtctaagtgcttttctctatctatatgacaatctctttgggagaggttgcctgtattgttcagcttctgattttgcccatctaacaggtgtaaagtggtagctggttttctgtttgcttgttttctgccagtgaacattttattcaaggtatgtgtgtggagagtggtcagggacaaaggagagtgggaatggcctttgaaataaaataaaatgatttaggtgaagaaactctaggaaagggtaattttctccatttagatcyttttttttttttttttttttttttttttgagacggagtctcgctctgttgcccaggctggagtgcagtggtgccatcttggctcactgcaagctccgcctcctgggttcacaccagtttcctgcctcagcctcctgagcagctaggactacaggcacccgccaccacgcccggctaattttttgtatttttagtagggacagggtttcaccatgttagccaggatggtctcgagctcctgaccttgtcatccacccgcctcggcctcccaaagtgctgggattacaggcgtgagccaccgcacccggcctagatcattttaagaaagaaaatgacagataaggtttctggtctatggaactaacaaacaagtagactattaatataatatcagatattaaatgccctgaagacaataaaataaggtaatgagttagaaagtgatggggaaaagcctttagattggatgattggaaggaagtaacatttgagcagacattggaatgacgaaccatgaagcggattttgttgaagaacatttcaggtagcgatagctattgttttaattttcatttctctgattactaatgagttagagcatctctttatctggtttttcaaattttgkatttcctcttgtcaattgcctgtttatgtcctttgcccattttcttttgaatttgttgcctttttcttcttgatttgaatatttgctgatatattctacatataaacccctcattgatttttttcttttctttttttttttttttctgtctctctctctcttttttttttttttcttttgacacagggtctcactttgttgtccaggatggtctcaagtgagcctcccaccttggcctccatgtgccaggcattgtgccaagcattctacaggcatgagccaccttgcccagcctggttttatattttccctttttggttttagacatcgcaatacctctggcattctttctattcctcaaacacgtcagctcctctgccctcaggccttcatccttgctcctctctctgcctgttatgctcctcccagatatttgcacacagggatttcttcacattaagcttagatgtcacctcttcccacatacccctcctccaggcacacgccattacatcatcctgttttgctagcgccaaggccctatcactacgatctggttcactcattgttttcttgtctatgtcttcctccatcgccctgaggataagctctggccagtctctgttaaacctcagcccctagtgcagtgsctggcacaggggacgtcctcaggaagcatctgttgaatgaatgaatagatatgccccggtcatgggccatggagtgaggaaaaggcaaggctaagagtggtgtgcttcaagtgacacttcaaattaggacaagttaatatttgttgagtttttaccatgtgccaggcattgtgccaagcactctataaggcttatctcattagtcctgataataatcctatgaggcaggtatttctattttctatttatgagataaggaaagcaaggtagagagataaaggaagctgcccaaaggtctcctttatcccagttagaaaacgggctgagaagaaaccaggacccaggggatctgctcctgagctgaggctcttagccaccacacatactgcctctcaaggggaggagggagggggagaacggctatggccagaatagagcacccttagaatccgagaagtggggtcctcccaggggaggagatgagggtggggagcagggaggggaatgctctcccctatatgaggccggtgaggcccagagagggttagtgaccaggccccaaacgggcaagccaagctccccaagctgcggcaattccactgtccccttccactttcactgggcagagaccgcgtggcgcgcattgggctgggcgtgatcctgaacctggcgaaggaacgcgaacccgtagagctggcgcggagcgtggcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgcttcggctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccgcgggcccgacgacctgcagcgcctcgtgccgttgctcgactctaaccgcttggaggcgcagtgcatcggggctttctacctctgcgccgaggctgccatcaagagcctgcaaggcaagaccaaggtgggtgcagatgtggggttgggtggatcaggggttagagagcctttgggaaggtttcccagaggaagtcacattcaaccgggtcttgaaatacacatcagaattagatgaagcaagacaaaggaggagcgggccagtcattttggcgttgaaggcaaacccgaagtttggacttggttttgggggcaagaggaagacactaagaagcttttaagcaaggggacacttgtgttttacaaagatcatcctagctgctgtgtggaaaggggcttggcaagggtgaggacggaggcaaggcaacccaataaaaaactatgacttgcaggggtgggcgttgggggaagggggagacagcgatgccagtggcagagagcagattcaagagatgtttaagagatggagttagcacttggtggctgggagaaggagaaagaggagctgaggatgactcctggccctgaacataggcaatgaataaagtgaactgggtgagagacaagtggaagtggggaaggggaagaaagtgacttctgcaggacatatggagtttgagatgcctgagagatgcccagctggggagcttcagtgggtagtgtagccttttragtctggagtcaagatggctgttagagacagaggcttgcggcttgggacaggacatcagtgtgtcagccagataacccccatcggagtcccaaggggtcctcatgtccagggcctaatccaccagtgacctttgcccactgctttaacttgctgtgtgaccttgagcacctggcttcccctctctaggcctctatctgggcctcatttttatcttctggaaaattcagtaaattggaccacagcagcagttcttaccctagatgtgggatagttttagcaccacaagtttgtggattgtactttttggaaacagagatctactatattgcctaggctggcatcaaactctcaggctccaagcgatcctctctgcctcagcctcccaagtagctgggactacaagcacgcaccacatcgcccagctgggctttgtttttaaaatgttacaggttgaagattctccctrcaatatcactctctcttctttgcatttttttgtggaggcttggaggttggtgatagctggtgcacagagatgtggtgcataccccatgacccaccttgtctgtaccccagctgtcatctgggggtgctcaaaggagtgtgtcttacagatgattgtcacccatcatgtatgtccctgcagatcaaaaagagactgctggctgggtgaggtggttcatgcctgtaatcccagcactttgggaggccgaggcaggtggatcacttgaggtcaggagttcaagaccagcctggacaacatggtgaaactctgtccctactaaaaatacaaaaattagctgggcatggtggcaggtgcctgtaatcccagctactcgggaggctgaggcagaagaatcacakgaacctgggaggcagaggttacagtgagctggaatcgcaccactgcactccagcctgggctacaaagtgaggctccatctcaaaaaagaaaaagaaaaaggagactgctatgttaggggggtctctggggcctctttcaacatccagtgttctaggaacttctgattcttctctctgcactccagagctgggtcagggaggacctgctctacaaggcaggtcattttgcttagggaaaagggtcttaaaggaagtaggragtgaggaccccaaggattggatctgggccgcaaccatgatcaccagyctgtcacccctttcccatcgaggccaagtgagtgtagttcaacaaagacatctcgagtcccactctgtgtccttcatcgtgccagatgcaggtttccagtagtgactaagacatgtcctcagcttatactccagtggaagttgcatcgtcaaccagtgacagtggcattcagagtgtggtataagacctcattggaggtgtgggccaggatgtgggggaatcaaagcaggctgcatgaaggaggtgctaatcaatttggattctggtggatgagtaggatttccgtggagtgggaggattcccatgagcagactggaagaactaagggtttggaaacatagtgggccaagacccagaggtgtgaaagccttggaatgtgtgcatgtgcgtgtgtgtgtgaagtgtaagttagtggaaggtgaggtgaactgggagtgatgggcagctgcactgtgccctgcctggcgctatgctgagagctcaactttattccagggccggtggatgctgtagaagggatataaaggagggataggcccctccgcccccaacccatccgagtcaggacctggtcaagaattgagagaacttcaggagggggaatccgcaggaccccatgacttagtggctgaaggtggggccagggcagatggagagactttgggttgtgagaagagacaaggagagggactgggcacgtgtgggagcacctggagagctggtgggacctacagccctctccccactccctccctaggtgttcagcgacatcggcgccatccagagcctgaaacgcctggtttcctactctaccaatggcactaagtcggcgctggccaagcgcgcgctgcgcctgctgggcgaggaggtgccacggcccatcctgccctccgtgcccagctggaaggaggccgaggttcagacgtggctgcagcagatcggtttctccaagtactgcgagagcttccgggtagagtcgcgtgggatacgcctcccccgagtcagagcgggcgccctgtgcacagggactgcgttccctccccgcctcgcaatcccgcggcgccagggtcgcttttgggggcggggagcctgtacgcagccaccgttagggtcactcggctctgatctaggtcccatccgcctcctccacgccatctccagttccttcccttgcatcttgtgctcgaggtccaagggcggagtagcgaagcccttcctgacacccgactcctcccccaggagcagcaggtggatggcgacctgcttctgcggctcacggaggaggaactccagaccgacctgggcatgaaatcgggcatcacccgcaagaggtacggagcctcctgcccgccggaccccagctaggtctaaataagctccccctccgcccacagcccgtccgagtctggacctcagcgtcttctcctccgtggggtgcaggttctttagggagctcacggagctcaagaccttcgccaactattctacgtgcgaccgcagcaacctggcggactggctgggcagcctggacccgcgcttccgccagtacacctacggcctggtcagctgcggcctggaccgctccctgctgcaccgcgtgtctgagcagcagctgctggaagactgcggcatccacctgggcgtgcaccgcgcccgcatcctcacggcggccagaggtcagcccgctcacccgggaccccgccccagccccagccccarccacggccctggaatggtgaggggagacacggggtggagccttccagcctcrccgtggattgattgagcacaaacgtgggtcacactgggctctgaggatgtaaagatgaatacgttgcactttacctcaagaagttcccagtctgaggtgggtaggcggtgggaggaaggaggctattaaacaggcaagcggccccggcaggaagctacccaggtctccagtgggagcacagaggaagcccagcccaccccatccayccaggtytagatttcagagaggacaggatgcctgaccatgtcttgagaggtgcactggcggggaggggtggcaacaggaagggcagcccaggcagaggcagcggcctatggagagtccatgcagtggggtgtaggcgggaagggtgtgcgtatgtgtgttatcctattggccaacagcttacaaaatttgggtctagaggtggtttagagtgaattctaggcctctagccaccctccttatttactaatttatttttacttactaatttactacttagctaatctttattgtcaattacaaggtactctgtttggtttttaagatattatcccatcagtctctatattgattctatgcaatgagtgttcagtttttaaaatcaaccttaaagaactcttgaaagaataaaaagaggagtaagtgtccagtttgagggccrggcaccgtggctcatgcctgtaattctaggactttgggaggccaaggcaggcggatcgctcaagtccaggagtttgagaccaacctgggcaacatggtgaaagcccatctccactaaaagcacaaaaaaatacaaaaaattagctaggtgtggtggcgcatacctgtagtcccagctacttgggaggctgaggtgggaggatcacctgagcccaggaagttaaggccgcagtgaactgtgatcaggtcactacactccatccagcctaggcagcaggagtgagaccctatctcaaaaaagaaaaaaagtatcagtttgaggagttttgaaagacatctgtgtgaccccccacccccaccatcatcattaaagatatagaatatttccatcatgggtgttccttttaaagataatgaaactaacatttaaagaattcaaatacatttcccacagtcataaaagtcattagatggcaaaactgggacttgagcccttgtctttctgcttcataaacaaacaaatgttgtctatgagggttatgtctaaatattataagaagatgaattcttttcattttatcctttcattcagcaattacagactaagcacccacaagacacaagggactgagctttggctgcattcttatgcttcaaccaaagcaggttggcttttattatttttacattgcagctcccattaaaacttcaagatttcatttttattataattaattaatttgagacaaggtctcattctgtcacctaggctggagtgcagtggcgcaatcacaacccactgaagcctcaacctcccgggctcaagtgattctcccacctcacctcccaagtagctgggaccacaggtgcgcaacaccacacccagctaatttttttattttttgtggagacagggtttcactatgttgcccaggytgttctcaaactcctggcctcaagcaatcttcccaacttagcctcccaaagtgttgagattacgggcgtgggccaccgcacccagcgcaagatttcatttttaaacaacaggaaaatcctagggcaaaaatagcttacaaaaaatagtttgtatagtgagtagggagccatgcatagtttttaagtgggaggaatgacatgctcagatttggattttagaaagatgttctggtagctgtggcaaatggactacactgggcaattcttttcttttcttttcttttctttttttttttttttagtcagagtctcactctgtcgcccaggctagagtgcggtggtgcattcttggctcactgcaacctctgcctcctgggttcaagtgattctcgtgcctcagcctcccaagtagctagattacagacatgtgccaccatgcctggataattttttgtaaagacagggtttcaccatattggccaggctggtctcgaactcctggcctcaagtgatccacccaccttggccccccacagtgctgggattacaggtgtgggccactgcccctggcctagactgggcaattctagctgggtttggggaggccattgaggaggctggcattggaaacctgagccagggaagggcccggaggctggagtccagtatgtttagtaggtagaatcctcagaatgcggtgcctggcgcttagtactgagcgtggctccagaggagcagagtgctgtctgttttactcactgctgaatctcaagcactgaagacagtcctggcacacagcaagtgcttaggatgtatttgttgaataaattaaatgggaggcaggagttgaggctgatacccaggtgtctggctttggtgggaaatagggaagaaggaatgagggggagatttggggtgtgttgaatttggagtgattgtgggcagctggctgttcaggtctggagttccagagagaggtcagggctggaagtgcatgcatatcaatgtccctagaacacagtgcctgcctcctaagaggaacccaacaataacatgaccttcctcctggaggccccatttctcctttttggggcaggccaccctccccaggctgggctgagagggcttggtggactggggactaagtccacaagggatgatatacctgacagtgagtgatgcggaggggccaccttcaccatgctgcctattgcccacttcagaaatgctacactccccgctgccctgtactggtggcaaacccagtggggacactccagatgtcttcatcagctaccgccggaactcaggttcccagctggccaggtgaggaggggcgggcgggcagcgacggggcgtggggacaaggctgtggcactgacacaggacttacttgcagtctcctgaaggtgcacctgcagctgcatggcttcagtgtcttcattgatgtggagaagctggaagcaggcaasttcgaggacaaactcatccagagtgtcatgggtgcccgcaactttgtgttggtgctatcacctggagcactggacaagtgcatgcaagaccatgactgcaaggattgggtgcataaggtaggtgcctgcctatgcttctgcggtcccagcattggcctgtggtccagaagatagggtcgtcttctattccttcttgtctgcacatcccggcacacttagccctgaagcacctccttggcccagctggaagtcaggaaccacagctctgactgtaataggactttagcaaaccacaagggacaagagactaggctttggctctctgagcctcagttttctttttcttttttttttttttttgtttttgaggtagagtctcgctctgtcactcaggctggagtgcaatggcgtgatcttggctcactgcaagctccacctcccgggttcacaccattctcctccctcagcctcccgagtagctgggactacaggtgcccgccaccacgsctggctaatttttttgtatttttagtagagacagggtttcaccgtgttagccaggatgtgagcctcagttttcttttctgcaaaatggggtaacttacctgttccactcaccttatagaactgttgtgaggatcagagagacataaaaatgctttgaaaaataaattccatgagagacaggagagcatagcgacaggcagaatggaatagttgttgagagctcaaaactgagagtttgaatcctggctctggccttgggcaagttacttaaccccgataagcttcatatttatttctggaaagagggtataataatagtatctaactccctagaacattgttataaggactaaaaaagccaaaatttgtgaagtgcttagcagaatggctggcacatagtaactgctcaataatggtagcaattattattattaatataattattataactactatatctgtttaattcatcattgtattttcagtgcctgacgcattgtaggaacttattgaatactaacagaatgcattgatggatagctccatattgcatcttcaggttattaatcattaatcggtcagtaggaattggagttggggctgagggatgcagtagtcatctaagagacaggatgagacaagcagtcagctcagagacaagaatatgcccagagggctgggcacagtggttcacacctgtaatcccagcactttgggaggctgaggcaggaggatcacttgaggtcaggagttcgagaccagcctgggcaacatggtgaaaccttgtctctactaaaaaaatacaaaaattagccaggcatggtggcgcacacctgtaatcccagctactcaggagactgaggcaggggaatygcttgggcccagaagacggagatcacaccactgcactccagcttgggcaacagagtgggaccctgtctcaaaatgactagatcgcatacaagttgktgtaaatgctgagccaggtaagcaaacatcttgcttgccacaggggtttggagaagggagagagcatcaaggtgtcaacgaaaagagtcagactctatgagcgaccatggcctgtgacacagccctcaggaraccctgagaacacgtgcccaaggtgatcagggcacagtttggttttatacatttttgggagacacgagacatcaatcaatacatttaagatgtacattggtttggttcagaaaggcaggacagctcaaagcaggggcttccaggctataggtaaattttaaatttttccagttgataattaattgagtttatctgaagacctgggatcaatagaaaggraatgtttaggttaagataaagggttgtggagaccaagttttattgtgcagaggaagttctcagggcagacttcagagggagtaggttataaaatgtttcttatcagacttataagggtgcctggctctttgttgattatctcctgagtccggaaagaaaaagaaaaaaatggggggaaggggattctctatagaatgtggccttttcccacaagagacaaacttgtggagcaatttcaagatatggcagggaaatatatttggggttaaaatatttttatttcctcccttattatgtgatgttatgctagagtcaggttagaaagcagaccacgctatatagggttaaaattaaaacctcctccgataagactttatggtttgtagggcatgactccctaggctccttaggtaggaatttgggcaagataaaaaaaaaaaaaatcagagtttagtcctcaaaggactggaataatcagggaagacttcatggaggaagcaggtcttgagaagaatcttaagaatctgggtaagtggaatagaaggcatcccaggccagggtaacagcatgagcaaaggaataaaggtagggaggagaacagtgctgaaagcccacatacatcttggtactgctttctccatatcacagatgaagaaactgaggctcagaaaagtagaataatgttcccctggctgcactactagtgtagaaatcagaaaagctaggcttcaaattccatctatctgactccaaagctcatcactttcccaagatccacactgcattctatggcacagctctgagggggtgtgaggggaggtgatggggtagggctggattcggttgacaccagagatgattgtatctcttcacaactccacatccagtgatgtcatgttggtagcttgwcatcagccatggtgggagtatttacaccaaggaaattggcaaccactacaaatcaaagttttgttagtttggttgattggctggttgggttttcttcccccatgaatagctagttactataaagttagcagcacaccactggctggataagaaccatggaaaccaggtaaagcagtgtctaaaggcaggagaagacctgtgcttaaagcactggaaatcaaggagcccatgaaggagaagatgccagggcggtgggtcttaggatgaaggctctgacactggaatgcagtccacatggagtgtggagtcaagccccagaggccatgtaggaggggctgagtactaggcctggtttggggaggggcactggggcagttgagcatccaggaagaacatggctgataacccagagcatgtggcaggcagccttttgagagaaagaaaagagtgtctgtgagctccatgagacttcagaccttgcctcattcatctgtgtccctggtgcctaaaaccatgcatggtacaaaggaggctctatgcaattgcaccaaaaaaaaaaaaaaaaaaaaaagagagagagagagaggctgaggctgtagaggagtttatagaacaattgaatcaatgattaagcagacaagtgatactgatgaagctgagatgccatgcctgggagagccatacatatctagtagatttaccaggttagaggacttgactccgtttttttttttttttttccagtagagatagggtttcgctatgtcacccaggctggtcccgaactcctgagctcaagcctggagttcagtgcctgcctcggctccccaaagttctgggattagaggcatgagccaccgtgcccagccagaggacttgactctaattgttttcgttctcaaccagctaggtgatcctgaacaaaccattatccctttcttttatttatttaattatttttttttttttgaggcacagtcttgctctatcaccaggttggagtgcagtggtgagatcttggtcggctcactgcaacctccgcctcccgggttcaagtgattcccctgcctcagcctcctgagtagctgggactacaggcacacgccaccatatccagctaatttatatatatatatttttagtagagacggggtttcaccatcttggccaagatggtctcgatctcctgacctcgtgatccgcccgccttggcctcccaaagtgctgggattacagacatgagccaccacacacggccgccattatccctttcttggccagcctctgaatctgtgcgatgaataatttgtactgtctttggttttgtataattctggatgaaacaaatttctaaaaatttccaaataaattgctgcaggctcaggattcattccaatgctcagcagaaaggcagcagggcttggctgaaacagcctggacttggactcccgaggcttgagtcagaggaccggcccctcgtgggctgggcgtgtgtgtggcttaggaggaaatcccttcctctctgggcttttttctctccatctgtaaaatggagcggctccccaggaagccagtcaaggacgaagttacgcatgttctttccccaggaagrctccacttcccaagaatgcttggcaccccttgtcgtcccagcagatggcaaagaggtgagaggagcctttgtcttggaccggccccagaggctccgtcatccctctttggttgtttctggtgcttaattgcctctggttttaaaactcctttccctgaagccacattagtgggtaatcaatagggaaaaaccacaagtgaactgcactcaaaaaagtaaaatccctttggttccctcttgagaggaagaaaaacattcaataagcacttaatggaacccgattactagcaaataattcctcagaacaacgctttgaggtaggttttattatccccactttacagaagaggaaataataacacctattacgtattaagcatacactgcatgcaaagcactgttctaattacttgccatggaatgttgcgcttattccatggaacaatcctgaagacagggactatcattaatcctgctttatatattagaaaacagaggaacgagtgtggtagtgcaggcctgtgatcccaacactttgggatgctaaggtgggaggatcacttgaggccaggagtttgagaccagcctgggcaacatggtgaaaccccatctctactaaaaaatacaaaaaattagccggacatggtggcacacgcctgtggtcccagctacttgggaggctgaggtgggaggatggcttgagcccaggaggttgaggctgcagtgagccttgatggtgccactgccctccagcctgggcaaaaagtgagatcctrttcccctgccccccgccaaaaaaaaaaaagaaagaaagaaaagagaaaacagagactttgagaacctattatttttgcctcaggtcgtagagcctgtgtcagagactcagtgcaaaccccgatttgatgattccagagtgcagccctaactgctgtgctatgttttctcattcattcattcatccatctattaaatatttagcaagggctaactataagggctttgtgaaagatgctgagatataaggtcagtgaaaaatagatatgatccctcctcatgtctggcagagaagacaaatactgagtaatttacccattaattaattaaaatttgcaactataatatgttctgcagagcctataataggggaactgacttggtcagggcagtgggagacaactgccctgtgtaagagttgattgagctcagatcagaaaaatgaatgggcattatcaagggggaaggacaaggaagcttattttgtgtgtctgggaggacagggcaggggtagagtttgagaagtggactgtggccaaccacatagggtctcacaggccacatgaaggagtttggactttattctaagaccatgcaaagtcttgaagaattttaagtagggggtgacaggacctaatttgtcagatgtgcattttgcaaatattagctacatgaaagggcaatgtggagagtgaattagagaagacaagcgtggatgaggaaagacctggtgggggcttaragataatggggattggaagagggtggtagtggggtggaggtagggaaaaatagtggatttgagaaataagtaaggagtacaattggcagggcgcatgatggatcaacctgtacgcaggagtgtgatgtttttcttctgacaccaaattgtttggggtttttcccacactaaccactaattctccagcttgccaacaccaactgggtatcccgcaattcaattcaattctgaaatgtcagtcacgaggcccaggcccccaggctgccacatttctgtttgatttggctacaaattcgggggtgcccatgacaccccgagattcaatttgccagaatgactcacagaactcaggaaagcactttacttactattagttgtttattatgtcaaccttaaataatgagattcagaaaataagactaagtatagagtttctttgagtgcaaagtttgagaatagccacccagtaagcattgactccaaaggmatggggtgagcattccaaactggagaagttaaggtttcacttccacaggcaaagagagaggaattttagcaggattacaacattttccatacaagaccagtgcrtatgttacagtgctttgattggttatagattgctacattccaaggaagatgactttattaccccctgagaaagggtggtgatctaagtggggatctaagggagtcttatctctggtgccatttggtcttcctaagtaattacagaaaaaaaaaaaaataggtggaagttgcagctgcatgccccatgactcaggctgcagagaccaattcctgtcaaggctcagaataacttaaagttccaagagctttaggtttgatttaacaaagcttgaataatagtaataaataatattattaatctcaaaatcctgggctcaagtgatcctcctgcctcagcctcccaaagtgttgggattacaggcgtgacccaccatgcccagctgaattatttaatttcacagttataaaggacacagctcaagaatagccaaatggaagagatacataggatctctacgtatggagggtggaggtgtggatgccatgccttctaccaccttcccagcacctacacctgtttatcaacctggaggctcttcaaaaccccttgtttgggggtttttatggaggttccattatgtaggcatgattgattaaatcattggccattggtgattgaactcaatctccagcacctctctggaggctgggaggtggggctgaaagttccaatcctctagtcatgccctggtctccctggtgaccagccctcttcctgaaactatctaggctacccccatagcaccccccrggcccccagtggggaatcatctctttagcatacaaagacactcatcactcaagagattccaagggttttagcagctctgtgcyaggaactctgggcaaaggaaaaatatttattttttattacactacaagggttaaggtagacatcaaggtggacatcaggactggtgtcctgccctgggcccagcctcgggccagtgggcctcccagcacctgcctggctacaagggtccctagatgggtacaggggtatcttcctcctttcctttctttctccaggagattgtgactgctttaagctgcggcaagaacattgtgcccatcattgatggcttcgagtggcctgagccccaggtcctgcctgaggacatgcaggctgtgcttactttcaacggtatcaagtgagccccagggccctgggaccaggggggtagggtacaaatcaccatgacaggcagagtgtgggcaaacagctgactagcagctccctctgcccagctgtctgaaccacattggctcctgtgcccacaggtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggkgtggttctgcattcccttctcctgctgatagcagtcagcttgaggaggatgamggaaggcagcctcagacaggaattaaggcaatgcccaggcrggcctgggcactgtattctgagcaarggcctgggcccaggagccagccagggatgagtgccatcatggctctccactcagactgtgcctggcccctgcacttacaacttcctgcygctctgtggccttgccctgtaatcactcagtgcccttagctagcctgactaagtcccagatcccctacagcttccttcggtgtggtatcttttgccacatccagggygagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacwgattcccaggtgagctgatgctggtggttaagggtagcaaatctctaaagcacgaagccctcacaartctttgccatttcccaaacactccgctccatggtctccagtcatcagagcaactctacctggtattatcatccccattttacagataatgacactgaggctcagaaaggttgaggataagcccastttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggctgcgcccccagccccactcttggcygtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccaggggatgatttctggctctttgtctccaatcagtcccactccctcctgaggtccccaagggcagtattcagagaggtttcctgcrttttatttctatttggtataccctccactgttgtccactgccctgtgtggccttctggttgacctctgcccgatcttctgtctctctgagggaatcagagtccagcatccagccccagctggaacagctgaagtcacaagcctcctctaagccaaggccagtgtgttcagaggtgactgccacccatactaggacaaacacagctcagatcaccaggtcaagcacctaggcctggcttctcctgagacagaggactcagaagtggcctttcctccaaagcctgctcagacacarrtctgtagggccagggtgttctgcttggctgggctgcagctgctacccctcggttggggctgagtcagccagatcctccccctacttctccccaagggccaagaactgctcagggacattaaaggtcaaaagtccagccacactcattcatcctttccccaggcccatgaagagaggcatctcaytgtagaatgtatgaggaagtgggaagtatctcagagaatcagctaagtttcctaacttgtccatccaaatgtgatcaccacgattcaacaatttggggcattgctgatctagccgttcctagtggggcttgctcaaggttgcacagcgagtcagtagaagccctggctggccccacttggtaccaatccaccaggcagctcagggctcctgcccagcccagcagcttctgttgtctaacgtatggcaggcagactgggagcaggaaaacagagggccccaaagcccaaggcaccagaaggtttgtttcagtttgctgaagctgatttgtaatgattggcactcttcagccaggggagtgggtaggccatagccaaggatcgattccccaaccacagcaaaggcaacactcttcctccagagatcaccaagcccctcttacctccctccctccttcccaaggctggcactaaccaggtaccacattcattgttaaggaatggctgatgactgctacacgtgttgggaacctggttggggctgtgcagtttgggctggaaggagagatgccagccctcgtgctgcctctggtccctgaagtgtcacctctctcaggacctctcctctggcctgtggggttataagtgatggatagcagaaagggagaactgactcctgtcccaaatagctcctctsccacctgtcctgcagtgggcctgtgtgggttatgattctagatcctagacagaggctgggtcagctgtggatggggtggtgccttggtctctcttgactacctcgtccaaagagagcactgcccttagacaagagttgcttgtcctgctgtgggctgggcttccagctgcagacctccagttgcttggtgttcactttgctcctcttgccctctgtcttctggtccaggcagatcaggggctctggggaaactgctggaactcgaggtgaggatcagccttttccagcatcctgtgagagaccagagagagagtttggatttcatgtggggaaccctcaaggcctgtctggagaagtgacacaggatttactggggtgggctggtccaggtagctctcctgaacctcctccttccccaagctgagaagctgagagctggaggacaatatccagggacatggctctggaaaataacttttttttttttaagagacagggtcttgctctgttgtccaggctggagggcagtgacataatcatagctcactgtacccttgaactcctgggctcaagtgatcctcctgcctcagcctccttagtagctgggactaccagtgcataccaccatgcctgggtgattttttaaattttttatacagacaaggtcttgctatgttgcccaggctgatcttgaattcccgggctcaagtggtcctcctgcctcagcctcccacaggatcgggattacaggcaagagcctccacgcccggccatgaaatataattcttaatatcatacaggaaaaagtcagcgggtcaagctagcctgtggcccagccacaactagctgacaaagcttcctggccttccctttaacacagttctgctgccatagttccatctataaaatgggaatggagggaaataggggaactgggakagagaacacagccttgccaagcagcaatgttagcctgatccttcctccacctagctcgccatctcgcccttggaaaatggctcctggaggattaggcagccatctgcaaggagaggggcaacctgggacaagacacccagagggtaaggattccaggaatgaagctgccatttctggttgggaggagaagaggaaacttttaagagaaagggctccattatgagcatgggttcagggccctgcrttacccaatcagaacagccgggatgagcaggaggccagctcccaggaggaaggggaaccccttcataaagttcagagtggctgggtagagtgagttgaagatgccggaggccgtcagcatggccaggctattcacacaggccacagcagaaaagagagcacctgtgaagaaataaataccatactctggagtccgaaagggccatattccaactctggcaccaccacctcacagctgtgtgaccgggagtagtcacttaacctatgtctccccttcctcaccagtaaatcctgctacatcatgtactgtgacaaggattcagtaaggtcatatgtggayagtagctggcacagaggggctactaaacaaatggctgctattaaatccacattaaaagtacatgtgatctgacagaacccagcacataaaagaaaaaaaaaagtacatgtgatattgtctgatgaaagcttgatggaaatggcttttttctggtttatcctctttggaatcatctcctgtttgggattaactgctggtctgatcagttccaatattcatagcggtgtcaccactgaatagcttcttatcctttgggttcctgttcctccttctgctaaataaggataatacctatttcctagattgtgagcaacattaagttcacatggaaatcacccatcactgggcctggtcccctggaagtagctagttagtaagggctgttcttttctcctgtttctcttgacatctctgggcacagagaaagtgctgggaaaaaaagtttaggtgaatgaatgaagacacatggattctggggacaccagaacccacagtgggctctgtatggcaccagagtctctgtcatcatcagatcctcattccaggacagatggaaaaagatgaatgtttccagactggggcataaagacccagaggctggagaagctgttctttatagatataccaggagaacccacagtttacaaaatgtgcaacaacccaacagaagttgagattaaattctgtcacatctagaggggtctgtgatgtcatcaaaagcaaaccacccacatcacagatgaagaaacaggcctgtggcagggctcggactaaaacccagatcctgagaccagctgcttttaaacacagacgtaggtttgcatcctagctccaccatttactgagtaaccttgggtgagccaatgtaaccccctgggtctctgtttctttatctgtcaactgtggaaaatgaaacccatgtcacaaggttgttcacttctgggcttgtacacgctgaccccagagaaacagggaactctggcatcaccacacccatcttacagacggaaaagctgaggtctgcagagagtaaatcctctgctctggttatctagaaagaacataattgtgctctgctgactgcaaatcccaactctgcggtttgaaaatccaaggtggcatgatcctctgcccattgtgggcaatttcacagaaatgtgtttgttttggccacttacttctccagggtgagaggggggaaggcaagctgttcccccagccatggctgcccatcagcccgtttcgggcagcactggacatgaggaaccagacacaggtgggttctgacactcaccctgctctgtctctctcaccagcttggagagtttagcccggatgacaggtgtgatgactaatgacaggaaaagcaacccatatcctgtggagaaacaaacactcatcaggaaaatggggctggggagaggggcgtccaagggaaaggcagcagagctcctatccataccccatgtggggcttaggttagacccaggaagaacttccttgatggtgagggtgggaagacagtagtcaaggaggaatggagactgcccttgtctgggcttggccacctgctagctctcatgaatgaatgctaattcccattgattgctttcttgtctgaacctcttgtggtcacagcaggcatcacccacccacttggcacttagtagggatatggcagggcacagaaaacaagcatgggctttggagtcagccctgagttcaaaacctgatgccattacatattatctgtgtggcctggggtacttaccctctctgatcctgactccctgtatgaggaagataataaggccttcatcacaggatggttctgaggcataggaggctgaataatggtgcccaatggcatcagattcatagccctggaacctgtaaatactaccttatttggaaaatgagtctatgcaggtgtgcagttaagcctcctgagagagcagagttatcctggattaggttgggccctaaatgccgtcacacatatctttataagaggaaagcagacggagatttggcaccgacagaattgagaaggcacaaagaggaggagagtcaatgtgagcacagaggcagagactggtgatggccgccccaagccaaggaatgccagcagccccagaagctggaagaaatgagaaacacgttctctcctggaggcttgcaagggagcactgcctgctgactgcttccattcagcccggtggtactgactttggacttctggcctccagaactgtgagagaatatgtttctgttgtgttaagcccccaagtttgtggtatgtcattacagcaatctcagggaaccaatacatgaggtaaaaaggtaacatctatgaagagcatggcatagggacacagcaaatgggagttccttttccctttgcattcagttacttacaggcttcctgttttcttcataaccatttctctccctgtgcgactgctgactcctcagcaaaactgcaaactcctacaggacagtggatcctccaaagaaggtatacgatgaggcatccagggaccctagcagtgtcaggcccctcaaatcccactctgttgagacctccccccgacccagagcaatgacagcatctttatcatctctgcatcccccagggccatcagcaggagggaaaggttcccttctgcttaattgtcagacaagcagttgagttaagaaatctgtgattattgtattgttgactatacacagcacattttagggctctatcaaaataaatctgtccctttaaaaaaagttaactaaagccgggcacggtggctcatgcctgtaatcccaacactttgggaggctgaggcaggcggatccttgagctcaggagttagagacctggactgggcaaaatggtgaggaccccatctctataaaaaatacaaaaattagcaaggtgtggtaatgtgcaccagtggtcccagctactagagaggccaaggtgggaggatcatctgggcccgggggatgaggctgcagtgagccatgatcgtgccactgcactctagcctgggtaacaaagcgagaccctgtctctaaatacatcaatcaaataaaaattttaaaaagttaacttcctcatttactggcctgttgaccctctcccatcaaaaaaagaaggggaggaagtgaggagggaaaggagaaggagaaagaggagaagaggaactgaagcaggaatttcatatctgtggtccgagaagactggtttttaaaaaacccaaagaagctgactaagggtatttgaggtaggtcctgtgattcttatcagagaagtgagtaccaggcattaatggcatggactttgtttaagaacatatgaataggcggtgggaggccaaggggtaaagcaattagtgtatgagccacacttttgtcttttgctctatattactaacaatattaatggttgataacagtgggttaattactttagctactgaaggtctatattttccatgtatcaaagatggcatttttgagggatttcttagttgtctgttctccagtgcaggctgggggcataactatgtttccaaagacacaggaatgaaccacatctgggggcagtgagtggccggcccccagttcttacccagtgcctctgggacaagctgtccctgagcccacacactttacctgtgaacatgagaggcgtgatagtggcaaaggcaaagaccaccatccccaggatgttgaaggccaggccgatctcagctacccaggcatcggccaggcagtactgcaggagcttcagggccagcaggctggtgaggtaggggagatgctgagctgcagaaccatagccgattagtttggagtcccagcagaggggtgtgcttagttcataaagggttaagatgtcctgggccccaaagtgcacagtgatcaccacgaagatggccagtgagtagagggctaaatgtttcctggacttctctggggcgggagccacatagagctggacaatggatcggtggtgacggaacgtgaagagccgggtggactttggctcctttaaggtctcaccaaagcagaaagctgcatagagagtcatggctatcagcaaggccaaggccagccagaaggggttggcataaccctgggcccggagccagtggcccccgaggaggcttgccagcatcccagccaccccgatgctggcttccagcagggccatccggaaggtgcggctgcgactggagctgacatctgccacggacgcaaagctagcagccagaaggccaccgaagtcgccgaggagggcacaaaggatgcgacccagcacgaagtagccgacgtggagctgcagctgcaccacaaaaacggacactagggcctggagcagcaggcccagcgaggccagcactagcagcgggcggcggcccacactgtcgctccaagctcccagcagggtggacgagaagagccccaccaggaagccgcccacgttcatgtagagggtccagtgggaggtaagggtctccacttcctgtaggggcacaatgaccagggtgcggttcctcactctgggttccacaatccccaaatcctcgccatcccgggagctacagggatgaggacttcctttggagccctaaacctcagagaatcttagcacagctttcaaaatctgccagtggagagggggaaggacatggaccaaggccccattccctttcctttccccccccttttgttaacctgcaaggccagactttagctcagcttttcgcatcccacccgctgaggttctcggtcaggcccctttgctctggtcccgcccaccatccaaaatgcaccctccctccagttacccgccactaccattacgcaggccccgcccctccgctgcccccacgctccagaccagggccctccacctgccaggctcctcgccgccccgctacctgcatggtggggtccgcgctgcggttgctgcagccccccctttggcgggtgccattgtagccgaggtcggcgctgaagcggtgccacagatactgcgtggtgagcgggccctgcaggaccaaggcaaagttggccaggaagaccagcggctctaccgggccccggcacagcacggcagccgcagggcgggcgcggggcttttccggggggctcgcgctcccctccatgtgcgtgcgcggcggagctgtcgccaggcgggcggcggggcgcgcgagcgactcgctgcctgggaccagcgacgcgtggcgtggggcttgcgctgtctgcgcctgcgcccggcgtccctccttaaatgtccggcggggaggggcctgtgacctgaggccaccggactctcgccgcgggtgcacctggctgggcgtgggccagcgaggggcccggcacccccagcccgcgggatgacctcacctgtaaagtgtgcgtagacaccgccctgcagccctccctcccggcccagacacaccacagataacaagaatatcaacaattaacatgtattgaccacttactatgtgctgggcacggtattaaaccctttttgtgcgttggtctcccgataactctacaggctagccaatattaaccatcgctatctaccgctgaggaaacgaggtcatcgggtactcaaggcagagctggaagagcacatgactcctgatgctgctgatgttctgcgctgtaacagagaggcagctggagaggatcggagtgggctgagcccagctgcctgggttggaacacctaggctctgccactaccttcggcatgccacttaccaccctgagcctctgttttttcatctgtaaaatggagttgctaacaaaacatgtctcaaaaagttgtggaaaagcagtgtctggtatattcaaagtgctattattgctattaacaggctgtcacgtctgggagtggtggctcacacctgtaatcccagcacttttggaggctgaggcgcatggatcgcttgaacccaggagttcgagaccaatctgggcaacatggtaaaaccctgtctctacaaaaaatacacaaaaattagccaggcgtagtagcagatacctgtagtcccaggtactcgggtggctgaggtgggaggatcaattg

SEQ ID NO: 1715 - DNA, 18038 bp, Homo sapiens
cacataccctcatgcccatgtagaaggggatgacagtgacacgtatgttctcagttgtttcccgatgaacatcggagagctccagccaggggtgattcttctcttgccaggcccttagcgtctcccgagccacaaaaggaggtgctggggcaagatacaattggttagtccaattgtgtgttgtggatacaattgtatctagtccaatcacacaatagtccagtgcgattgcccctcctagaaaaccctccctagtggtggcccaggcaaacaaggtgctcatacatgaagcaaaagttcaggctggaagaaggcacaggactgctaccaagaataagccctgaggagctagtgtgatacaatgggaaaacaatcggactggcagttaagagccctggttttcagccctcactctgctactagcaaccttgagtcccttgtcatcatccctgatcctcagtttccatatctgtaaggaaataactgccatctgtcatctgtcaggtatgacacctatgaggcatgacagctctaacaggaggttgaaaagggttgtggaaatagagcgttggaattatttcttttttttttttttttttttttttttttggagacggagtcttgatctgttgccgggatggagtgcggtggcatgatctcagctcactacaacctgtgcctcccgggttcaagcaattcttcagcctcagcctcccaagtagctgagactacaggtgcacgccaccacacccagctaatttttatatttttagtagaaacagggtttcaccacattggccacgatggtcttgatctcttgacctagtgatctgcccgtgtcagcctcccaaagtgctggagttataggcgtgagccacagcacccgggcctttttttttttttttcctgagatggagtctcgctctgttgcccaggctggaatgcaatggtgcaatctcggctcactgcaacctccaccctcctgggttcaagtgattctcctgcctcagcctcccaggtagctgggattacaggcgcccaccaccacgcccagctaatttttgtatttttagtagagacagggtttcaccaggttggccaggccagtcttgaactcctgacctcagatgatccacctgcctgggcctcccaaagtgctgggattacaggcgtgagccaccgtgcccggccctggaattatttctatgatattctttgatgaaaaggccctcccattccacctccccttcttgagagagattaccttttgtctggtcatacagaagaaatctttcaaagagttcatgttggatgggaacctgatcagtggaggtgtaggggaggatgtcttcatggctgacatagtccaagcctggcacagagatgcaaaagacagtggtgaaactcacaggagaggagagagatggggttgagaagaaacattaactggccttgttccagtatgggataaccctgatatcatacctctcagcatcataatccctcccagtggatgacaggacatcagaatcctctccctgagacacaccagactccttcttgacgggcaccattcaaatgctaactactcacctgggatggcatagagggcccgactgtcatcatggttagccaagaaggtcacagcttctgtctgagatctctgagactaaggcaagaagtgaatcagtggtgaaaccatgtctctgctaaaaagtacaaaaattaggctggtgtggtggcagatgcctgtaatcccagctactcgggtggctgaggcaggagaatcacttgaacccgggaggcagaggttgcagtgagctgagatctcaccactgcactccagcctggcgacagagtgagactccatatcaaaaaaaaaaaaaaaagacgtgaatcagggctttgttggccactgtgcagtccaaggccttggggaccaagactgacctgggctctgtttgacccccttccctccctttgtccccattgggatgcaggactttccatggagaggacccccaagcccagccatcttgcttacttactatatgtgggcagtcacgagcatcaatcagcacctgatagtaagtgtgagttttgcctttcacctccttggagccatggccagcagggttctctgctctatggggtgggagaaggaggccaagatcaccccaggagaaatggaagctgtggctgactcagctccctactcctcctcacctaaacaggctggtctctgatctaaaggggctttagcaccagctggacacctgctctgcagcacctcagctcagctgctcctcagttggggcaaataatagagcatggaagaccatggtatggagccatcatctgaccgtgtggatacctcttaaaagaagggggccatgttgagaaaatcaaattgccacctcagtccccagggcccagagtactcttgtcttcttatatcccagggactgtctgtgatcacttaatggggctgaaccttttctgttttaatgtattctagggatgatgtgagattgagggaaagactccagctgaacatcaagaaatcaagaagacttgtcccccaaatgccctctgggatactcataatgaaaattaggaatggcttaggaaagcattctgaggaggcctaaagggactctctgacttagactatccctggcactcagcacttttgtctccatgggtcttagtcccagagaagtactctggggatgtttccaaggcctaggaggacgctgtcttcacccctagtaccccaattacatatgtctgccatctcctcctgaggatactgtgaggcacaaccacagggaaacttacttttctggagctgcagaagccacatcccggtcatacagtctggcctgccagggaaacaggacgacacctcggtagccaaaaatgctatgaaggaaaagctggaaggaaagaggggcctcagtgagtctgcagtccagcaaatccatccaggtgggccccagaccacaaagcaacacaggtggaggcaactccagcacaaggtcttgctacctcttcccttgaagtctgtgatcaaccagaccaatgctggaacactcttatttcttctttacctggctgactctactcatcctttaggtaaaagcttaggcctccaggaagccttccctgacctcccttccacttagcacaatgtacagctattggccatttgcaaatcgttcttttctagactagaaactccacaatagcaggaatcatgtctactttgctttctgatttaaccctaatgcacaatgcctagtccattgtaggcacacagaaaaataaaatgttgaacaaacaaaaagtcttccttacctacaatatcctagaagggcctaaatctatcccagtggacccagaacaaagctgatatagaaaaagaaccacacatccagagtttaccacactgaagtcaattttattacggcaaagcatcaaaggtatacttttctgaaagctccctccacggcttcccaccatccactatgttagagaaatcttcagcaacttggctaaacctcactatagtccacaccatccctgtccacattaacttggaaagagaacccactgacacattaagtgcattcaaatccaggagaacagaaaccctatctataaaaatttgattctgggctgggtgcggtggctcacgccagtaatcccaggactttgggaggccaaggcaggtggatcacctgaggtcgggagctcgagaccagcctgaccaacatggagaaaccgcatctccactaaaagtacaaaattagccaagtgtggtggcgcatgcttgtaatcccagctactagggaggctgaggtaggagaactgcttaaacccaggaggtggagcttgcagtgagccgagaccatgccattgcactccagcctgggcaacaagactgaaactccgtctcacaaaaaataaataaataaaataaataaataaaataaaaaatgaatacaaatttgattctggaatggcaccaaacatcaaggtggaatgaatggaacaccataccatgcaggcctgtgacctaatctgacttttttcagaagcagagcactctatgaaaatgaaagatgacccagcccaatactcacctgcccggtctcatattttccattctgttttggcacctcaaacacaccaactgtctccaacactttgccctctggtcggtttctgagtaggaaggaaaagaacaagcaacagaaaagctgagaaggtaatggtagttatccataagaaaaagctcctaggatactgaggggccagggcgatgacagcagagaagggtttggggtagtgggaccagctggagcaggaaaggctttcctcctccttggtgaaaacctccacagtctcccagtgttagatgtgaccgctcccatactactgtcttctctcttcactgggcattcttcatatcatgccctcacactctgctcaaatgtacccctgcccttgtttcttccctaacccaccctcctgacctcccacagcactttaactgtcttgctcactttttcaatttttttagaaggggagtatctttttttcttcttttcttacattttctatatcacaagtcatcaaacaatatcctgctccctttacatttcagttgtgtccatgtcttatctttattaaatactgtaaattccctgggagcaatgcctgagtctgattagctggtactgccccctcagagcctagtgtacaagaggtgctcaaaaaatatttgtcctgtattataattccatgtccatctccccctctaacctgtagcccttacattgcccttgaaaagcttaaacatctctagatttcctacggcacatcgctctctcaataccgtttttgttcatattctcacaggggtcttaaattgcaaatagctatcatctctccccaatgttcagtgtctaatatcagccactaaaatgtcagtcaccactctgaacagggctgctctttctaggggcccttcaaataaaggctgtttttactgttttgaagatgtgaactttatgcttcctcccactgatccaccagcccatttgatccgcctgtcccatccgtggaaacagtttccacaccatccccatggcctcaaacccccttccccaagtcacagatagaaaatcgatctccccaaagtcacttggaaacctggggcctacgagggtccacacccaagagtctcgtttcccacctctagcatctttctgaggcagaccttcaccaaatccaaaggctgagggttcaagccaatgccctagggctgaattaaaaagcttccctctgacatcggtgctggggaccccagccggggaagtaggattcacttggggagggtaacctgttcccccccagggccagccctgtacaaccagggctctgggccgcgctggcttccctgctcctggcacatgtcccagacagcgcaggtcggctccctgctcgggaccctctcccgggtcaaactccagtcaccctcagcaggcccgggcccctggcctccgcactggctaggaacacgctctctgggctccaggcccagtcctcgcgccccctggctccgtccctcaccgggacgagaggtgcctccgcgtcgtcgtggtcgacgctggcgagaaggctccagctccggccgccgcacagagcggccttggccaccgggccccagtcagcgaccgggaccaccagcggctgcccacggccaggggccgccgggctgtacaggctgccatgtcccgcccgagcgcccgcccggctgctgacacagagcccgacccgcggccgggcggttccgccccagtcccacactgccccgcgcggcgtcccggccctcttggcccgcctggtcccaccccggagctcagagcaacttccggtgcgcttagcgttacttccggcgcgcggcgggcggaagtccgggttggggtcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaaggggtgagccccagtctccagtccggggtcccctccttgtgtccagatcgattccctcctgaggtcttttcccatcattccccttcttctacggagcactcatctagacaagtcaagagtcactccataaatcccagggccacccactttcttaactcccatgggaatttctcgtggatgacaaatttgcttgtgcagtttctgctcttttgagagccccctcttcacttccaggcacacctaggcccaattcacccttgagaaagtctaggtttttaccaaatacaaatatcacaggttttgtctcttctttttctccactttaggaatcagcttagcatagtgagcttgtaggaatccggatttctttccacctcaaaagcaagagtggtgaaatctgatactttgttttgtttgttkgtttttttaatataggatggcaaaagctgtgttgaaagatctggcctgagagtagcatgtgagttccagtcctagctctgtcactaatcctttgaaggagtcatttctcctcgctgggcctcagttcccttatgtgtaaagggaaggaacaggacaaactagcacataaggtattttgccagaagtaacatagaccagccagaagtgcaaagggtagactgctcaattattagaactagaaaggaccttagaaagagattgcctagtattagtgtcctctgagcatttagcatcactatgacctaaacttatttagggaagagctgttgtggccacagaactgatctaacccaaaggcacaagtaaatggcttacttgttagttataacactggcaggataattgagagctgacagctaaagtcacctgcgcagcactgggagatacctacatggaattatccaaaattcttttcaattgaaaatgatcctggaaatggattaatgtagagatggccctgttttattttggtagaaagaagggctacacccctcttgatcttaacccttcaacctcagctcgtggatcattgtgtttgtgaaaccttttcttctcagattccaaactatacctccatgagctcctagaaggcagtgaaatcyatctcccagaggttgtgaagcctccacgggtatgtaagggatatgtttgtgagagtggttattgactgagttgggcttatccatgatacactgaacttataaatcaacttttaggcttgaaaaattgtttttgaaatctttgggatctgggggagccagatattgtcctccccatcagctgtttggaaaattgagatcaaaaaaaaaaaaaacagtttcaaagcactggagttaygactagtatgtgggtctcctgatacctttagcagtgctttacccctggaaccaatgattgtgatgtgctttctaacaagctgggaatatcattcttctcatttgatttttctgcttcagaacccagaactagttgcccggctggagaagattaagatacagctggccaatgaggaatataaacggatcacccgcaacgtcacttgtcaggtaaggacatgctcttcrgtacgtggtctaggtagcccctcagagtagggccctgcastggaagaagatacagagtttagaaaaaacatggaaacttggtttctrtactgttcagggaccatagraagtctgcatacaaacaacacagttcccatctcattcactgagactctgggctgagatggtgaccaagttttaaacgtcatagaagtgggagttagccgggcacggcggctcatgcctgtaatcctagcactttgggaggctgaggtaggtggatcacttgaggtcgggagttcgtgaccagcctggccaacatggtgaaaccccgtctttacaaaaaatacaaaacttagcctggcgtggtggcgggcacctgtaatcccagctactcgagaggctgaggcaggagaatcacttgaacccaggaggcggaggcagaggctgctgtgagccaacactgcaccattgcactccagcctgagcaacaagagcaagactccatctcaaaataaataaataaataaataaataagtgggaatgaatcttggaggctttttttcttcttcttttttttttttgagatggagtctcactctgtcacccaggctggagggcagtggcaggatctctgctcactgcggcctccgccttccaggtttaagtgattcttatgcctcagcctcccaagtagctgggattacaggcatgcaccaccacgccaggctaattttttgtatttttagtagagaccacgttggccaggctggtcttgaactcccagcctcaaggtgatcctcctgcctcggcctcccaaagtgctgggattacaaggtgagccactgtgcccagccattcgagcatttcttctgacagggctccctactactctatggcatgctcctaccctggaacaggagagtagatgggtactggcagcctatgtcctctctccgaaatgcctgctctgtagtccagaaaagagtcaaaatggttccagacaaaagaatccatggggagggcagagttaatatgttggggaatagagagggctgagcccagactgtcaatggatgctctctgagctgcttctattctgaatcatcttctttttctttttcccaggatacaagacatggtgggactctcagcgacctgggaaagcaaggtgaggtactaggagatcaggcttctraaaccttttcctgagatgggtcatgacactcaggcttgttgtttgactgaaacccagttggtgggggagccatgagataagagcacctcctagagaatgttgaactaaaggtgccctctctggctcctccccaaagtgagatcattgaaggctctggtcatcaccatcttcaatttcattgtcacggtgrttgctgccttcgtctgcacttacsttggaagccaatatatcttcacagaaatggcctcggtgagtaggcactgggcagggcagggtgcccctggtgggggtgttagtgggtaagggaggacgtatgtgaaagtgccttgcacaggttaggtattgaacagatatttatgccattaataaggggagcattagagctttccagcagtcacgggaggttaggtaataaccccaggagaagccacattctcttttcttyccctcccscaacttagagggtggttggggggctctccatcctcattaaagttgctggggtacagagctggttgttggcctgcatcccttaagcctggttctccccatctccagcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactratcaccagctttctccatacatttttaatgcagacctgtaattgagttcagaagcctccaagaaaacagaaaggatcccctttctccagtttgtgctgraagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggtattcctattttaactcctgtgacaacacaaagcatagcgatttccatagttctaactgttcagggtctgctcctcctggtacactctttttggttcactgtatgtactcctgttgtctttttttttttttccaaagcacttttctgttttcataaattatatactcattcactcagtggacacttcctctacaatgtttgccagtttctgttagttgggagaagtgtcagctgtgaaaagaaaaagtaggtggcattttacagtgtttccagtaamctgagctatataaaatttgtgttaaaaagctacactgggccaggtgaggtggctcacacctgtaatcstagcattttgggaggctgaggcaggcggatcacttgagkttgggagtttaagaccagcatggccaaywtagcgaaaccccatctttactaaaaatacaaaaaaattagccaggcgtggtggtacatgcctgtaatcccagcactttgggagacyaaggtgggaggatgcttgagttcaggagtttgagaccagcctgggcaacatggcgaaagcccatctctacaaaaaaacgcaraaattagctgacatggtagcgcacgcctgtagtcccagctactcaggaggctaaggtgggaggatcacttgagcctgggaggcagaggttgcagtaagctgagtaagccaagatcatgctattgcactctagcctggatgacagagtgagaccttgtctcaatgaaaaagcagggggcactgggaggggagaaccaaatgccctatcctccagttctcagcatatagaagggagctctctcatctgctagccactcctgcctcactgtgccatgctttctgtaatgcactctgggtccagggactgcttggcaggaggtgggaagaacaagaagtttagggccttcccagtttcttagggcctgtctggagagggaactagcgtttactgagtttttacgatgtgttacacaccatgtaaagccctttacctacattatttcttataccccaaacagagagcaaataagtatccccattttttagtcacatagagttccagagttgccacagttacatcgcaaagtcaggatttgaatccagtgcagaccgcaaacaccatggttttctctccaaagcagagcagctccagaggtggaggtgactggaatgtcctagattcagtgggaccaggagctgggggtgctagcagaggctctcatctccccagggtcttgtcagtcagagtcctaaacccttcaattaactatccctctaatcccagctgaagcctgggtaatacctcccaccaagaggtatctgtgtggaacctggccctatttagggattaggtgatggagataaatttccatggcaaacggccctcgtccccgttcgtttgcagagcacaacaatccagattaaggtacagagtttgggttttatttggagattagttggtattacaggtgatggtgataccaaaacccaatgctgctatacctgcctccatcccagatctgtcaggttgtctccacagccccacatcagagggcatccaatctgatctttgtgaaaattaaatcaacataagccccagcttcctatctttgcttcattactttaatgccactccctcttcacatccgtagttctgattaatttgtccaggtggtcgatggtcaagagagggggccctgacccataaagaagttggctctccagcagtctagatgaggagcagcactctcctctcctacctcacttagcagttagcaaggtaatggcctggagagacctcaggagacaggagcctgccccttcagaaggaggaggccatcagctggtgagaactggggaccaggcctggcaagagtggaggaaaacatgaccctcatctcatccttctgaaggtaccacctgccacaacaatgagcatatgccccaaaggggtcagggtgtggggtggcaggagccaggccccagtctgcttaggacctgcatctaggctggcctggaggccagtggaagggagggatgcctgagctaaactcctttcccgtagggaatccctttgcataaaaagtggggccagggaatccacttctgatgtgttcaatcccaggaggggcagggtgggccacaggagtcagaggaggggccttgcaagttctggacaaagactaggagtggtccacattgacgacaatggccgaggcatagatgaggtcagacaggctgcctagtgaagtctggggagtagctcgctctaaagaagggtggacctctgaagccccagctgatccccatggggctacagctttagccccttcccagccctgccgtggactcaagccaggagctggacaggagctatgtcgacacactgaggtgcgctgaggtgtgccgctggagggtggaggttggcctggcatttggggatcccagggctgctggagggtgtctggaagagaacaggagctctgggggcactcagacccagggcttagaattcctgacttcctgttcttgattattttggcccagcgcttctggaaccacacctgctaggaaagaagaaggggtctgttctggccccagcatcccctccacccagggacaggggaaacaacctgaaggcaggctacccagcgaaggggctgtgggccaagcctagatgttggctgtgtgagaaggggtcacagctcacctgtaccttggcctcaggaaggcaagtgacccaggccaggtgctcatgggtgctgatgttggggtagggccatgctgcaaacgccctctccagctccagtagctgccctttgctgaaggtggtccgctttctccggtgggaacccaacccgctgccaccgtctgcaggccatggtgggggtcaagctgggactccctgcaagagcctccacccagcctcaaagccctcaatcaaccccgaagtccctactcccacccctctccaaccgtcctcatcctaccatggcctgcgttctcaccctgcccacacttcccccatcagatcacctgctgaggatgcatccacagggctgggcatggagctggcaaagggtaaggtgccagagggccgtgccagagggccatgccagggctgtgcccacaccagacccccccatttgggttttatcatgctcagggtggctggccccgccttcaggagtggagaggtttagagtccagctcaagcaaggcagagaagtctcggtggggaagaagggaggctggaggccgggttgggcttatgagggtatgggtggggcaaattgtataccccctgcccctccaaggcctcgcaaaggaagctggacccagcatcccttctcaaacctcaaactggcagtctgtgcctgaaatcctatacttcatgaaaatcctcccaggggtccttccaggcagccaaagaaaaccatctctccagtgctcccaggcactggctgccccttctggagcccttagtgctctgaacctggctaccttcaggggagagggagtggagtcctctcccacaactggggactgggctggtgaagtgggacaggatgagaaggatggtagggtgtcaacgggatgaatgggagccagccgctgtcagcaggactggggaacagatgtcaccaccagattgccctcaggtctgctttagagctttgcctcatctaaccctttctctctctggcccctcaagagccagatggacttcctggggttcggaacctggaaccagaggaggttccacaggtgcagttgaggggttctaagaaagatgataaagatgtttatgtgtacagtattctcttccttggatatattctgagccactttttcttaaattttgaaaatttttttcttttttctttttttttcaagatggagtcttgctttgtcacccaggctggagtgcagtggcgtgatcttggctcactgcaacctccacctcccgagttcaagcaactccacctcctgcctcttcctccggagtagctggggttacaggcgcctgccaccacacccggctaattttttgtatttttagtagagacggggtttcaccatgttggccaggctggtctcgaactcctaacctcatgatccacgcgccttggtttcccaaagtgctgggactacaggcatgaaccaccgtgcctggcctaaattttctttttctcactctgttgcccaggctggagtacagtggtgtgatttctgctcactgcagcctcaacctcccaagctcaagcaatcctcccacctcagcctcctaaatagctgggactacaggcacacaccacccataagttgcccagctaacttatttatttttgtagagatggtgtcttgctatattgcctaggctggtctcaaacttcgggattccagcaatcctcccaccttggcttcccaaagtgctggaattacaggcatgagccaccatgcccagacaaaaattcccccccttttttattttgttctgtttttagagatagagtctcactctattccccaggttggagtgcagtggtacaataatagctcactgcagcttcaaactcctgggctcctgggccacttttccacaagaagtgtgtgcttttgaatttcctttcagtttctgcccttcactatctctcctggtcttgctgctccccatcctagaccctagacagagacctcaagaaaggctcaccctaggggtgggtttggggaagcacagtgactggttccccaagtgctcaggagtcagagctactaggatttcagatcaggatggacaaaaaagctgagccagaaccccaccaactcttgccccttctctctcctccaagaccctagtcaactccaaggggcaaagcaagcctcacccacggaggctggcctggtaactttgtcatcatcagaggagttcaagtgtctgcttagctgctggtgggttgctgggggctgcttagctcaagaggaagggtagctctcaggaggccttccccagccccaaaccggttcacagagaggtcctgagcacagagaggtcctgagcccaacatgggttggacacggcgaggcccttctctgtcccttctctgtccccctcaccaacccattctgacagtccagcttcctctcctttacccagacagggatgtgtctaccccagtcagaacaataattttaaactcggggctaagggacctttattgggctgggggaaggagatgggaggagggagctacagagggcccggccatgtgggctctgactcctacagatggccaggagctgggcagcccagccagtactgagcgatggagcgtgggtagggagggtccacagtgtccactcgccgtgtgcgaagattgactcggtagtacttgtctggaagagaggaaagcagaggatgcgtgaggcccagcctggccctgcccactcttcccttgagaagtctagggtctctcccagaagggaaagtgaacatccatgatgcagctaaggacttctggcctggctttctgtggtcactacttgcaggctgcgttcagcccttgtgcaccagggacagcaaggaaaacccaagctagaccagcttcaggggtggcagcggctcctacctccagagaagaagaagacactctggatgggttcacaggtggcaggcacaagccagtccatcctgtagtcatcatagttgttggctcccaagttgctctcctcactggagaacaaggacagccacatggcgcgggatggccggcgggagttctggttgcggccacggctgtggcctcgttgtgaacggtagcctttgcggttgcgatgcctaaacctttgtttcttggccaaggaggggcggggtgccatgcctgagatgtagatgcggccagccatggctgcgtccacttgccctggcacaccgtgccagtcccggctaatgaactggggctgtctggtaccagctgtggcagggaaggggtgaatgagaggtcttgggggtccgaatcttgccccttccagcggggccattagagttcatctgctgcaccttgcccaaagacacacagcagcgaatggcagagccaggcctttgactctcagtccaattcccttccccctgtgctttccctccaccatatcactggtgtctcgaccccacccccccaggccccctaaactcctcagccacagcccctccctctgctggctgtgctctcagctgtgctaggcaaagtccaaggtgtggggtccaggtagagctgagctttccccaaaaggtcaacagaagcaaagtctggcctgagcaaacagactttgatcgatagctccacaaccacagccccctccagccggcctggctctaccaataccaaggggtttcagcccttttgagggagaagcaagacttgccctctctccataccagaggttctgccccagaagagaagctcgaagatgtcctcccagctgtcccgctgcatcatggcaaagtgttcaaacacagccgacagggagctgccttcacactcctcctgactgggctggtgctggaactggtactcccagtactgtttccctgaggagcggggtggtgggcattaggagggctgggccagggcaagactggagatcccagaggctgttgaagttaggatctcccagcatgaggtgggggtcaggggtgggcacatgctgaggcctgtccccagtgaagtgtgaaaggaatccaagactgctccactgcctgctcagtctcccaccaccccctgagtacccttgaagaagtagacccgctcccggccactgtagctatgggcagggagggccaaggctgcatccacgttgtccgggatgccatcgaagccgtcagagatatttcgggggtaatcagggtccaggacaccatcctcaaagcgccagtactgactaccctaagaggtggggaaagtgaaaaggggtatggaggccgctggctgggcacagaggcagagtcccttgccctaaggcagccgttcccaggtccaggttcactgcccaggacctggagtcttggggctgccctgtgctcacagagctcccaccaggtcctgcagggccctgggtccagcttccctgtccaccctgtccctgggagcaatagctctcaaaccctccctagatgctttctaccctggcccacagcccctggcaccttgaagaggtaggtcttcccctgacagttgatgcgggtgaaggcggcatcgatggggccctcgatgccccagacatctcggatgagcttggggtacccaggcctcactgccttttcgtccagttcatagcagtactgccctagagtggaggagatggtgtgagagcagggacgctcctggggcagacccgcatccccagtacctgccctggattcacctcggaaggcaaagagggaaccgttcttgaggtcggtgaaggcgtcgaagggcttcccactgcacagctcctcctctgctgggggctgaggtctccctggatgaagggtctcaggccttgagtctatcccctcaggcttagaggcgcccacctcaggcgcaggggcctcttcctcaggt

SEQ ID NO: 1716 - DNA, 18379 bp, Homo sapiens
taggattacaggtatgagccactatgctcagcccgtcttcacaaattttttaaaattaatttttaaattttttttgagacagaatcttgccgtgttgcccaggctggagtgcagtgactcgatctcaactcactgcaacctccacgtcctggcttcaaatgattctcctgcctcagcctccagagtagctgggattacaggtgtgtgccaccatgcccggctcatttttgcatttttaatagagacagagtttcaccatgttggcagtctggtgtcaaacccctggcctcaagtgatccgcctgccttggtctcccaaggtgctgggattacagataggcgtgagccactgtgcctggccaatttttaattttttaattattatttttaatcaacagctttagacagagaaccttggtttcatcttcagtgggctgtggccatgggcagtttcttcatctgcaaaaggggagtagtactaggacccagctcacaagctgacaggggaagatgctcagacaaacactgcctgcctggcatagaaaaatgcccagcatatgttagccatgaccacgaccgtcgtcgttatcatcatcatcatcatcatagcatctcatgtttcaggaaactttccaggaagaagggacctcgattccctctggggaatgtccctggtggttgctctttcagcagcacagctggctaactaaggctttggcagttgcagcctctaaaggaaaaattcctcaggttcagactaaacacaaattgcactgacctttgatcagaaagtaatttcagagagagagatgctcagacagggagggcagctggttttgagccccaacctttcatcttccccttagctcctctcctttccattcacactgccccctcccccatcacctggccctcgggggtaagctgattcctctttaaaactctggcccaaggaagacaaaatttaaagcccactcccttcctccttagcatcactggaccaaggtcaaatgctacaaaaacattttattgaaaataagcaggaaaccaaacgaaaatagtcaaagaaaacgcacaaggcacgatcgttgtctagctccaactgtaactgtttctatctgggccattgccagattgcctcctggctgaagatctcttggtccacctaagcaccttgctttttacacacaacgcggggctctctgagaacaaaaatgggccacaaggggtgcaaaggctgggagaggagtagactctgtggtctgtctgagggcagttctgactggcaccacagtcggaggacaggcgcggcctgttgtgtgggtccagggcctccagtgggaaaacgtggctttaggcccttctcccagatgctaccttttacagaggaagaccagatctgaggtttagtttccatgttgtgttctgagttctttctattcattcagtcatttaaaagtacttaccaaactaccacaaacctgggtggcttagaacacagaatttctttttcttacagttctggaggttagaagtctgaaatcaaggtgttggcagggccgtgcttcctcagaaggctcttgggaagaattctttcctgccttttccggctgccggcagctccaaccttggcttgcggcagcataaacccattctctgcctctgtcttcaactcgccttcttttctgtgtgtgcctctgtgtcattacatgctgttctcttatatagataggagacccactacctgtgtctttgtgtccaaattcctttcttctttttctgttcatttgtttgagacagagtctcgctctgtcacccagaagcccaggctgcagtgcagtggcgggatcccggctcactgtaacctctgcctcctgggttcaggtgattctcgtgcctcagtctcccaagaagctgggattacaggcatgtgccaccatgcccggcaaatttttgtatttttagtagagacatggtctcgccatgttggctaggctggtcttaaactcctggcctcaaggcgatctgcctgccttcgcctcaaaaaaactgccgggattacaggcatgagtcaccaccatgcccagccagttcacttttttttttttttttttttttttttttttttgagatggagtcttgctctgttgcccaggctggagtgcagtggtgcaatctcggctcactgcaacatccgcctcccggttcaagcgattctcctgcctcagcctcctgagtagctgggattacaggtgtgtgccagcatgtctggctaatttttgtatttttagtagagacagggtttcaccatgttggtcaggctggtcttgaattcctgacctcgtgatctgcccgcctcagcctcccagagtgctgggattacaggtgtgagccaccgtgcccggctcacctcttctttttttttttttgagacggggttttgctcttgttgcccaggctggagtgcaatggcgcgatcttggctcaccacaaccaccgcctcctggtgattacaggtgtgagccaccacgcctggctctggcttacctcttcttataaggacctcagtcattggattagagctcaccctaatctagtatgacttaatcttaacttgattacatctgcaaagaccctttttccaaataaagtcacagatactggggattaggactcgaacacatctttctgggggacacaattccaccattacagggaataaacaggataagaaaaccatagaacccagcaggtggtaggtgacacaagctaaggggtgttgccatgttgcccaggctggtctcaaacttctggcttcaagggatcctcccaccttgcctcccaaagtggggatgaaagtttgtctggggcattgcagttttagacaggaagaccagggaaggcctcactgagaaggtgacatttgagccaagacttaaaaaggtacgaaagtgagccatgtggaagtctgggggggaggagtgaactaggcagaggcacagctgggcaaagggcctgaggtgtgaccatgcctatggatttgaggaacttcaaagaggctgtgtgctgcaggagagtgaagggcagggagtggcaggaaatgaaggcagacaggtagcagtggggaggacgcaggggtccagctcatgtaggtcttgattggacacagtgagtttcagatgacagcctcctgtctcatggggtagccccaaagccacaggagtctggtgatttccctcttccccaccagacatctatgccatcggggtgggcaagctggatgtggactggagagaactgaatgagctagggtccaagaaggatggtgagaggcatgccttcattctgcaggacacaaaggctctgcaccaggtctttgaacatatgctgggtgagtgagctttgccctccttggtgtggggaggatggtgaggagcccgccagaggcccgtgttgggaacctggacacagtgcccctcacttgcctccttccccatctgatcctcacacccacagatgtctccaagctcacagacaccatctgcggggtggggaacatgtcagcaaacgcctctgaccaggagaggacaccctggcatgtcactattaaggtaccaggaaggaggggcagggcttggattccagaggtaaaagcggccatgggccagacatactgcaatctctgaaaatcacctgttcccctgcagcccaagagccaagagacctgccggggggccctcatctccgaccaatgggtcctgacagcagctcattgcttccgcgatggcaacgaccactccctgtggagggtcaatgtgggtaaggcaggggatgcaccagcctcctgatcctgaagccacagatcctaccacctcacccagcctctggcccctgcaggagccctggtctagcctaatctagtgtatcatttccaggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggtgcctggagtctgggatgggagggtgccctgcagggaagagtgctctggagatccctggaagagatactggggacaggctggtgtgacccttgctcttctccccaggcccatctgccttccctgcacgatggaggccaatctggctctgcggagacctcaaggcagcacctgtagggaccatggtgagtgctgggacttatggtgcttgagagctggggccggggtttgggggtgataacaaggactaggctgcagtccccaagccaggaacctggattctgggtaaaaggaccagcaccaacatccccttctcttgactatagagaatgaactgctgaacaaacagagtgttcctgctcattttgtcgccttgaatgggagcaaactgaacattaaccttaagatgggagtggaggtgagggtctcaggttggggatgctgggatccccctgtgacagctcccagaatgtctctcttccttctccaggtctggctgctttctctctctgacgcgggtcacccctcctcccaagcctcacaaacctgctaggtgtccctgggtctgcttattctttttttgttgttattgagatggagtcttgctctgtctcccaggctggagtgcagtggcacgacctcagctcactgcaacttctgcctcctgggttcaagcgattctcctacttcagcctcccgagtagctgagattacaggtgcccaccaccacaccagctaatttttgtatttttagtagagacgggatttcgccatgttggccaggatggtcttgaactcctgacctcaagtgatctgcctgcctcaacctcccaaagtgctgagattacaggcgtgagccactgcacccacccgggtctgcttattctacccttctctctggttccacccctgctgcagtggacaagctgtgccgaggttgtctcccaagaaaaaaccatgttccccaacttgacagatgtcagggaggtggtgacagaccagttcctatgcagtgggacccaggaggatgagagtccctgcaagggtgagtccctcaccatgcctggattcccaaggggaaggccacctgtgtctctgtggccagcatgcatgccagaacaccagtccactgccctagatgacactgtctcctgtcaccctttgctggcaggagaatctgggggagcagttttccttgagcggagattcaggttttttcaggtgagaaggtagaagcttgcaggacccaggggttacaggatctcagccttgttggggggatgagggaggcctttgagggatctagggaggttggggcttacagttggggctgtggcagcctcccagccagttctctccttttctccaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatctctcagtgcctctatctggaggccaggtagggctggccttgggggagggggaggccagaatgactccaagagctacaggaaggcaggtcagagaccccactggacaaacagtggctggactctgcaccataacacacaatcaacaggggagtgagctggatccttatttctggtccctaagtgggtggtttgggcttactggggaggagctaaggccggagaggaggtactgaaggggagagtcctggacctttggcagcaaagggtgggacttctgcagtttctgtttccttgactggcagctcagcggggccctcccgcttggatgttccgggaaagtgatgtgggtaggacaggcggggcgagscgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtaagcgagggtaaccttcccttcctgctgtctccagcatccctccttggccttttggggccaggcttcatcagcctttctcttcaggtgtgaccaccactccatggtctttggccyrgccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagaggtttgagggcaatgagtgtgggcagtggcctaaggcagaaacagggcaggcggcagcaaggtcaggactaggatgagactaggcagggtgacaaggtgggctgaccgggagtaggagcagttttagggtggcaggcggaaagggggcaagaaaaagcggagttaacccttactaagcatttaccctgggcttccaggcagccctggaagtcaagagaacactcagaaatggggagggagaagcagtggaaatccatatgggttgaggagtaggtaagatgctgcttctgygggactgggaatgcgctgtttctcagtgacatggtctccgagaccaggagggatacacctaaggcagcctttccctcttgatgacttctacttgtccccccttctcaaagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgrtggagtgggcagacagcgatctgtgacaacggaggtgagaagcatcccctccccctacattgctgtctccctgacggcgcccagcccgaggagtgggcactcggctccggacactgtaactcttgctctctaccttgctcacggggcctcaggcttcagtgcttacctcgatgtctcatacctctgcagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaaggtgacctttgacctgtacccccaggtcagatcctggtcttccatcctactgtcttctctccccacctcaaccctgctctttcctcactttgtttaaacctccctgtacaactatctcacttctgagccttttataccctggaaacccatgatcccccgtctctttggtcactgtatccctgacactcccagacatttgacctcatttctgactctcccagactccttcatgtaygacacccctcaagaggtggccgaagctttcctgtcttccctgacagagaccatagaaggagtcgatgctgaggatgggcacrgcccaggtttgaagacagagaagggaggcagggcagggaactgggggaaaatggagaagggacagaactgttaatgctggagcctgagccactctcctggcacccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggaatcctcctatccctgaactcgggggaatggaatctcgctgatcttccaggactagctccctgatcattccagcccctctgaacaacagggccccaggaaaatctccaggtcctattctgtcctccttcccttttacttgaagcagtttcttgactggtaattcctccatgaacctcagcccttgagcctcttactgagrgcctccctgtcccagcaaagtcgctgaaatctcccaatcacagtattctattttcaatgccatggcgccttgttctcctcacccacaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaaggtcagaggttagggaatggtgggaggttcactttggggtcaggaggttcagggtggagggggtcatgagactaccttgagggcgacagggaggaccactttgtagtcaaargttgaacagcaggatcgttgggcaatggaggttagtgggaacctgttgggggctggaagggccactttgtggtcaaagggaagtccgtgtaatgatgattaacttaaaaagttgaaagatgtgggatttcagttgcagattggtctctggggttaaaagatggcttggaagaccaggtgaggtgatggtctcttccctctccacagaccacaagttgaagtcagggactaacaccaagaaggccctccaggcagtgtacagcatkatgagctggccagatgacgtccctcctgaaggctggaaccgcacccgccatgtcatcatcctcatgactgatggtcagaagggacctctctcctgtcccagcctccccaccttctcagaccagcatgtggcccttaagtccacttgtaacactatacccatggttggggccctgaatgtgactcatagctggctgttcatctctcctgtgacccttcataaggaattcttcctaagccctgtgatcractrtctctaacccttcctcaacttgctcaccctgccaygtgtatccctgcctttagccagtttatcttcctwatctcctaccctcatggtcctgtctcttctgcaggattgcacaacatgggcggggacccaattactgtcattgatgagatccgggacttgctatacattggcaaggatcgcaaaaacccaagggaggattatctgggtgagtaacctgcctaggacccagcaccccacttcctcagggcttggaccctcatccttcctttttatccctcagatgtctatgtgtttggggtcgggcctttggtgaaccaagtgaacatcaatgctttggcttccaagaaagacaatgagcaacatgtgttcaaagtyaaggatatggaaaacctggaagatgttttctaccaaatgatcggtagggmgatacaagggaataaagaacacaactctcctcaggttcccctgaagtaattcattcttcctctacacctgaagctctagttgcctggaaagccttcttcattcctccttctctacctcagtgtcactattcttgtttcctggcactgttcacttaaccttagaatcacagagctctgagcacttcagagatctttctayagtcctacatttgacacgtggaaacagaagccaaaggaggtcaagggacagcaagttagcaacaagggtgggcttgaaaacagccaggcctctgacagcttgatcccaagttctttcccttttcagtccaccatagcagttttctcctaacacgaggaaacaaatacccgtggtctttccctttctccttttgggcctttgctccccatagactcctacccaaaaggctgctgccatttgggaatgaagtgttcmgagttttcagcacattctccttctctgccagatgaaagccagtctctgagtctctgtggcatggtttgggaacacaggaagggtaccgattaccacaagcaaccatggcaggccaagatctcagtcattgtaagcacagaatcccagtagtggggacttgggggaggtgaggtcaaggtgaaatgggagtaggggaaggaaaaaatggccataagagatggtggtttgtgaaagttgagctttccctctctactgttgtgtccccagcgcccttcaaagggacacgagagctgtatgggggctgtggtgtctgagtactttgtgctgacagcagcacattgtttcactgtggatgacaaggaacactcaatcaaggtcagcgtaggtaaggatgcaactgaaggtcctgggctgcacctatgctctccaggcaacacctcccactttctacagatcctacactccacccatcctcaatgcagccccattccttgcaccccagaccagtcagggatgggggaagacgtgaagttaggaatgacacggggccagaggcaggaagctgcccacaaagaggtggtacctactctcctacttcaggaggggagaagcgggacctggagatagaagtagtcctatttcacccyaactacaacattaatgggaaaraagmagcaggaattcctgaattttatgactatgacgttgccctgatcaagctcaagaataagctgaaatatggccagactatcaggtgagagcgtccagatccctgaggaaaggctgggaaaggctggaggactggggtgaggagcaggcctggtttgctgttctccttgtcctttataggcccatttgtctcccctgcaccgagggaacaactcgagctttgaggcttcctccaactaccacttgccagcaacaaagtaagacatacttggcaagaggataaggatgagatcccaagagacaagtggggcatgagagggaggtgcaataggaagagatgatgcctggcccagaacctagctctagaagggcttaggggacatctactgagtgacraaggcaatggggagatgacagtggtgggagcagctgaagtgacgcagtctattcgtccagaggaagagctgctccctgcacaggatatcaaagctctgtttgtgtctgaggaggagaaaaagctgactcggaaggaggtctacatcaagaatggggataaggtgagaaacgggcatcctaaggaggcactctaggccccaatccttcctaagccacttctgttcattacttctccatgcttcccacctcccctacagaaaggcagctgtgagagagatgctcaatatgccccaggctatgacaaagtcaaggacatctcagaggtggtcacccctcggttcctttgtactggaggagtgagtccctatgctgaccccaatacttgcagaggtgagagaatgctctttggtygtgctacaagtgcccaaggcccaacagtccttttctctacagcttctsctctccttgcaggtgattctggcggccccttgatagttcacaagagaagtcgtttcattcaagtgagtcctccctttcctatctggggagatgccaagtggtcagcatgggccccaaagcaggaaagctcaatgcatgtggctagtaattcgaggtaggcagagcctgcctcaccttaggaccgcatgtcttgcctgcgtgtgtcaagaacgaggctgagctgggtccctagtctgattcctttaggtcagctaagacrcaagcaggaacagccatgcttccaggattaggaattctactgaatgatccatggcaccccactgcctctgcaggttggtgtaatcagctggggagtagtggatgtctgcaaaaaccagaagcggcaaaagcaggtaccygctcacgcccgagactttcacatcaacctctttcaagtgctgccctggctgaaggagaaactccaagatgaggatttgggttttctataaggggtttcctgctggacaggggcgtgggattgaattaaaacagctgcgacaacacctgtgttccagatccttttggggcaagggagtggggaacaggcactggccatgttgttacactgagatcaaacctgacagccgtttttaaaggtttaaccccaatcccaagtgctgaaaaaccagaggctgagggagatgtgtaagcttccacctcagtgttttactgagaccagcattggggcatatgaggcacaaggaatccagctctgttccctagaagccatccacaaggttttccttgtagacgtcatcactgtagacaatctgggtcctcttgtcccggtggcaacccttagggctgttctggacagctagggagggaggagaggaacagttaaggtctaaaggagatcatagaacagaccctgaggctgactcctgaccacctcactcctggccactggcccctggaagcccagtttccacgctgccctctggtggccaggatggcctgtcttccttagctcctttgtgccaacccatggccaagaaaagtataagtggacattttgatgaatgttttgttcttagaaaaatcccaaatgtcattgttgagacacgtgaatgatattaacccactacttacagtcagtatgtcagaagctaaaaactagaaaacctctgtagcccttttttgacatgctggtcaattctagttcctttcttttgcctgaagggccactgtagctgagcccttctttctgctcactcctttcccaggaaaatctactttcagggaaaatggattattcacactaagaaatgctactagctccaccagaactcattcagggtgtagctttggccctcaccattctctctcaagcctctagctgtttcttccccttcctctttcctccctccaccagacatgttactctcttcaccccatccaatggttccatccccaccacccttgagctacagagaatctctctcacccactcccatcctgtgatctctgtgcctcaacactgctggctactccctctttctcaaagtgtgtgtccttttgcttcagtggcccaggcccctgcggtgctgctcccagccctccgacccctcctcctgtctcctttgctaacgttaggctcaacgttagcctaacatgtcaggacagctggggacatgtggggtgtgaggtgaacagtcctgtttcctaacatagtcccagagtactcctcaaactgagtcctgggtcgtttttttttctctgaaatcagagtctccctgatgatcctattgtttggcagccaccctgtgatgtggatgacttaatctatgttttccttccttacctcacacctgagttccagatccctgatttcgaatacttatgaaactcactctactccatctcaaaatgaacaagccccatgagacactcatcttcctcaccaatctcactccagctcccactttcttccctgttccagtcactgctttggaagctgttttcaatccttttctctcctttctttacctctaactgacagaggatctgaaattttccttcccattcccatagcctccgcacacactctgacctcgatcatctctaggaaacccaaggatgtgtgggggaaccaaaaggaatggcctgtgggggagaggatgggaaaggaagaatcccattcttaccgagggagccccagacagacttgccagtagcggcatccagcatgggctgttttcgggctatgttgactttgagctgtacagactccacctgggtcccgttgagctgaagcagaagaggggaggcagaggatggggaggaaaacattacagataaaccaaagaagttattccaggagttgctatcctaggaggagactgaataaggaatctgagaatgtgagtttttctgtgtgaatagggagaggctttctttatcaagaggaaccaacttcttcctggcatctagtattttgaggagaacacatgagaacagcagaagcgatgggaagaacagatttgggaagttccaacctcagcaacggcctgatctgctgactccatcttttcataggtgacgaaggcacagctgggataagagaaaacacggtcagtggagagccaaggggctcttctggacccaaccaaacccagtgataataggcggctgcagggagggcagcttcttccctcaggtctcacaccccaggattctcccaggacttctcatcatgccctgttgtcatccttactttctgggtgggtccatggagaggtcaatgatgtttccaaaaggagagaaggccccacggagaagggtgggtgtcatgtcttctccatatacatagagagtattccctttcctaggggctcgccgttcagggaatgaatccgaccctttgggagcacaaatcatagtcacaagacatagcccatgccacatttcacttagtaggacccacataaacctcagttaaggtcaccttgacctccagccaaaatcactcactgcggaaaggaccctctcggtctcggtctcgatcccgctcccgatccctgtcccgttcccggtctcgatctcgatcccgatcccgatccctgtcccgctctctgtctctgtctcgatcccggtctcgatcccgctcccgatctcggtctctgtcccggttcctctcatggctgcggtcccggctgcggcttcggggaggggaggctgaggagtgggcaccactgcgttcttcatagccccagtcaaagcttcgagggggaccatcaccagcccctgggccctctgcctcttctccatctggtcctagttctcgaagtcgatcactagaagacacaaagctggggagatgcagactgaagatcaaaggggggttttaccttctcccctcagaccctgtggagactcaatattccctctatagcccagctcctacagcccaaacctcccaaggactcaggcaatcaactccaccaaatgggcccagccttatctctactctctaacctctcatacagagatttcctctggggacgtctggatgactgtaaaagagaccaagaacagttaagatgatttccagttgctgacatgtggtccaaaatatatttgtctctcatattcctccatccccaacccctcagggacagaaattaggagcctttacctcttgcaggtcatcatcagcagatatgctcctctggaacggctggaaagtggggactggtcccttctcggggtcctggagtggtgagagacctacctcagtgtggagcaggaggttgcccaaccatggaccagaggtgttcctcttccctcaccctcttctaggtttcctctgatcttttcttcccttttaattctacatacatttcttatttgacgtggttttacttattttttttttttttttttgagacacggtcctgctctgttgtccaggctggagtgcaatagagcaatcgtagcttgctgcagccttgacctcccatgctcaagcaatcctcctacctcagcctccctagtagctgggactagagatgtgctctaccatgcttggctaatttctgtatttttttttttttttgtagagatagggtttcactatgttgccagggctggtctcaaactcctgggctcaagcaatcctcctacctcggcctcctaaagtgctgaaattaaccaggaatgagccattgccgcacctgccattgtggcttgttttgttttgtttttgagacagaatcttgctctgtcgtccaggctggagtgcagtggtgtgatctccactcactgcaacctctgcctcctgggttcaagtgattctctggcctcagcctcctcagtaactgggactataagtgtgcaccaccacattctgctaattttttttttttttgagacggagtctcgctgtcacccaggctggagtgcagtggcacaatctcgactcactgcaagctccgcctcctgggttcaagcaattctcctgcctcagcctcccaagtagctgggactacaggcgcccgccaccacgcccggctaatttttgtatttttagtagagatggggtttcaccttgttagccaggatggtctcgatctcctgacctcgtgatccgcctgcctcggcctcccaaagtgctgggattacaggtgtgagccaccgcgcccggcctcacaccctgctgatttttgtatttttagtagagacggggttttaccatgttggccaggttggtcttaaactcctaatctcaagtgatctgcccacctcagcctcccaaagtgctgggattacaggcatgagccaccacgcccagctggtattttttataagtgactcgatatattatgtattcagtttatttgaacctctcttgaacctgataacattttcagccctttccatcccttagggcaacatattccaagagctccaatccaaggtggattagaaccacagaatttgtaaaatggagaattcaggagtcgtctagttttttcattttatacatgagaggtgaaactcagaatggtacagcaatttgccagtgcttgagtatgcatatttttccccaaacccatctacattccaacttggagggatgccctttaaacaatctttctgcttgtgctcacctttaacttcccctcaagggttcgagaacgcttgaagcctgagttcttggtctcagccttgatggcactgatggctcctgacttcaccagctgctttgcctgctctgttgctgtggctgtgtccatgacaggctgctctgatagtgctggagagacaaggggaagaggcattatgttggccaagccatgatgaaggtcagctccatgctgcccacttccagtccatccccatttcccctgtcactcacagcgtttgacaccaccttggctggttgtgctgctgctactttgcttcttcagagccagcaatgcctttttctgggaacaagggtgagaagagagaggtaagtgagggccagcccctagccggttcctctcctaaggcccctgggcacatcactccagggaccgtctttcttgatgccctcagagtggtacactgatgtgctctgcctcttgcctctggtcccctagatcatgtatgatgctggaaattcctaatctaaccaaaccacggaacccagaggttttccagagtgttacatttttgaagttgaagacaaataactcaatcatggactagaatcctaggatataagctgcaagtaagtataagtttatgtgcctttcctggaagcttcatccatctatttcctgcatattgaatgaggcccagccatgacttcgtaacagggatatccaggaggctaatgcattgttcctaccctcaagaagcttacagtctgagaaataaaatacattgagttagcaatacaattataagaggtgcagattattcatagctgaaagctagtaagattttctgatgtttaatggctattaaactaggccctctcccgtatctctgcacaacacagagaggagaagggtattttagaaaaagaaaacagggtggcaaagatgcagagataagaaggctttgggaatgcatcttttggaagtagtgaatagttctactttactagacaaggctgccaaactaaggttttgaggcttttttatagacaatgtgaagccatttatggtttttgagaaacagagggagcagaattttgtgttttcaatggatcatttgaacaggagtgaagaagtctgttcaaaaaaaaagactgagaaatttgttgagagaccattacaatggcccacatgaatgtcaataaagccctgctcgggggaatgcacagtgaagaataaacaggaaaaattacttcaaaagaagaaacaataagacttggcaaaggtttgactatgcaaatagtggggaagtcagagttttgagtccaaacatgtggcagaattggtgtagtcaatcttatttggaagatcaagaatagaaagatgatagcttcaacactgagtatctgaagtttttcag

SEQ ID NO: 1717 - DNA, 24345 bp, Homo sapiens
  misc_feature (1)...(24345): n = A,T,C or G, or insertion/deletion polymorphism (see Tables 1-2)
ccaactgaggaggctgagaaccccatgaagaaacttccagtctctacctccaggccaggcagcccaatgccaggcccagagcccccagttatctccaagtcccagaggagtagccaggagatctgtagctctcagccacagaagcagctccccaatgtctgtgacaataccagctctaatgtgccactgtctgcctaccaagtaacctgccacaagcagtccccattccagtctccgaaggaagccatgcagatccccctctccagtgccccaacctgccagcttcaggaagttgtggaggaccgtgtgctggtatttgatggggctgctgtgccatgaccctgtgggctcacgggcagtgcttgtgggcctcatgcccagccacccatccatctatgtccctgaaaatatgctgtccacccagctgtcggccaaacccatcctgtctcctgacagcaatcactccagcttttggtctatcacacccatgctgtccagcccagtgccctgcagcctctcatctggcagctaccgagaggtagccctgattcccaaggaggccaggctcaacctggagtcatgggactcccctggtactgagacacccatcagggttgggatgctgactgggcctgttccactggggatgcccctccaatttgatgagaggatactgacccatgtccctaatactagctggtccaagcctgatggtgaaaaaaatgaacctagtcataccatctggatgctagacccttccatggcaccctctaggatgccagatgcctccatagtccagaccaagaaactgcagtggatgaactcagagcctgctgcaccagccgatacccaggaagtgcccagatccctcctccaggaagacataggcagccacgaagaggtcattcctgctcaccctgataaccctcaggccaaagatgctggacagactctcctcactgggcagatcctccttgctggacagccacccctacctgagcacccccttactgatcaaccccctctcactgggcagacaccccttgctaggaatccctctttatctaaagaaccccccatcaccaaagagcccactctttcaagatggtcccccaaccctggagaacctggccaggtctccacccaggaagatgagcccttaggcctgcctactcatgtaggggtatttcaggtgcccctgacccctgaggagacctgtatctatatgagtagagacaaggttggcatcagtaatactcagcactccatcacgcatcagcagcaacctggcaactcccctaggacccaggaggagcagcttcccttgatcacatttaccacacctggcactggacgcaaggtcttgcccatggccatggtggccactgagccccagagtgccccattcaagctgacagctgaggatcttacacacttatcagtagttgcacaccttggactgccccacggggcctgctatgaactggtgtccaccatggatgctctgccagttcggtcgccagtgctctgctgccactcactgggacccttccaggacatggcggccgtggtgattgatacaggcacaggattcaccaaatgtggactggcgggagaggaccatgtcctcagtgtcataccctcacgagttcagctgctgcagcacccagcccagggccagccacgatatgcagtgcctgaaaaccaagtgggatcctattcagtgctgaaccgtggtgtggtctatgactgggatgcactagaggtgctatggcagcacctgttctattgaaggctgggtgtgcagcccgagaagctgtctgtgctcgtagccgactcgcccatctcaccactcaccaaccgagaaaaggtggctgaaatactctttgagcatttccatgtcccagccatgcagacagtgcatcaggccctgctggcgctctatgcttatggacgtaccactgggctggtgctgggcagtggccatggcacttcctatgtggcacccatcctcactggggatctggccccacttgacacctaccggctggatgtggctggtgctgaccttactgactacttggcccagctgctgcagagaagtggccactcactgccccaggcaggactgatcaaccagatgaaagaggcctgctgctacgtggccatggatgtggcagctgagagggcccacacccaggcgcaggccgaggtggactttgtgcttccagacaagcaggttatcacgctggggcctgagcgcttctgctgccctgaggccctcttccaacccaatctgataggtctcaaccagctgggccttccacagctggccctcctaagcatcagccggttggaggccaagcagcaggagcagctactggccaatgtggtactggacggtggcagcaccctcatgagtggcttccctgagcgcctgagacaggagctgggccctggtgccactgtgctggggtctccccaccgtgcagttgctgcctggcttgggggctccatcatggcatcccggagctctttccagagcctgtggctcagctgccaggaatatgaggaagagggcccatgggctatctataagtaccagctgtgagcatataaaagttctggttctgctttctttaagcaccgtggcatgtttcagccacagggtggtgtgggaaaagcaggagtccaggcatggggtcatggatgggggccctggctctctcccaaggcatgccctgcctctgcactctggaactccatgggccctggcaacctaccctttctagacagccccggagccccttgactggcattggctctgatctggcctgacctttactgcaccccaagggcaaccacagacagtggctgctgtgggttttgccccgttgccctgacgacaagtgcaattacccttgattgccagcttgttgccatggcaatttcaaacataatgtaataacccacacagcctggagtgagtcacaaggtggggggcggggggcagccccctcccctggctccagaggaaaagactgcttgcccttccccattgtgggccctcttctggggactgaagccaagcaacatggacaacagtcaggcagtttcaaagatggctgggggcctggggtgggagggttctgtcagagttcaggcttcttggggagctgcactggtaatctaggtacctcctagagtctgaacctttgctggagcgctatgctgggttagcaggggcttctatcagccagccagaatctaagggcataggagtgccggcctttggcaccctagagctgggagttgggggcacagataagtcctggatcctgggtaggaggcccaacctgagctgggggatgaagctctgtggatactgcggctcgcaccttattctgcccctctgactttctagctttggtgggagccagaactacgaacttgggccctcttctcctcctcagcctcccaacccaggcagcccctgtcttcagggtacaggcctccttaggagggtcctcataaaggctactaggcaatgctaatctggattgcctctgctcttgttccaaactctggtctgtgctaaagggcctcctgccatcactctggccagtggagtggtgagaaatcatgtcccctgaccccgtctggctttgaatagtggaagtaagaacaaagctcagcattggtcccgtccctgccctggaagagctaagaggatggcattcagctgatgttactatctcctgcctgaaaggcagctggaggttgaagccaaaacattgaagccggtcctaccctgcctgtgccttcctgtctaggggctgagggataagccatggctcaatcctagccctgggttcttgtcttcagattgccctccacaaatggcaaagacttgtctatcttcacatacaccagagatcaaggggctgctctggtggggagcctgaaaacagccaatgatgtagggtcagcacagaccctgcccactgctggacatggtccagcccccttcccatgtccagctctcaaagcctgattcagcctccacaatcctgagacttgtgtcaggcaggaaggggactgataactccagggaccagctacagcgtccacacacacgtgccagcaagcatgcctgggtgcacaaagaatgcagacacacgtgcccctgggcaccactgcatacactgtgctgttgcatctccctcggcaaaagagagcatacacaacacgtacacgtgtgcacacacaccctgccacgtgctctcacccacatgcacagagcgtgcttaggaccaagaagaggtggagtactgccagcagcaggcagggcgctaaggagccaccccttcccctgcctaaaaatccccattccagcttctcattgacccccatgcctggatagccatgaccctcaggaaagacagaaaacatgtatgtggcatgtgtggggtcagcaagctacagcttggctacaccataaaactcagagacccattgtttcaagaatagtgggcagatggcaggaaggactcagtgccaggccattcattcattctgcagacatcagccgagcatactgagatgagaaacgggttctgccttgcagatacccagcctgccaggagattcctacccagtggtggggtgggtcccataacccgagaccactcagagcccagggaccccagaagtggcaccagcctggcctagaggaggtaacaccaagccagggaggaaggtgaagggctcagtaccccctctggaggaaaattttgaggaaccttgtttgaggcggtcatttcctaagctagccttcagtctgagccccagccccagcttctggacttggacagtccctcctgtcatcagccatgggtggccagggcagcctcaagatggctgagggtttggggatgaccccaactccctctcccacagcagggtcaggaggctcactgggaggagtgaggtgggataaaacccagctccagacactgagaggcctgagtctggtcttcagatactggccttaggatggtcctcagggcttgtgaggggtgtgggtcaggctttgggtccgtgagcctcactgacaagggacagagaaatggccaaggacttcctttaaagcttcctcctggtggttctgagcctcctccctctgattagcacccaggccaggtgggataccttggtgccacagttctcctgtgtccccatatcccaggccaggccactagagtgatacaactcatgaagtgtttgacagtgattagactgaaaagaaagcagaggccacaccatgtcacaggtgacttttatagtttgggaaatttggtgccacacaggaaggggctgactgtgctgccacccttgctggtacttatgtttgggaaagactctggccttgcaggagttggggatggggtgggataggagactttgctactacagtctagggccctcactgttttcacactgactacctgcaaacacacacctctgtgtgtttactgctcctagctaggggatgcgtagctaggggatgctaggggatgccacactgactacctgcaaacacacacctctgtgtgtttactgctcctagctaggggagcctgccctagcccgactgcccatctggtttttctaagttggtcctgccttttgggtcgggttcggggagctgggcaaagccccgttccctagagactaatgactggcaagcgatcctatgcagctccaggactcaggctttcccccaactctccactcaccaccccttacattgggcataggaggcctcctccggccccaggctgagggcctaagggagccattgagaaccttggccagggctaagcaggccagtgctcaccagcaccgctgccatcccgcgcgctcctgctctccagtgggattctgcccttaaggctccgccagggtcggggcggggccggttgggaggccccgcccccagcccgcccccggcccggggtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggtgcggggcgggccgggctgggggcgcttcccgaacgcaggttgtggggccttgggggattgtttccctggctcgaggtkcgggatgcagagtgcgcgggggcgcagcgagggctcgmggtcctggcggggtcagagcgcgcgggctttgcagatttgggggagggagtgcggggtcgggctaaagttccccattacctcggacggcttgggggttctggggggaagcttctgcggctcggaattgtgaaaagattaaccctcgaagattcgtggtcccccgtgaggataggggccgagagctgagccgtccctccccgttcccagagccgcctccagcccctcccaactgtccccgggccccttccctcccgcttagcagtcactaatttccatgacaacggagagttctttatgggcgacaacccggagggggctgggcggggctgccgcggggtgggggaggaagctccaagcccctggggaccagcagccccccagccaaaattcagcttccaagccttcacctgggtgccagctgggggtccagtgcatggacccacgtgcacggtgggggtgggggcgcacatgttcctgctgggaggtgcggggcttggtgctcacacgtgtgctttccgcatgtgtgttgctgtgccagcgggggcgagccagcagcacttgggaaaggggtcagggtggcagcacggtggggagcagggcccctggctggaggtggctgggatagtgacagcatgagcttctgccttccccagcttgtactgtttggcagagaccctgggctcttgagccccagccccctccccgcatagctctgccaaattgcttttgtccgcacctcccaggcagatcctgctccaccaggttccttcctaaggatcagggccctctgtcccacactaaaagctcagagtctgcagtagtccagtccctgtgctgtactccccttacccccaagtccaggctttgagcccccaggactacctttagagacctggtgccctcccccaccctcagagttgattcctggcagctccagcgacttctgagcctcagtttcctcaactggggaactggtgtctccactcagagtcaggttggtttccagggtggggcaagggtctcccttttctaatatttggtgtggacccttcaggtgctctcctaggctgkctgttcacatatctctgatggccctactctccagccccatgccctggccaccattcacaggcaggcaagcagtcctctgccctgggagaaggccagattccatggtttccattaggggaaactgaggcatggggaggtgaagggctgtgtggttatcctgtttctgggttgcttgtggtgccgtttctggcactcatggcaggatctgctgttgggggttggtgagaggggattaagcagagctgtaagaggggctctggggacccaaagcctggaaaggatagcagatgggggaggggttggctgggagggtctaagtacagctgggccaactgagaagagggactataaagggaagcagccaggcatccgagcctcatttccatacccctatgcgtctgccttcaacatgttggacctgctttacctaagctgccgtgatggcagagagacgggctgggaactgtcctgactggggggctgcagcagctggcctcttccccaccaacatgctccaaggagctggcctccttttggctgtgcctcctacaccaagttcagtgtatgtttgggggatacaggagggtgcagtctcgaaggtcccagtaccatggatagctcctggcccagggatttagagcacatcgccatggaggccttagggctctgctgggcacccatccgcccccttcagaactcccgtccacctcccctttcctgccctttgtgcctgtgtcccttttactttgtcatctccttgctcctcttccatcacaggttctgtctttgtctgtgtctctgccccattctcttttttctaaattctctccatctccccacctcccctttcttgatggggacctgggtcacagaaccttgaagaagcagccaggctaaggtctcaggaaattcttgaagaagggacctgaccaacacatctcccctccccctccccttgttttaaaacttccatcaccatagcaaccctttactctagtgccttcctctgcatttcccctcctccacccacagggaagcagagcctccagtggattctccttcaggggttcagagatttggaccccaagtgcttgggaggagacagctggcctttggctttgcctgcatgttgacagctaaactttcgggatgtagcactggactgcatgcccacccccaaaactggagagacctccccacaatactccctcattagatgggcaaaattcagctgtaggaacttctaccatgatttagctcgagccggaggctcagtcagggcagccccttgaccggtcccctgaagcaattggatggtggtctagaagcttggcccttgttcttaacagaccttgagggaggtcttcagctcccctggtcctgtgggtgacacctcagctgtgagttaagcagggcttgggcttcagcatgttcattgcagcaggaaacccagccccagcccttgagagagtagagcagcagagaggagggggtgcctgcaggctggtgttcacagctgccactaaattaggaggtgttgcctacagttgttgggaggcagctggaggcctcttgggcccctcctggcctccctagatttactgcaagctctggagccccacgtggcaggggaccaaggtagcaggaaactctgtttatgtctatgaaaggtagggcctgaaccaggatgatctcagcggaggaggggacaggaccccaatgtggggcctccggacctcttggcctttgtcccgtttgggctttccctgggccagacttacctaaagatgcagcagagtccctgggggaccatttatcaccagggcaccaacagaggacccctcaggattgctggaggctcaattccctgagtccagtggtcaggccctgggagcaggccataactggggagtgcttggctctcaggctccatgagagccagctggagggcaatggccgcaccagggcctgcactccccacaagctccctctgggcagccggtagtgcatactgttcagttcctctgcagagagtggagggagccatgtctccagggaaatggctgttgtggagctcccatgcccttccatggcctaagtgtacctgaggaagagctcagatcctgtgttgctgagaggagagctctccattgttgggtgttgggtctgggccatgggggtgaaaaatacaaaccccttccacttggcctcctctctttctgagagctgtcccttggctgttcctcccaggtctcctttgttgcaagcaggtgcccagggcttggtgcacacacccgaaacctcccagggagcaacagtggatagcagatggtggagtgggtgtgggcagagggaaccaaggtgctaattgaaagccaggcccctctttctcctctctttgccctggggccaagtccagggccccaagccagtatacttagactggtgaggaggaggaggaggaggaggagtgactggctgaaatttgggcagccatagtagggggcaggggagacagatctgttcccatctcagccttgaggcttcaggacatggctccaggctgacattacggggtggaggcccagttttctgtgcctttcatgggacagacccccatgaccagccctggacctcagtgggcacgaatgcatatgcagagccgaaagctggggccaggatcaaggacaggcatgcacaaaacctcccacccacgccacactggcaaagctgggagctgttggagtggggtggggggtggggcatggaggttgtggaaggtatctcagaaaagggccattttgagtctggccttcgagcatcaggattgttttggacaatgtgttgcacaaaccaccttataatgtcagaaatcacaatgaaagaagagattcagttctgctctcagcacctcgctcatgtggcagctgctccacaggaaagccaaggtgggcagagctcttgccagtgcccacacttcctaccattgagtggacacagttgagctggcgagtcacctgttgttggacatttaggtagttgctgaattttttttwatgttataaataactctgccgtgacaaataggaatctgacgggaggcttttgggggaagggcactcttgccagagggaatggtgtaagcaaagcaacagagccagggcacaggtccctcccagccttcttgggagactgcaggctaaggtaccatcctcctgcccagtacacggccctcagactgagatgactgttgcaggccccctcctgcagctgttatggtgtgaaaatgtgtagccggcaatggtaactggctatgcctctgctctcagctgtgaggatgggattctggccacatgcttctccccagtggaggagtgcagggttgtgcccatggtggcagacatgcagtcagtgacgatcttcaaagcctctcctttgtctctgctgtgcytcgcaagayggcttaaaccctgtctggaataatgctgatgaaatgcatttgtattccctgagcccaagcaacccagatgaaggaatgatagagtttgttccctaatgctgaaggcaaatctgagggagaatttccagggctgtgactcctgggaatcacagcctggtggctggcttctgcctgggaggaagcaagtagcagccagggttggctatggggctcgtttgggtcctggtctttgactttggctggcagagttcatcttgccaagctgcctcctttgcctcctcccttctccactaccttgaggctgtgagtgccttcaggtcggggagcatctaggtacccccaggccctagctcaggccctgcacacagcaagtgctaattggcrtggagggaaaacatgcacagtcagcagaggcagagcaatttcagcgcagcctcagtgcagagcttgctgtagccccagtgtcacactgaccgggtattatggaggcacaccctggcgtcagatctgtgaaggtctagtcagtaaccccccacccccagctttgagcatgggctatgagtgccttttcctttggacactggagtcagcccccctagcactacagatgaggattgggctgtaattggcaggattgcagacctgtgggacaccgtgccccaggtggaaagagtgcctagcgctcactgagccagctatatctgttctgtttgggggccttgcacctggacctgacagcccaggtcccctgtgggccccagtgggcatgaatgcatatgcagagccgaaagctgggaccaggatcaggcttgttttgctcttcctgaccagtacacctgcatacctcctggcaaatcttttcctactgagtcctaatgctgcctccaaagctttaccttgcctctccacccagattatccctctgaggaatcccccaagcactgtgcctgagtgcagtatttactaaattcatcgaagtcattatagtaaaatagtaaaaattcgcacagaaaattagtaaacaaaagatatgtctgcctttttgacatccaattctttgcccaggagagaactcttatttccttcagtattcttccagaaaagagtttgtgagggtacatcagtatgtaaactttaaaaaatttacccaagccaggtatggtggctcatgcctgtaatcccagcactttgggaagctgaggtgggaggatcacttgagcccaggagttcaagaacagcctgggcaacgtaatgaaatcctgtatctacaaaaaaatttttaaaaattagccagttgtggtggtgtgcacctatggtccagtcctagctactcaggaggctgaggtgggaggatcgcttgagcccaggaggttgaggctggaatgagctgtgatcattccactgcattccagcctgggtgccactgcattccagcctgggtgacagaacagctgggcatggtgcgggtgcctgtaatcccagcwgcggtgggaggatcgtttgagttcaggagctctgggctgcagtgcgctatgccagttgggtgtctacactaagtttggcattagtatggtgacytcctgggagctagagctcatcaggttgcctaaaggaggggtgaagcaaccaaggtcagagacgaagcaggtcaaaactcctgtgctgatcagtagtgggcttgtgcccatgaatagccactgcactccagcctgggcaacatagtgagacttgtctctaaaaaaagaaagaaagaaagaaaagaaaagaaaagaaataggtcttccagaatccccccatgtgtcctgaatcaatcataacccctccttttctcttagaagggaccattatctgactctgcttatttcctagcttttctttatagctctactgctgtgtttgtatcccccttacgggtttgttctgcctgtttgaactctatcaatagactcatactatatgtattcttttgtgtctttttgcacttaacactgtgtaagagtcaccaggtggttgggtatagctgtagctcctttgtttccattgctatataatattccattgtgtgactctaccacaatacatcctgttggtggtggtatttggtctgttttcaatttttggckattatgtatatggctactatgagcattgtatgactgtcctgatgcacraatatgtgcacttctgtaggcacgtatttaggagtgcaattgctggttcatagggtatgtttgtttgactttagtggttttaccaaactgctttacaaaggggagtttgccctctcctagcagtgctcacgttcttcatatatccactaacacttgttagctctagaccttcagagatgactagcaggtgggtgggtggttatagcccccttcatctgtaaaatagctgaaatttaaataaactgtttgataagccttttttttgaatgtatagaatacaaaactattcccttatatatcagcttaatacattttttcatatgtaggctgttgcacttcaggcagccaagctgagtagctggatgtctagccagaaaagcaggggtaggatctaagcctgcctatcctctagccccycctggtatggtctctgcccctagcttggcctgagccaggttggggtctcccaaaagcagcccctatgttgtggggaagtggagagtagtacagctaagccagaccccattgtgcccgcaggttagagcctggcaatgccgtttgggtgtgtgactctgggygacaagaagaactataaccagccatcggaggtgactgacagatatgatttgggacaggtcatcaagacgtgagtgccgggcctgtcaggcaaggctgggtgggctggtgagcaggggctagggaagtggcagtggagtgcagctgatgctaaggccaggcctgagtgggtgcctgtcggctgcagtgaggagttttgtgaaatcttccgggccaaggacaagacgacaggcaagctgcacacctgcaagaagttccagaagcgggacggccgcaaggtgcggaaagctgccaagaacgagataggcatcctcaagatgtgagtttgaggcctgggattggggcggggtgggaggcagcagggaagggcttagagggcaagtggcctcaggcagtcccagcctctggccaattagtctgctgtggccactgtggtgaccacagcctctcccaggggttcatccagccctaactactggctcccctccctgtcgccagggtgaagcatcccaacatcctacagctggtggatgtgtttgtgacccgcaaggagtactttatcttcctggagctgtgagtgtgggtctggggacccaagattccccagcgcccagggctttcacctgtcccaccctctgcagctaaggaaaccccctttctggacccttggcgtcccaggtccctgtgccttgctcagccagctgcctggcgtaggcagctcacccaagtgctcctgccctacccctgattctgcccacgccaggctcaggggctggtgtccctcagggccacggggagggaggtgtttgactggatcctggaccagggctactactcggagcgagacacaagcaacgtggtacggcaagtcctggaggccgtggcctatttgcactcactcaagatcgtgcacaggaatctcaaggtgagggcagagccagagtcaaagggccagttggcagctgggctggtgctggggtgggcagcacctcagggccttggtctagcctccaaggtcctcatggtgtcttctgctcacccacatgctattctcacaccacagctggagaacctggtttactacaaccggctgaagaactcgaagattgtcatcagtgacttccatctggctaagctagaaaatggcctcatcaaggagccctgtgggacccccgagtatctgggcaagcagggggtggggcaggggcagggggataatggggggcagccttcagggagctgctctgggcagggggaaaatgtgctcatctcaggaagctggtgtggatggtactggacctggctaggcctgatactgaccagcagatgggcgctgtgtttgtagccccagaggtggtaggccggcagcggtatggacgccctgtggactgctgggccattggagtcatcatgtacatcctgtgagtggacagatggacaagcaggcttgcagtcagatggggtgggggcatgtgtctstggcctttctgtgtgacccttcccccatgcaggctttcaggcaayccacctttctatgaggaggtggaagaagatgattatgagaaccatgataagaatctcttccgcaagatcctggctggtgactatgagtttgactctccatattgggatgatatttcgcaggcaggtgaggaggtgcctgcccagcacttggtagaacgcaagggagtggggagggtgtcctgctctcatcttcctctgtggtattctgcttctgtcccccagcccatttatcacctctagacattgagatggggtgcccatgactatcccctycttggttttgtccacagccaaagacctggtcacaaggctgatggaggtggagcaagaccagcggatcactgcagaagaggccatctcccatgagtggtgagcagggtccaggggagggtgggagaggccagggtccccctcacacccagcagccccatctttgaggcctrgaaggggtgcaggtacctagagctcagggcagcccagaggctctgcctggtagtccctggatgccacatagaagggctgagcagagtctccacaaaggctcattctctcagatccagacacacttgcaccctttccaggatttctggcaatgctgcttctgataagaacatcaaggatggtgtctgtgcccagattgaaaagaactttgccagggccaagtggaaggtaaggcttggataactcccttcttggctctatcccaagtattgcttctggcactcagtttcttgcctgcatcacacccctgcagccacacacaagcttttctcaggccatcaggtgtgggtgtagccactgtgattaccttaagtaggagtgctgagcagctgagtacttggccctggggtggatggaggtggccgggggtactatggaaggagtttggtttggtcactgccaagcaatggatccagcaagcctcacccttagcctttctccactgtgctcctttcagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcatwactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctyacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcctctggccaccctctcgcctttgcttcctctgtcctactggggaggagcccctggaaggcagtggggaagggagaggctgggagcaggttcacaagtagtggctgggagtagtagtgaacagtgccctgtggatttcttgggctgagggtgaagatcatcctcaccacagtgtattcctcaatggtggtggtggtgggggtcctctgaactctagaaatccatgtgagtagtgggtcttgggctgcatttggaccaaggaatactccctgggctgagagctcaagtaagggctgctgtttttgactcctgttgaccgaggagccttactcttgatttaggcatagagctggaatctacctgggccagccascgcaaggacagaccctgctcatagccaaagatagcttccctgagctagggagagggtgtagggtgagcaatgcacaaagattctatgctgctctgtgttgattccttctttctgtgaacacctgtgctttccacctatgccccaaatgaaatctcactctgggtctatttcagctggagcagatcagctttatattatgggactatgcacagggtttcttctgggtagagggagtaacactgccacagatactaagcctaaaaacccaaaagttgacttactccagcccaggtgggcctgggtgaactcaccagggatgctgctctctgggaggacctcaaagataacctcctcaaagataacttctctgatgtgggaataataaaaaggatttgttagtctctagtctttgaagcatctgggcctccaaaattccaaccctactacagtctcaagcataactgatcctcctgagagctaagagctaaagtcagggtactggccctagtgtctccaaactcaaggatagtcatatcttacttggatgaagccaaggttggcctggggtgacctgagggactggggcctatgtgtccatctttctagaatcgcccggaactgaggactgagagggtagggtattgtggtctatgggaactacagaccatagcgcatggtccatcactgtccagagcccaagggacccatcgggaccattgttctattcccttgcggctgcggttttctctgccttggcccagcctgcctcgcgccagctctggcatgggaccacaatgcgctgccttgccctggaaaagggtccagctggcagcctcgctgctccccgccttgatataatgctgcgctctcaagtggcaggtcgagtctccccagaggacgcctgagagcgaccgcgctccgcccaggattctctacggcctcggggccgctaagccccgcccatagttccgcccatccgagaatttgtccaatccaggcgaagtattcacgctccgcccaaagttttgtgttgtcacttccggcccgctccaggaagtcgtgctgcggagccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtggtgagtgactgcagtgttggggcccggtgtttgcccgggtaccgcttcagggccttgaggtgttgggcctccaggcggtccaaccccggaatccagacaagtgatgagaaccttcctcctagacgaggccccacgggagcttcccaacctgggcagaagtgggtcaggacaggctttctggtagaggtgatagctgagctaagcctgagggggactaagatggctcagtgaagatagatgcttccttgatcacctatacaaacagatgtgatttcaaaaccgttagcctgggcaagggtgagctttcaccacatcaacaagtccttttatttcttccagatagaaacctgctaggcttctggctacccaagagagtttgctgtgccttacttgatggtttggaattattctacccagagtcatctcactgtccagacaccccaatgtattcgccatgtcagcaaacccgtttaacatggggaaggcaaggagatgctcccctatccaggggtcctgctgaccgtgtagggccattctgttgagtgtacagctagtggggaaagattcccctagcagatgtggacaggccggtttggacctcctagcaaaagagataaggcagcgttacccctgggaatggtgggtgataataatcacagggtcttgtggggctaaaggccctaggaagcagaaaggcaggcatgacactgatggctgctggcttacttgcaaagctttgtttaggcctgtgttgctgacagcctgagccccatgctgagggagccactgctgtttggttagactagaaattaagctcgcctctaagcgtactctattttctgtttgcctactctattttcttctatccttttactttatttatttatttttattttattttatttttgagatggagtctcgctcctgtcgtgtaggctggagtgcagtggcgtgatctcggctcactgcaacctccacctcctgagttcaagtgattctccttcctcagcctcccaagtagctgacattacaggcgtgcgccaccacgcccagctaatttttgtgtttttcatagacagggtttctccatgttggccaggctggtctcgaactcctgacttcaggtgatccacccaccttggcctctcaaagtgctagggcctatccttttactttaaacttttctgtgtccttgtgttttacatgtatcccttgaaacagcatttatttctttttttgtatattaaaaagtactttagcttactgcaaagatctttattttattttattttgagacagggtctcactctgttacacaggctgcagtgcagtggtgccatctcggctcactgcagcctctacctcctgggctaaggtgattctcccatcttagcctcccaagtagctgggactacaggcgcctgccaccatgcttgactatttttttttttttgtatttttagtagagatggggtcttgctatgttgcccaggctggtcttgaacccctggactcaagtaatccacccacctctgcctcccaaagtgctaggattacaggtgtgaaccaccgcacccagccttggaaaacaacatttagttggacttttaaaaatccagtctgataatctttgtatttaactggaccatttagtctacttaaaattgttgcaattactgattaaataaagagtaaacatattgtctttagtcgattctgttttgccttgcctattatatcttattgtctcctttcttgccttggtaggaattggttaaatattctgtatttctccatttttccctcagttagttgggtcgttatataccccatttccatttataagtggttatcctagaaattaaggtatgtatccttaacttaccaatttcaaggttaatcagcacctttctcattttcccaggcaactcaaagagcttagaatactaacattcttttcccacttctacgttattgttgaatattttaattgtgtgtatgtgtggtatttttttcgttggtgttatttttgagacagagtcctgctctcttgcccaagctggtctgcagtggtacaatctctgctcactgcagccttgacctcctggactcaagcgatcctcctgcctcagcctcacaactagctgggactacaggtgcatgtcaccatgcccagctaatttttgttttttgtagagacaggatttcgccatgctgcccaggctggtttgaaactcctgtactcaagtgatccaccctccttggcctgccaaagtgctggggtttacaggcatgagccaccacgaccggccaattgtatgtttttaagtaaagtttttgtttggaataatttttttttttttttgaaacaggatcgtgctgtgtcgcccaggctggagtttataattgtttcttcttgcaggattgaactttttttaaatgttcttctttgtccttctttgtctcttgtaactttaattcaaagtctgtcttgcctaattttttttttgagatggagtctcgttctgtggcccagactggagtgcagtggcgcaatcttggctcactgcaacctctgcctcttgggttcacgtgattctcctacctcagcctcccgagtagctgggattacaggcacacaccactgtgcctggctaattttttttgtatttttagtagaggcagagtttcactatgttggccagactggtctcaaactcctgacctcgtgatccgcccacctcggcctcccaaagtgctgggattacaggcgtgagctaccgtgcgtggcctatcttgtctaatttaaagtccattttatctgctattagtatagccacttcagctgtcttttggtgactgcatggtatatcttttttcatctgttttattttattttattttattattgtttttagagacaaggtctcgctatgttagccaggctggtctcaaactcctggcctaaagcaatcctcctgccttggccttccaaagtgctgggaatacaggtgtgagccaccacactcggcccttatccaacttctagcttccgttgtagctattgaagtcagattttagtttatcagttactcctttaagcatactttggaactttatcctcagactctcattacctttagaattttctctgattttggctttctgcagttttagtatagtgtatccaatatgaatttctttttacctttttcttttcttttttttttttttgagacagagtcttgctctgttgcccaggctggagcacagtgggacaatctcaactcactgcaacctccacctccctggttcaagcaattctcctgcctcagcctcccgagtagctgggactaaaggcacgtgtcatcatgcccggctaaattttgtacttgtagcagagacagggtttcaccatgttggccaggctggtctcgaactcctgacctcaggtgatcttcccaccttggtctcccaaagtgccgggattacagccatgagccattgtgcctggccgaatttctttttacaaattctgctcgggattcattagatttctttaacgtgtagagcaatttctttctttctttcttttttttttgagacggagtctcgctgtgtcacccaggctggagtgcagtggcacgatcttggctcactgcaagctctgcctcccgggttcacgccattctcctgcctcagcctcccgagtagctgggactacaggcgcctgccaccatgcccagctaattttttgtatttttagtagagatggggtttcactgtgttagtcaggatggtcttgatctcctgacctcatgatctgcctgcctcggcctcccaaagtgctgggattacaggcgtgagccaccgcgcctggccgtgtggagcaatttctttaatcagttctggaaaattatcagccattatctcttcatatattgcctctattccattaacttttttatcctgtgttattatttatttttgaggtagagtctcgctctgtcacccaggctggagtgcaatggtccgatctcggctcactgcaacctccacctcctgggttcaagcaattctcctgcgtcaacctcccgagtagctgggattacaggcgctcgccaccgtgcctggctaatttttgtatttttagtagagacggggtttcaccatgttggccaggctggtctcgaactcctgacctcaagtgatctgcccctctcagcagattgttgttgttgttgttgttgagacagggtctcactctgttgccaaggctggagtgcaatggcaccaacacagctcactgcagccttgacttgggctcaagcagtcctcccatctcagccttcccagtagcacatgccacagccagctaattttcttttcttcttcttctttttttttttttttttgagacggagtttcgctgttgttaccctggctggagtgcaatggcgtaatctcggctcaccgcaacctccacctcccaggttcaagagattctcctgcctcagcctcccggggtagctgggattacaggcatgcacctggctaattttgtatttttagtagagacggggtttctctgtgttggtcaggctgctctcgaactcccgacctcaagtgatccgcctgcctcggcctccnnnnnnnnnnnnnnnnnnnncccgcctcggcctcccaaagtgctgggattacaggcgtgagccactgcacctggcctacctaaagtctttgtgg

SEQ ID NO: 1718 - DNA, 201 bp, Homo sapiens
tcacaatctggatgtttggtatcatgagacaatctccctgccctggcttggggggccacccatgggttaaggcataagtaacaattcctgacaagagtggrgtcattaatgtctggagcaggaagctgaggggagttgtgtttttctcttgcctcaacattgtaggaggagagagaatcctttctaggcatcagggtcatc

SEQ ID NO: 1719 - DNA, 201 bp, Homo sapiens
cattctgggcttgttgcagaatgtgcctgcccgaagggaaacccaggagtcccccaagccctccctgtcttgattgcccagcccctgccaggggatagccmtggcaagcaatgcccccactgccaatgctactcactcctcaagtggacataaaatgtactccaaaagccacagatccctgcccagcaggctgtgctagct

SEQ ID NO: 1720 - DNA, 201 bp, Homo sapiens
acaaagacgctggacagaataagtgcataactacatggtacagagggttataaggagggaaaaggggagctggatgagagagttgagagtgcccggtgtgytggggaaagctgcagggtgaaatactgcatcagggaaacctcagggaaggtgaggactatggtgaggtcagaggggttgatatgagaacagtgccctgca

SEQ ID NO: 1721 - DNA, 201 bp, Homo sapiens
aagacggcagccactctcatgtcaaatcccagcgtcttttgggaggcagcttcccttttttagtttagtttgttggaagaaaagaattgtccctttccccsctctaaactaaaagccttgccagcccaggtgggcagcaccgaggtccctgcagggaacgtgcaaggggaaccctgcagtttcccgctcacatgcccttcc

SEQ ID NO: 1722 - DNA, 201 bp, Homo sapiens
gcagaaggcaaaggcaagaaagccagtggcatctgaaatgggtctcccttcgaaagagagcacatccacctgacccagaccgcagagccaggccaggaggmagaggaggaagaataaaaaagccaaccacatcgggactcaaaggaagcccaggatcctcgccggcctccaccgcatgctgccctgaccctgccccacttc

SEQ ID NO: 1723 - DNA, 201 bp, Homo sapiens
tgtcctactggctctggttgggagcctttcctagcagtcctaccatgactggcctcttggatccactctgaattcttctacttctctttgcagtagaaagrcattaactgatatttctctttccaaatttctttgcaatgttttctgtagaagaactgaacattaaataaatattatttctagaactcagttttcgcaaaa

SEQ ID NO: 1724 - DNA, 201 bp, Homo sapiens
gcctacctacccaggaaattgcggcagcccccagccgtggagccgcgaacccagcttccctgatggaccgtcacctcccatttgtggatcgcgtcttcctycagggcatcgggagtgaggttgcagatctccactttatcaaagtgggccttgaagtcctgaaatgccatcctgcagcaaagcggagagacacgatgcaca

SEQ ID NO: 1725 - DNA, 201 bp, Homo sapiens
catggctgtgttgcaataaaacttgtttacacaaacagatggtggtccagcccagatttggcccatgggctgtagtttgccaatccttggaacagataaaygttcatgctattatttgtttagtaagagtattctttagttgccaggttgaccatgaactaccataaatagagagctcctggaatgtacattggaaaagtt

SEQ ID NO: 1726 - DNA, 201 bp, Homo sapiens
acattggaaaagtttttctttttgtccagtttttcaggatcacagctgttatacaaagctctgtgtaccaacaatgcatatatcaccaggctcatatacarttttcttagaggagctcaataccctgtggacttaaattaagaaccataaaactgcttgagagtggacaaagagaagataaccatttttcctatcttactg

SEQ ID NO: 1727 - DNA, 201 bp, Homo sapiens
cttagtaggaaagtgagtgtttcattttctcaatttatctgtggatgtggacaaaggggaaaggggtagggaatagggggttgtagtcagcctccaacagrttattaccactgaaattgtgccctaaaggattaaagaagtcagtaactaacagaaattcttgagtttgcaaggtaagaaacaacttgctcaaatgctgaa

SEQ ID NO: 1728 - DNA, 201 bp, Homo sapiens
aactcactctcatgagaatagcataggggaaatcgtccccatgatccagtcacctccctctcttgacacatggggattacaggtgcctcccttgacaggtkgggattacaattcgagatgaaatttgggtggggacacagagctaaaccgtatcattctccaccggcccttcccaaatctcatgccttttcagatttcaaa

SEQ ID NO: 1729 - DNA, 201 bp, Homo sapiens
tatcccaatagcacctgcctgactaatacatcatgctctgctgactccatatgtggctggtttcctggatccgattctgactgatggtatctgttctcacrctgctaataaagacataccagagactgggtaatttataaagaaaaagaggtttaatggacttatgtgttccacgtggctggggaggcctcacaatcatgg

SEQ ID NO: 1730 - DNA, 201 bp, Homo sapiens
atgactggcagaacaagaacatgaaatggtctccacgcagaagacagccacgtggaagtggctgactggtagaccagctgagatgaagactactccagtcytcacagcggtgctcaaatggccccatcaaatcaaatgtaatgaccaggcagagactagggtgaaaacagttgtggaaatccatttgtatgtctcctgtaa

SEQ ID NO: 1731 - DNA, 201 bp, Homo sapiens
ccaaaccatatcagatggcttatttggtttctatgtagaacctctgcttttcattcaacagtcttcatttagccacagataagctctgtccctaacttccrctgatggaatgtacacataagaaacttccactgatggaatgaacacagaaggtgcctactgggaagaaaactggcctgaatctgagctgggtcaaatgtc

SEQ ID NO: 1732 - DNA, 201 bp, Homo sapiens
gagtccaaaggtttgagaacgaggagctccaatgtccaagagcaggggaatatggatgtcccagttcaagtagggaaagggaattcacccttcctttgtcrttttcttttatttggatctttagcaaactgaataatgctcgtccacattggtggcagcaatcctctttactcagtctactgattcaaaagctattttctc

SEQ ID NO: 1733 - DNA, 201 bp, Homo sapiens
tgcagtcagtttgaatggctgctccttatgggaataatttacattctcaataaaattctctagcaattttctgattgattttaatgagctttaaagccttmcgtagaagatcccccagctgatagtcagccttgggcatggattaagggcttttaaccaatcttgcaacaagtttaagcagatattctttattgggtccaa

SEQ ID NO: 1734 - DNA, 201 bp, Homo sapiens
ggtcctgaaattttattttcttttacaccactttccagcatgttacctgatcagttgtttattatctttgctgttgaatggagtgatcattccaagggccygaggcaggaggcccaggcacagtggaaactctcccaaagaccaggatctttgttttgttccctgacatatgctgagcaccaggaatagtgaatgaatgaa

SEQ ID NO: 1735 - DNA, 201 bp, Homo sapiens
caagggcccgaggcaggaggcccaggcacagtggaaactctcccaaagaccaggatctttgttttgttccctgacatatgctgagcaccaggaatagtgartgaatgaaacaaattgtgaggctttaaagagccgaaatatttaaacactgggcacaaggttgttgcttaatcagtgctagatccttacctcccccttgtg

SEQ ID NO: 1736 - DNA, 201 bp, Homo sapiens
aacaaattgtgaggctttaaagagccgaaatatttaaacactgggcacaaggttgttgcttaatcagtgctagatccttacctcccccttgtgtccaggtsgacttgttactgcagttaaaccacttgctgatcctcaaacaactagttagtggcacagccaggcctaggaccccagtctctactgttccaactaacccat

SEQ ID NO: 1737 - DNA, 201 bp, Homo sapiens
gggtttagacaaatctgcagacaggaggaagaatgagatgaatggcacttaagtgttattcctctccagatcatgattctcccagtttgaattaagactcktctctgagttttggaggagagatgcttggaaaggatgattgaagagattcattcacccattagactccctactattgattaaggatgtaatgaagtgata

SEQ ID NO: 1738 - DNA, 201 bp, Homo sapiens
tctctctcagatgtaactgagctgtgggctaggaggaaaaggccgggaggaggcacggtgatgactgaaaaacctctcccctctcataagaccagtcatcyggacgcgggctttcccccactcggtgcccacctggggtcttacaggaggagctgctcctcctcagcaataggacaagatggtcaggtcttcctgcttccg

SEQ ID NO: 1739 - DNA, 201 bp, Homo sapiens
atcagggaaacctcagggaaggtgaggactatggtgaggtcagaggggttgatatgagaacagtgccctgcaaatggcaggcaccacaggagcatgagccrtcatcttcacctttagcattcagcccgggagaagtagggagacatagaaggggcaggtgctggccaagaggcaggggcaggagaggagaaggcggagggg

SEQ ID NO: 1740 - DNA, 201 bp, Homo sapiens
aactcagaaactctccaagtaaacacaaattagccatcgggtataaattggggaggtgtctggatgtgtgaccgactcctctgtgggtcagtgtttctggkaattggtgtgcacacgtgccagtcacagggggttctgcggacgcatgtgtggaaggggcagctaggcggtgggcctgggttagatgcctgggagtggtgt

SEQ ID NO: 1741 - DNA, 201 bp, Homo sapiens
tgtggtcccccgcaatccagcacgtcaagggctcctgatggatcaagataatctgatcgagcaaagtgagagtcggtggcgtccctggcaagatcagggtkagtggggtggtggggcacactcatagctgagtggagtcgagagagtaagggagaagaggaactggcgggcttgctgtagaggacaggagagagctgggtt

SEQ ID NO: 1742 - DNA, 201 bp, Homo sapiens
ggggcagggcaatggatcactcacatggacgctcttctttgtggagcttcctgctgtgaatttccgagtttcctctgcccggcttctcccaccgtctgcaycagaccttctttccactagcctgacctcaggtagcctctcaaactctggtttctacctcctgctcatatgcagcaattactgtgatggtactaattccag

SEQ ID NO: 1743 - DNA, 201 bp, Homo sapiens; identical to SEQ ID NO: 167

SEQ ID NO: 1744 - DNA, 201 bp, Homo sapiens
ctcccacgctctctggacttcacagaactggatgttgctgctgagaagattgacaggttcatgcaggctgtgacaggatggaagactggctgctccctgaygggagccagtgtggacagcaccctggctttcaacacctacgtccacttccaaggtaaggcaaacctctctgctggctctggccctaggacttagtatcca

SEQ ID NO: 1745 - DNA, 201 bp, Homo sapiens
tcctcccacctctgccttccaaagtgttgggattaaaggtgtgagccactgcacccagccacagattgcttaaagcattcatttaacaaatacttgttgargatttgctacttgtaagactttaagcctggcatctcagaggaggccagaggagggctgtataggccctgcctccaggcttttaaaggtcaatgggcaaat

SEQ ID NO: 1746 - DNA, 201 bp, Homo sapiens
atagggacagaatttcagttttgcaagatgaaaaagtgctggagatagatcgtggtgatagctgcacaacaacatggatgtacttaatgctactcaactgmacacttaaaaatggtaaaatttatgtcatatacattttatcatatacgattatttatcgatatgtcatatacgactttttaaaaataaaaaagaagcatc

SEQ ID NO: 1747 - DNA, 201 bp, Homo sapiens
agggaaacgtgctccacaaggtaactcagggaagcctcggggctctcagaggacagaggtcactggggagcggagagcaggccttgcctggcagtgagggmaacagggctggtgaagctaggagcaagcatgatgagcccagcctgcagagtttggggcaaggaacgaggatggggcggttggcttggcatgagtgttgaa

SEQ ID NO: 1748 - DNA, 201 bp, Homo sapiens
caagatgttaacctcgtgagggacagagagccaggcgggaggtgaaagacaagactgtggagaaagaggttcagtggcgcatagtgatttttcttaccacracaacctccttgaggtctttcccttcgggttcagggggaggtgatagatggggggattgctcagccctggcactgactggtcacaggggcagaggccagc

SEQ ID NO: 1749 - DNA, 201 bp, Homo sapiens
ggaggtgaaagacaagactgtggagaaagaggttcagtggcgcatagtgatttttcttaccacgacaacctccttgaggtctttcccttcgggttcagggrgaggtgatagatggggggattgctcagccctggcactgactggtcacaggggcagaggccagcccgagggttgcccggttgagggtggcagcacactgtg

SEQ ID NO: 1750 - DNA, 201 bp, Homo sapiens
gcacagctgtgtttgacaagaaggtggtgctgaggaggagggccgtccagccccacggtcccacgggctgctgagacgtgcaccgtgtaatgctgagtccyactgcaaatgatgcccaagccacagaggtctgcagggaacctggcaatgcttgtgatttccctatggcccgctaccccccggctccctgcgactctatgc

SEQ ID NO: 1751 - DNA, 201 bp, Homo sapiens
ggtctttcccttcgggttcagggggaggtgatagatggggggattgctcagccctggcactgactggtcacaggggcagaggccagcccgagggttgcccsgttgagggtggcagcacactgtgcagggcagagcagggacacatggacttagcctgctgtccctaggagaagtgctgggaggagcgctcactgagaagga

SEQ ID NO: 1752 - DNA, 201 bp, Homo sapiens
gcagaggccagcccgagggttgcccggttgagggtggcagcacactgtgcagggcagagcagggacacatggacttagcctgctgtccctaggagaagtgytgggaggagcgctcactgagaaggagggtcctgcagaaggcaaaggcaagaaagccagtggcatctgaaatgggtctcccttcgaaagagagcacatcca

SEQ ID NO: 1753 - DNA, 201 bp, Homo sapiens
cctgccccacttcctaactttgctggcctcagtttccgtcaaaggaggcagccacttcctgcccacatggtctgtccagtgaggagatcgggggctgtctmgggacctctaggtttccctttagcaatgatgttctatttacatgacctcagcaggcagctagatgtgtcccactagagaggacctgaggatctggggcct

SEQ ID NO: 1754 - DNA, 201 bp, Homo sapiens
tgaagcagcccagcagggagcctctcttcaaagccttctctagaatctcatagaagttctcgggggcctctttagtttggaaggtctctgccacacccccrgtgaagtcttccatggcctcgatggcgctgcctcccttcagagcttcatagctcccatttagcctgcaagggtggcaagagagagaggagagagtcaggg

SEQ ID NO: 1755 - DNA, 201 bp, Homo sapiens
cccttggcccaatcaagttgacacataaaactaaccataacaccatctatacagtttttttttggtgagctgttctgccaaccatttttggcctttttaartgaccccaataaatcttttttatgtttagaaactagatggcacacagtttctgttgccttgcttgcatcctgatgtggggggcactcaccaaggggcaga

SEQ ID NO: 1756 - DNA, 201 bp, Homo sapiens; identical to SEQ ID NO: 187

SEQ ID NO: 1757 - DNA, 201 bp, Homo sapiens
aggaaaaaactcagaaactctccaagtaaacacaaattagccatcgggtataaattggggaggtgtctggatgtgtgaccgactcctctgtgggtcagtgyttctgggaattggtgtgcacacgtgccagtcacagggggttctgcggacgcatgtgtggaaggggcagctaggcggtgggcctgggttagatgcctggga

SEQ ID NO: 1758 - DNA, 201 bp, Homo sapiens
cgtaccaactgtgcctgcagctgccaccgcctcccagctcctatcttgcaattggttgttttgttcaggagaggtctgtttttgtttttgttttaaaccaratcgcacccaatgaggagaaaaatacaaaaggaaaaaactcagaaactctccaagtaaacacaaattagccatcgggtataaattggggaggtgtctgga

SEQ ID NO: 1759 - DNA, 201 bp, Homo sapiens
acagtttttttttggtgagctgttctgccaaccatttttggcctttttaagtgaccccaataaatcttttttatgtttagaaactagatggcacacagttkctgttgccttgcttgcatcctgatgtggggggcactcaccaaggggcagaggtgggcttgggtcccacccactggacttggaaacagtgccctttgtccc

SEQ ID NO: 1760 - DNA, 201 bp, Homo sapiens
catggagtgggcaaggcaggctgctgggctttgctgagcttgagtctggcagagtgatacctttggcttcttgtcctcctctttcattcaattctttcttwctcttccccttgtgcccctcaaggatctctcctcctaaccaacagctcccttgaagtcagggtggtgctgtgtggagtctgggtgtcccccaggatcagt

SEQ ID NO: 1761 - DNA, 201 bp, Homo sapiens
aagctttccacggtagactgggatgatgcacctcagttgcactgagcgtagccggcccctccccagcacccctgtttccacttcctgcgggggctgctgarcctcggcctcatctatgctccttcccctgctcgccccactcacccctggtcgtttccacacaaaggggatctgcggcctctcactgtagaacagggagga

SEQ ID NO: 1762 - DNA, 201 bp, Homo sapiens
aaggaggacaaaggagccaacacaaatagctaacattctaaagaatcccaaagagtccaacggcgtctcacaccttggctccagtgaggaggaagggcagrgtctcccttcagtgttctttactccccacgcattcagaggatgtcactcaaaaggtgggtggctacagaagaccaggtgcatctgcaccttctaagtact

SEQ ID NO: 1763 - DNA, 201 bp, Homo sapiens
cctgtaattccagcactttgggaggccaaggtgggtggtttctctgaggtcaggggttcgagactagcctggccaacacggtgaaaccccatctctactamagatacaaaatgagtcgggcgtggtggcgcatgcctgtactctcagctgcttgggaggctgaggcaggagtatcacttgaacctgggaggcagaggttgc

SEQ ID NO: 1764 - DNA, 201 bp, Homo sapiens
ccaccgtctgcaccagaccttctttccactagcctgacctcaggtagcctctcaaactctggtttctacctcctgctcatatgcagcaattactgtgatgktactaattccagaactcagctttcttcctgcagtttttgctcctctcttgtaaccccctaactcaaagtcccctgtacttcaaaattcaaagtttatctg

SEQ ID NO: 1765 - DNA, 201 bp, Homo sapiens
ctgagcatggggcgctggccctggtggtttccatgacaccaggtcctgacttgacctcgacagatttacctagcctccggatgagaatggtgagctgtgcrtgtcagacgagcagagggaagacggcagccactctcatgtcaaatcccagcgtcttttgggaggcagcttcccttttttagtttagtttgttggaagaaa

SEQ ID NO: 1766 - DNA, 201 bp, Homo sapiens
ccctggaatgtgggagccacactgtcctgcccaggctgggggcggggtggggagtagacacacctgagctgagccttgggtgcagagcagggcagggccgyggtggcacggggctgggcaggcggcctgtgtgtctgtctaccagtcctccatccagccagcacccagctctccagttagtgtctgtctttcaagtgcagg

SEQ ID NO: 1767 - DNA, 201 bp, Homo sapiens
cctttgctaggaagcaggtccaggccctcagcctggtggggagatggaagtggggcatgtcctacctcaccagcgacttgttcaaacagagcccgaaaccrctgctcctcctctgtctcctggtcaggtggagttggctttggaggctaaaaaacagccaaagaaacttgcacaaaatgatccacaaaaaagaaacatgac

SEQ ID NO: 1768 - DNA, 201 bp, Homo sapiens
ggagtagacacacctgagctgagccttgggtgcagagcagggcagggccgcggtggcacggggctgggcaggcggcctgtgtgtctgtctaccagtcctcyatccagccagcacccagctctccagttagtgtctgtctttcaagtgcaggcaaggtaaaggaggagaggaagaatgctttttctacacttacacttgcct

SEQ ID NO: 1769 - DNA, 201 bp, Homo sapiens
ctggaaatctgctcccagaggcaggcattgagtgacacgatggcttgacatcaactctgggtgttttttatgttttaaaaattgtgatggtaaaatatacrtaacaaaatttgccatcgtaaccattttcgagtgcacagttcagtggtactaggcccattcacactgttgtgcagccatcacccccgtccatctccattt

SEQ ID NO: 1770 - DNA, 201 bp, Homo sapiens
tgttttttatgttttaaaaattgtgatggtaaaatatacgtaacaaaatttgccatcgtaaccattttcgagtgcacagttcagtggtactaggcccattyacactgttgtgcagccatcacccccgtccatctccatttatcttctcaacttcccaaactgaagctctgtcctgctgaaacactaactctccatttcccc

SEQ ID NO: 1771 - DNA, 201 bp, Homo sapiens
gcctcgatggcgctgcctcccttcagagcttcatagctcccatttagcctgcaagggtggcaagagagagaggagagagtcagggacctagggaggccacyggggcaccctgctttcagagcttttctaactaagcctgaagcatctcccagggcttgccctggctgggtggtgtggaaggaagacgggaagcaagttatc

SEQ ID NO: 1772 - DNA, 201 bp, Homo sapiens
ctgcagcacttctggtctaaaacatggaaagagcagagtcacacccaccgtctaagtcaagcctcccctgctggatcagacccagctacatgcctggcccrgtcacaacctccagccccttctgctgccccaggtgcaggccatgtgcgtgggctatgcacggggctcccctaggatgtttagcagtgacatgaagcaagt

SEQ ID NO: 1773 - DNA, 201 bp, Homo sapiens
gcaggaataaacactgcccccaagagttatgcccctccttgggtgtggctggggtacctggtacagccccagcatagtgcctggaatgcactatgcagccycagcatagtgcctggaatgggagcccatgagcaacttacatcaatgaagcagcccagcagggagcctctcttcaaagccttctctagaatctcatagaag

SEQ ID NO: 1774 - DNA, 201 bp, Homo sapiens
gtggctggggtacctggtacagccccagcatagtgcctggaatgcactatgcagccccagcatagtgcctggaatgggagcccatgagcaacttacatcartgaagcagcccagcagggagcctctcttcaaagccttctctagaatctcatagaagttctcgggggcctctttagtttggaaggtctctgccacaccccc

SEQ ID NO: 1775 - DNA, 201 bp, Homo sapiens
aatgttgatcctgttgcttttttcccctctgaccaagctacccatagacagctttgaaaatcacacacgggttccaaggtagggcacctgggctttgtccwccaagttacaagctgagtattccacccagcactaaccattgacatcagctgaaagactcagggtcaacccatcaaagccgcaggcgatgcagggggcagg

SEQ ID NO: 1776 - DNA, 201 bp, Homo sapiens
cggtctcccttttgtcttccttttcgtcttgggtggaagcacggtggtactcccgtaagcatcggaatagcatgatgctgttttcccttctcccctgtccraatacaattcctctagcctatagcctgcagcctgctgcaccattttaaatcccctctgctctaggttcactgggtcccccagaggccaagccctgctcca

SEQ ID NO: 1777 - DNA, 201 bp, Homo sapiens
gactgggatgatgcacctcagttgcactgagcgtagccggcccctccccagcacccctgtttccacttcctgcgggggctgctgaacctcggcctcatctrtgctccttcccctgctcgccccactcacccctggtcgtttccacacaaaggggatctgcggcctctcactgtagaacagggaggaattgctggctgggaa

SEQ ID NO: 1778 - DNA, 201 bp, Homo sapiens
cagttgcactgagcgtagccggcccctccccagcacccctgtttccacttcctgcgggggctgctgaacctcggcctcatctatgctccttcccctgctcrccccactcacccctggtcgtttccacacaaaggggatctgcggcctctcactgtagaacagggaggaattgctggctgggaagtctgcatcctcaaacag

SEQ ID NO: 1779 - DNA, 201 bp, Homo sapiens
agacatggtgccggacttgtcagcatcaaaccgaaggaaaaggttctaaagggtggagagcagaagccttgagaaggagcgtgcctgaaaggcatcgctgrtggcagtaaatgggtgacagccagcccgggggagctaccctctaggggccgcagaggccacagttggactgggccttccaaaagaagtcggtctcccttt

SEQ ID NO: 1780 - DNA, 201 bp, Homo sapiens
gaaggatttttcccacctcttcccacttttccaggcaccaggactgaggaggggcctgggctggaggtggaaggttccagcagtgtctgggcggacgccaygtggggagctcaagctgcgccgccttccccgagagacctctgctttgaattgtcttcctcaggcttctcagcaccctgcttctcctctcatcttgtgtcc

SEQ ID NO: 1781 - DNA, 201 bp, Homo sapiens
ttcaggagagttttgcaaattgcatttgaggaagagacaaaccataaaccaggagagaaaagagcgaggatggagagggaaggggtgggatggggcaaggstagctacagcagtcagcaggggaggcgtctctgggggaagcagaggagcacagacctaaacaaagggagggagggagggagggagggaggaagccgggcc

SEQ ID NO: 1782 - DNA, 201 bp, Homo sapiens
atgccagaggagataatactaaggaagacagccccttggagcagagatctgggactctagagtcgctgggcaggccttggtggccctggtcccaggagggragacttctgaagggggagacaaagatgccctccatgctggtttgtgcgtccagcttttatcttggagaattctaactttgacaaaaagtaagtgagttgt

SEQ ID NO: 1783 - DNA, 201 bp, Homo sapiens
ccagcctgtggtctggccaagtgatgtaaccctcctctccagcctgtgcacaggcagcctgggaacagctccatccccacccctcagctataaatagggcmtcgtgacccggccaggggaagaagctgccgttgttctgggtactacagcagaaggtaagccgggggccccctcagctccttctcggccttgtctctctca

SEQ ID NO: 1784 - DNA, 201 bp, Homo sapiens
gtggatcgcgtcttcctccagggcatcgggagtgaggttgcagatctccactttatcaaagtgggccttgaagtcctgaaatgccatcctgcagcaaagckgagagacacgatgcacaggagggcaagagtgagggcatcatccattcactcattcattaaatcattcacttattcattaaatcatcttgttcctgtccgc

SEQ ID NO: 1785 - DNA, 201 bp, Homo sapiens
gaccacttaggagaaaaggagaagggagaacttccagtattttatccaaattctttattcgtcactcagctagcccagacgtcttcttaggaagcattggragatatgagagagtggtgtggggtgggaagcaaatggttggggagacatagcatctggcttttttgggaagccctgctgggtttagacaaatctgcagac

SEQ ID NO: 1786 - DNA, 201 bp, Homo sapiens
ctgtcttgctgggtctgacccagcatgctccagatagcacctggagcagggaggtcaccactgccttcccccctcaccatgctctgtcccgcccagggctrcgctcagccaccttcctgctgtgctttaagcagtcacatgagcccccattttctccatccgatcctgtggtcccctaatctccctgccttgcctgtttat

SEQ ID NO: 1787 - DNA, 201 bp, Homo sapiens
gctgagaagattgacaggttcatgcaggctgtgacaggatggaagactggctgctccctgatgggagccagtgtggacagcaccctggctttcaacacctrcgtccacttccaaggtaaggcaaacctctctgctggctctggccctaggacttagtatccaatgtgtagctgagatcagccagtcaggccttggagatgg

SEQ ID NO: 1788 - DNA, 201 bp, Homo sapiens
ccggaaagttcacaaaaacagaactctgttcccttggatgggatcccaaagtggcaagaagacccccaagtcccttcaaaagctccccacccccaccactrggcagtcttgtgcatcttgattctgatccaatttcagcatgggggtcccccagctttgggttattttctgtgaagaagactattctgctggctaaggatg

SEQ ID NO: 1789 - DNA, 201 bp, Homo sapiens
ggatgaaggcctcacccagcgtttggggcaatgccagaggagataatactaaggaagacagccccttggagcagagatctgggactctagagtcgctgggsaggccttggtggccctggtcccaggaggggagacttctgaagggggagacaaagatgccctccatgctggtttgtgcgtccagcttttatcttggagaat

SEQ ID NO: 1790 - DNA, 201 bp, Homo sapiens
catgctcatcctcagcccttttgttcctgattttacagaaatctgtaagatatgatgtaaagctcctaactcccctaaataagaaacagataggggtacgrgaatgaggaccagaccaaagggacaatcttcagttgcagacaaaggaaaaggcagaacagattctgaaaatgagtctgtgggaacgacagcaacacagta

SEQ ID NO: 1791 - DNA, 201 bp, Homo sapiens
cctcgatggcgctgcctcccttcagagcttcatagctcccatttagcctgcaagggtggcaagagagagaggagagagtcagggacctagggaggccactrgggcaccctgctttcagagcttttctaactaagcctgaagcatctcccagggcttgccctggctgggtggtgtggaaggaagacgggaagcaagttatca

SEQ ID NO: 1792 - DNA, 201 bp, Homo sapiens
ccaagcggtccctgaaggtgggcaggcggtcatcgatcaccacgtccagccactcactgtgctgccagaactgttgcccaggaaaaagacagaaatgatgygagtcagctacatgggagctccaggccctgtttgtaaatgttgatcctgttgcttttttcccctctgaccaagctacccatagacagctttgaaaatcac

SEQ ID NO: 1793 - DNA, 201 bp, Homo sapiens
ccgcttgagccctgagagggttgggtcctgccgagcctcacctgcaaacccagagccctgattttttcccagcccttagatgctcactacaaagactagtrtagagactcctgtcgggaggctgcctgagctggggaagctgtcactcacttggcgtaggctttttccagcaaggcgctccagaactcgttgtggtcggca

SEQ ID NO: 1794 - DNA, 201 bp, Homo sapiens
cactctcatgtcaaatcccagcgtcttttgggaggcagcttcccttttttagtttagtttgttggaagaaaagaattgtccctttcccccctctaaactawaagccttgccagcccaggtgggcagcaccgaggtccctgcagggaacgtgcaaggggaaccctgcagtttcccgctcacatgcccttccgagactgagtg

SEQ ID NO: 1795 - DNA, 201 bp, Homo sapiens
ggaggtgttcacaggattgttcagaaatccacccagggtctttctgcttcttcctaattccagcagaggagcaggcaggtcagacacagagcacagagtcyctggagcctgcacggcagtgctggctgccagccttggccagaatcctgatgtttggggctagaggagggggatgaggggcgattctccccacaccacgtc

SEQ ID NO: 1796 - DNA, 201 bp, Homo sapiens
gtcccactagagaggacctgaggatctggggcctgatgggctccagggtaccgtctgcccagtgcttgctgtgctcctgagcatggggcgctggccctggyggtttccatgacaccaggtcctgacttgacctcgacagatttacctagcctccggatgagaatggtgagctgtgcgtgtcagacgagcagagggaagacg

SEQ ID NO: 1797 - DNA, 201 bp, Homo sapiens
gaaacttgcacaaaatgatccacaaaaaagaaacatgacaaaaatagcaggaaagaagccaggagcctgtgtgcccagccccatgtcaccctcctgaggcrgtgtgcacaagctgcgtcctgtagcgtgaggaacattttctcatgaaggctcttttagaaggtgagactagaaggactttattagctggacctgtggagc

SEQ ID NO: 1798 - DNA, 201 bp, Homo sapiens
agcagctcggcaaatccatgggtggggtggggctgaggggtgtgtctaagagacactgaggaggctctgtcaagatgttaacctcgtgagggacagagagycaggcgggaggtgaaagacaagactgtggagaaagaggttcagtggcgcatagtgatttttcttaccacgacaacctccttgaggtctttcccttcgggt

SEQ ID NO: 1799 - DNA, 201 bp, Homo sapiens
cccaaaagccctcaacagatttctgtttgtctcattggtcagaactatcttacttgaccactaatggttacagaggagagcagtgatgcaggatttttctyggtccctttgccagtcagggacctcttgctggtgatgctggaggccttgcttggggcacactacctgtccctggaggtgcctcacccaatcggcccccct

SEQ ID NO: 1800 - DNA, 201 bp, Homo sapiens
tggacacatcaccactcccaacctgcctcacccactgcgtcacttgtgatcactggcttctggcgactctcaccaaggtctctgtcatgccctgttataaygactacaaaagcaagtcttacctataggaaaataagaattataacccttttactggtcatgtgaaacttaccatttgcaatttgtacagcataaacacag

SEQ ID NO: 1801 - DNA, 201 bp, Homo sapiens
attttaaaaaatatcattagacttctatctgctatttttttcatagtacatgaaatgaaaaaaaaaaaacaaatttcagaaaactagataggaagatcccrtttcagtaaaatcaaaccaactgaccttgatgtttgtgtgtggaagtgtgtgcctgtttgtacgagcagatagagagctgggaaggatacaggccaggtg

SEQ ID NO: 1802 - DNA, 201 bp, Homo sapiens
atagagaaaattttaaaaaatatcattagacttctatctgctatttttttcatagtacatgaaatgaaaaaaaaaaaacaaatttcagaaaactagatagraagatcccgtttcagtaaaatcaaaccaactgaccttgatgtttgtgtgtggaagtgtgtgcctgtttgtacgagcagatagagagctgggaaggataca

SEQ ID NO: 1803 - DNA, 201 bp, Homo sapiens
tataagtgtgtgtgtttgtatgcatagagaaaattttaaaaaatatcattagacttctatctgctatttttttcatagtacatgaaatgaaaaaaaaaaaacaaatttcagaaaactagataggaagatcccgtttcagtaaaatcaaaccaactgaccttgatgtttgtgtgtggaagtgtgtgcctgtttgtacgagca

SEQ ID NO: 1804 - DNA, 201 bp, Homo sapiens
gggccgggctcggtcagtctccagctgggatccccagagtggtcaccctacccctccctcgagacagactgcctgactgtgtgtcatcaggctggtcaccrtctccctgaacctcgatttgctcacctataaaatggaactaataacgatgcctgggctccctgtctcaggggctctggtatagctgaagagaactaatat

SEQ ID NO: 1805 - DNA, 201 bp, Homo sapiens
gacctcgacagatttacctagcctccggatgagaatggtgagctgtgcgtgtcagacgagcagagggaagacggcagccactctcatgtcaaatcccagcrtcttttgggaggcagcttcccttttttagtttagtttgttggaagaaaagaattgtccctttcccccctctaaactaaaagccttgccagcccaggtggg

SEQ ID NO: 1806 - DNA, 201 bp, Homo sapiens
acacacaaatttgtgtccttctcccacaacgggctctcccgagttctctgtcatctgcacggccctgtgagcaggaggggaaacagagggctcacccctgyccccaaggcccagtgtgcaaatccattcatcacaacgaggttgtgtgagtctccccagtagcaagggctgctgaggaatggagccctcgtttccggggcc

SEQ ID NO: 1807 - DNA, 201 bp, Homo sapiens
aagaaatgttatcaagaaaatcatagggaagaggaaatacatttactatttattaagtggaactgggtcattgtaaaggtcttcatccttattatcttcaygttgagtaggctgagaaggaggaggaggagttggtcttgctgtctcaggggtggtagagatggaagaaaatccccatataagttcaagcctgtgttgctc

SEQ ID NO: 1808 - DNA, 201 bp, Homo sapiens
ttgtgctctgcccaccctccccaagcacagctgtgtttgacaagaaggtggtgctgaggaggagggccgtccagccccacggtcccacgggctgctgagaygtgcaccgtgtaatgctgagtcccactgcaaatgatgcccaagccacagaggtctgcagggaacctggcaatgcttgtgatttccctatggcccgctacc

SEQ ID NO: 1809 - DNA, 201 bp, Homo sapiens
ggccaagtgatgtaaccctcctctccagcctgtgcacaggcagcctgggaacagctccatccccacccctcagctataaatagggcatcgtgacccggccrggggaagaagctgccgttgttctgggtactacagcagaaggtaagccgggggccccctcagctccttctcggccttgtctctctcagatgtaactgagct

SEQ ID NO: 1810 - DNA, 201 bp, Homo sapiens
ctgagatcacatcatggcactccagtcttggtgacaaaagtgaaactccatctcaaaataataataataataataaacaatttctaagtattattcttagyagtcacctacgcatggcactttgtgcagatgactcctgcatgtgtcagggtttttcttgcgggcaatgcagtctgatcagtataaactaggcagagaggt

SEQ ID NO: 1811 - DNA, 201 bp, Homo sapiens
cgggagaagtagggagacatagaaggggcaggtgctggccaagaggcaggggcaggagaggagaaggcggaggggcactcagggcgagggtgtcaggcccrccaccccagagcaccattactcccaggacgcggctgcgtgcagacctggaaccagcctagggagcagccgcagatcacaactgagaacaaacgacagtct

SEQ ID NO: 1812 - DNA, 201 bp, Homo sapiens
tactgtattcttacaataaataagccagagaaaagaaatgttatcaagaaaatcatagggaagaggaaatacatttactatttattaagtggaactgggtmattgtaaaggtcttcatccttattatcttcatgttgagtaggctgagaaggaggaggaggagttggtcttgctgtctcaggggtggtagagatggaagaa

SEQ ID NO: 1813 - DNA, 201 bp, Homo sapiens
tacagcagtcagcaggggaggcgtctctgggggaagcagaggagcacagacctaaacaaagggagggagggagggagggagggaggaagccgggccggtcycgggagaggtaacagccaatcctgtggcagcgaggcacgttctggctcaccctgcaggggtggtgagttaactgggccggggcctgcagaggagtgaagg

SEQ ID NO: 1814 - DNA, 201 bp, Homo sapiens
ggcgctgaggctgaggtcttacacagagaggaggattgccaactggcaaagccctgcttttcaccaactgctcgaacggactggactgcctggctgctgayagggagggagagatccaccagatctattcagatgccatgaacagagaaaataacactgccttcaaacggggacccctaacagatcttgcttaagaatcta

SEQ ID NO: 1815 - DNA, 201 bp, Homo sapiens
cccttcaatcaagaagagtcagatgaaatgaattagcagggccagcccaagaacctcttctgggggtctcagggtagctttcatttgtagcagctgaggckgaagcccagctgcaaggcctttgagagaacgtggtgctggacccgtgtctagggcaggggttctaaaccctgcttacatatcagagtcacctgagaattt

SEQ ID NO: 1816 - DNA, 201 bp, Homo sapiens
atcgggggctgtctcgggacctctaggtttccctttagcaatgatgttctatttacatgacctcagcaggcagctagatgtgtcccactagagaggacctraggatctggggcctgatgggctccagggtaccgtctgcccagtgcttgctgtgctcctgagcatggggcgctggccctggtggtttccatgacaccaggt

SEQ ID NO: 1817 - DNA, 201 bp, Homo sapiens
aatgtggctttagcatggtttaggaccatatgtcacacagatctgatgacatttttttctagggttaccaggcagtgtggaaatgcacctgccctcatgcygggccccagagaggtaaacccactggcccagggctccctcttacctggaaatggaatatcccggcataaccagggccaaagctttggtcctgggggatga

SEQ ID NO: 1818 - DNA, 201 bp, Homo sapiens
tagggtcctcaggaacggagcagactggtacaggaacagagtcatcatggccaagagtccaccgggtcctcttgccatcaggaggaatagcagggcttgtrcaggaattggggctggagggaagggccgggctcggtcagtctccagctgggatccccagagtggtcaccctacccctccctcgagacagactgcctgact

SEQ ID NO: 1819 - DNA, 201 bp, Homo sapiens
tatgtcacacagatctgatgacatttttttctagggttaccaggcagtgtggaaatgcacctgccctcatgccgggccccagagaggtaaacccactggcycagggctccctcttacctggaaatggaatatcccggcataaccagggccaaagctttggtcctgggggatgactctggccagtgctttttgattaagcgt

SEQ ID NO: 1820 - DNA, 201 bp, Homo sapiens
gtgagccccacatcacaggcatgtctgactctagaggaacggaggtgcaggggcttgaggccactggactccattcagagggagtgaggaagcagaggccraagcagtgttgttcccccagccccgtgcctcttgggtcctcagggaccccatgctgcagttgcttgcctgtcccagtgactcaacctccctctcgccatg

SEQ ID NO: 1821 - DNA, 201 bp, Homo sapiens; identical to SEQ ID NO: 185

SEQ ID NO: 1822 - DNA, 201 bp, Homo sapiens
cagaggccgaagcagtgttgttcccccagccccgtgcctcttgggtcctcagggaccccatgctgcagttgcttgcctgtcccagtgactcaacctccctytcgccatgctccatccacttacactcacccagctctccctggcagatatcagtcctggtggcccctccaagaatgaattctgggtttttcacgatttcct

SEQ ID NO: 1823 - DNA, 201 bp, Homo sapiens; identical to SEQ ID NO: 189

SEQ ID NO: 1824 - DNA, 201 bp, Homo sapiens
gaggccgaagcagtgttgttcccccagccccgtgcctcttgggtcctcagggaccccatgctgcagttgcttgcctgtcccagtgactcaacctccctctygccatgctccatccacttacactcacccagctctccctggcagatatcagtcctggtggcccctccaagaatgaattctgggtttttcacgatttcctgg

SEQ ID NO: 1825 - DNA, 201 bp, Homo sapiens
gcgcctgcctgctgctgatccagcctcactatgcctctgacctggacaaggtggagggtctcactttccagcaaaactccctcaactggatgaagaaactrtctccccggtaggagcctcccggtctcccctggaatgtgggagccacactgtcctgcccaggctgggggcggggtggggagtagacacacctgagctgag

SEQ ID NO: 1826 - DNA, 201 bp, Homo sapiens
aaccagatgccccgggtccccaccgcagagcatcccaggcctgtacattattttctgcctccaaactgcaaagctttccacggtagactgggatgatgcamctcagttgcactgagcgtagccggcccctccccagcacccctgtttccacttcctgcgggggctgctgaacctcggcctcatctatgctccttcccctgc

SEQ ID NO: 1827 - DNA, 201 bp, Homo sapiens
gcctactcaacctgaagatgataagaatgaaggccttgatgatgatccacttccatttaatggagagtaaatatgttttctctttgttacgattttcttartaacattttattttctgtagcttactttgtgcacagtatataatatacacagtatttaatacctacgacataaaaatatgtgttaatcaacattagatta

SEQ ID NO: 1828 - DNA, 201 bp, Homo sapiens
tcaagacggacagtaactgttaccaactgagtcagcttttcccctaaagatggtatcgtgaagccaatacatgaaacccaaagcgagcctcaagcagtgcrgactttattcaatggccaaagaatggagaagcaggagcatggccgcaagtcaacttcttgtctagtgagaggtgagggggttaaaatatagggtatcctg

SEQ ID NO: 1829 - DNA, 201 bp, Homo sapiens
accaatgcacccactctgatccagctgtttcccttctagaaatttatctttatcctgatgatagagccgcaccccgaaaagtgaaaggtataccagcttgytcatttcatggtggcattgtttacattaaaaaaggttggaaagcacttagtgccctctgttgggggaatggtaaagaaaattatggtccagctaatcatg

SEQ ID NO: 1830 - DNA, 201 bp, Homo sapiens
ttctctgggggtcatcagacgggtgaaatttgagctgagatatgagtgatgaggagccgctgcacaaagatgctggatagagggaacagcaagatttgtgycttaggaagctttgagtttctgtgggttttgttgttgttgttgttgttattattttttttgagatggagtctcactctgtcacccagtttagagtgcagt

SEQ ID NO: 1831 - DNA, 201 bp, Homo sapiens
acaaataaacaaacaaacaacaaaaaataatgctttctgtacataaaccagcacataagtaatataatttcatgggatgatagtcactatagagaagatargggtggtgcagtggaataaggtgagatagggttggtgggcagggctcttctctgggggtcatcagacgggtgaaatttgagctgagatatgagtgatgag

SEQ ID NO: 1832 - DNA, 201 bp, Homo sapiens
cagccctaccctgctcttggtgggcacagagagttgtgagacctacctctggccagacactgttctatgtgtggaaatattgcaatgaagaagatcaaccmtccaaatgctcactgtggccaggctcggtggctcatgcgtatcattccaactctttgggaggccatggtggaatgattgcttgaggcccagaatttgaga

SEQ ID NO: 1833 - DNA, 201 bp, Homo sapiens
cgggtttgtggaagcaaagccacttgcaaagtctggcacatggaggggatcaggagctgctgattcctccctttcccctatcctctctgcaccccctgccmctcccacagatgctgctgaatttcatggtctccttctgagcctgacttgcctcaacttgcaaggcatctcttttgtctctttgtttgcacaatgaaggac

SEQ ID NO: 1834 - DNA, 201 bp, Homo sapiens
gaaacactgagtttcagagctgatagtaatgctgtatcatttcaatcagaaaggaattttgcaaaaaggaactgacttttttgtttgtttgtttttgagayggagtttagatcttgttgcccacgctggagtgcaatggcgcaatctcggctcactgcaacctctgcctcccaggtttaagtgattctcctgcctcagcct

SEQ ID NO: 1835 - DNA, 201 bp, Homo sapiens
accctgtctccaaaaaaaagtaaataataataaaaaaaagagtggggctattggttagtggaaggaagaccggagaggtaaagctcccctctcatctcatsatatcaagagtacctgccgtccacatgccttaccacagctgatgctggccttgatcacctggctaaggtagtgttagtcaggtgtctccactggaaagtt

SEQ ID NO: 1836 - DNA, 201 bp, Homo sapiens
tcttcacaaaaatgttatatacatttgaaagagaggagaaagtgcttataattacaagttttctaaggtaaatgctctgagaataagagagggagggaaayctcttcccccattttcaaccgggagaattaagcctcttgtttttaagttgcatttgtccttacagtggctactaggtgttgggaacactgcccgggagct

SEQ ID NO: 1837 - DNA, 201 bp, Homo sapiens
actattctaagaacctcgtaaaagtggaatcatatagcatttgtcttgttgtgactggtttatgttacttagcataatgtcttcaaggtccatccatgatrtagcatatgtcagaatgtcctttctattttgcttgaataatattccatcgtatggatatgtcatattttgtctttctatttatctgttggtggacacttg

SEQ ID NO: 1838 - DNA, 201 bp, Homo sapiens
aaaaaaaccagccagttatatttaccagctattaattaaatttttcactggaagcagtcttgccttgtacatagggatgaaacacacacacacacacacamatacacacaccatatatatatttataaatgcatatataaaaattatggtaaaatacatgtaacataaaatttacaaccttaaccatttctaagtgctcag

SEQ ID NO: 1839 - DNA, 201 bp, Homo sapiens
tgggactatagtcatacccagctaattaaaaaaaaaaaaaaacctgtagaggagggagtctcagtatgttgcccacactggtcttgaactcctagcttcawatgattctcctgccttggcctcccaaagtgctggggttacagatgtgagccactgcacctggccttattatgtttaattggagggaacattgataaagtc

SEQ ID NO: 1840 - DNA, 201 bp, Homo sapiens
agttgagcagcccatactgctgctctacctacggagtggccattctttctttacgtctttataaacttgctttcgatctatagactcgtcctgaattcttycttgcgtgaggtccaagaaccctctcctggggtctggatcaggacccctttccagtaacaggtccacttttccccaaataagtgatcttcctcctccttc

SEQ ID NO: 1841 - DNA, 201 bp, Homo sapiens
aatgataaatatacctgtctgccttctgctaactctctgggatttctttccctggagtttgacctcagcccaagacgatttcctttctccttctcatctasgagctggaggttgatgctatgcacagatcttaggatgacttgaatcacaggtgcagcaggataggaatttactctccgcagtttagggcccaaaaaaatc

SEQ ID NO: 1842 - DNA, 201 bp, Homo sapiens
agaggagcacagacctaaacaaagggagggagggagggagggagggaggaagccgggccggtctcgggagaggtaacagccaatcctgtggcagcgaggcmcgttctggctcaccctgcaggggtggtgagttaactgggccggggcctgcagaggagtgaaggatttttcccacctcttcccacttttccaggcaccagg

SEQ ID NO: 1843 - DNA, 201 bp, Homo sapiens
aattgaacctttcctcaaacacaaggcacaaacctgccccagcccatcatcctcccacagaggcactgtgaatgtataaagaaaggcgatgctaagaaacrtgctgcaggggaggctggcacattctgctccttagctaaccgcacaggcccatgggtccacacacatcagaccatggctctctgtggtctatctttgcca

SEQ ID NO: 1844 - DNA, 201 bp, Homo sapiens
taaaaagtttctaccaatgttcacagtggtttaaaatgagggccctggtgtcaggaagtgagtcctgggtctgaaccctggtgccaccactccaagggccrtgaccttaagaatcaccaactgggctcagaggcccacctcctgggcagcagagagaagacctgccatctgctcaggttgcccacaggcagtacctggcat

SEQ ID NO: 1845 - DNA, 201 bp, Homo sapiens
caggttgcccacaggcagtacctggcatgcagtcagccacctgtactccagtcttttctttacctgcagctttcagtgcagtccgtagttcataggtagayatggtgccggacttgtcagcatcaaaccgaaggaaaaggttctaaagggtggagagcagaagccttgagaaggagcgtgcctgaaaggcatcgctgatgg

SEQ ID NO: 1846 - DNA, 201 bp, Homo sapiens
tgtccctcacatagtattgcaaatgacatgaaggatttttattgtaggttttgctgaaattttccccaagggggaggatgacttagttgggtgatgggggkagcaaacatccctgtcgtcagggttgggtgcaaggagcataagcctgcctggcctctgggagagccctcactgtgtggcctggagccttcctaactgtgc

SEQ ID NO: 1847 - DNA, 201 bp, Homo sapiens
ttggagccattatcctaagtggctcacacccagataattggcctgacaggctggccatgcggtgccttcaaccctactcacatgtcaccagcagcacagcraagtcagggagtcgggatggcgcctgcccctcccatcacccatggaggctgcatgagtggaagacaaattttattccagccttggctctcagtcactttc

SEQ ID NO: 1848 - DNA, 201 bp, Homo sapiens
gccgcagaggccacagttggactgggccttccaaaagaagtcggtctcccttttgtcttccttttcgtcttgggtggaagcacggtggtactcccgtaagyatcggaatagcatgatgctgttttcccttctcccctgtccgaatacaattcctctagcctatagcctgcagcctgctgcaccattttaaatcccctctgc

SEQ ID NO: 1849 - DNA, 201 bp, Homo sapiens
caggtataaatattgaaacctccttagcgaaaattataacggtgagcaaattatgacagcggaggagatctgacctaaccatctccttcttgccttttaayctctaaactgtcctgggtcattttggggcatgggtcaagctaactttaggagaaatttagtttatagtttaaatgatgatagaccttcccaaaactaagt

SEQ ID NO: 1850 - DNA, 201 bp, Homo sapiens
cctacaaatcagccctgggaagcagatctgcggctcggaggagcagggaggggacccaggcagtgtggtcgcttgtccctccataggtgccccaggacccygatggggttggcacttactcttttgcagcacagcatttaaaacatactcaagttcctctgctgtcacctccatgtcctgttgaagtggagacaattgttt

SEQ ID NO: 1851 - DNA, 201 bp, Homo sapiens
gtcaggcgtggtgggggtgcctgtaatcccagctacttgggaggctgaggcaggagaattgcttgaacccgggagtcagaggctgcagtgagccgagatcsagccacggcactccagcctgggcgaggagcgagactccatctcaaaaagaaaaagtaaaacacccccctacttgctgaagggagtgtaaattggtgtctc

SEQ ID NO: 1852 - DNA, 201 bp, Homo sapiens
caaactcctggcctcaagtgatcctcccgccttggattcccaaggtattgaggttacagacacatgccaccctgctcagtgtttctttttacagagatgcrcttaggtaaaatttcatgtatctataccatataaagagagatatgcacacatctctcatattgtttcaccgaagtgcattatatatatatattattctat

SEQ ID NO: 1853 - DNA, 201 bp, Homo sapiens
tttctcttcttcttgttcatcttgaagggcagcaggaggtgaacatagtgcctgggtggctctgggatgccatggggcaaaaccccaaggacaaatgctcrgaagcttcacatgggtgcagggagatgacctctaggaccccacccggtccaggccttacagcagggcctgggttttgagggatatgccaaacagcctgga

SEQ ID NO: 1854 - DNA, 201 bp, Homo sapiens
tgcctcaagaaagcagatggcattcttgggtgtcttcatttagttttccaaaccttcacttctcaggatgaacaatagttacagaaactgcagccatgcartctaaggtctaccaggccttgcacacttcctcacccacactgggaaatgccctgagtggctcagagggaaagggctctgagcttgggcagagaatcatgt

SEQ ID NO: 1855 - DNA, 201 bp, Homo sapiens
ctgctgattcctccctttcccctatcctctctgcaccccctgcccctcccacagatgctgctgaatttcatggtctccttctgagcctgacttgcctcaamttgcaaggcatctcttttgtctctttgtttgcacaatgaaggactttggaactggggtcctctggctgggaccagagtgcagttctggccagtccaaatg

SEQ ID NO: 1856 - DNA, 201 bp, Homo sapiens
ggtgatcttgggcgagttatccatgctgtctgtccctgcttccaagctgtgaatcaggataatcggtgctgcctgctagaggcatggcgggtttgtggaarcaaagccacttgcaaagtctggcacatggaggggatcaggagctgctgattcctccctttcccctatcctctctgcaccccctgcccctcccacagatgc

SEQ ID NO: 1857 - DNA, 201 bp, Homo sapiens
gaaatgataaatactggaggggatagatagcctaaataccccaactcgatatcacacattctgcacatgtaacaaaatagcacatgtaccccatcaatacrtacaaatattatgtatcaataaaaataagtcaataaaagtattagtcaccacgtgaaaactctgatgttctaagcactttataatgatttctgtgtgatt

SEQ ID NO: 1858 - DNA, 201 bp, Homo sapiens
tgaacctgggaggtggaggttgcagtgaactgaggtcgtgccactgccctctagcctgggtgacagagagagactctgtcaaaaaaaaaaaaaaaaaaaargaaaaaagagagagagagagaaagaaaagagagagagagaaggaaagaagaaaagaaatgataaatactggaggggatagatagcctaaataccccaact

SEQ ID NO: 1859 - DNA, 201 bp, Homo sapiens
ccatagagtctcgctgactttacaggaagctttgtttgggggaacttaacactgggtggtgtctgagccccaagttcattcctacaccagcctcccctcgygttctatgtctcaggtcacttccagctgtggccctagaaagtttcttggaggggatgctgctgcccacggagaatgatactctgccagggcccattccta

SEQ ID NO: 1860 - DNA, 201 bp, Homo sapiens
gataaatgtgtttgcccatagaaatgattatacaggctgggtgtggtggctcacacctgtaatcccagcactttgggaggccgaggagggttgatcacccraggtcaggagatcaagaccagtctggccaacatcatgaaaccctgtctctactaaaaatacaaaaaattagcccggtgtggtggcggatgcttgtaatcc

SEQ ID NO: 1861 - DNA, 201 bp, Homo sapiens
caaaggcaggtgggggttagatttcatccaacctgacccctgatagaggagaactcacagaggacatcggctcttcctctagggcacatgtgcctctttcrttctctagacatcatattaataaagttccttgttgttatagtcctacaaataggatctcacgtctgagaaaaaacaaatgttagaggatggaggtggttt

SEQ ID NO: 1862 - DNA, 201 bp, Homo sapiens
tctcatgtcaaatcccagcgtcttttgggaggcagcttcccttttttagtttagtttgttggaagaaaagaattgtccctttcccccctctaaactaaaarccttgccagcccaggtgggcagcaccgaggtccctgcagggaacgtgcaaggggaaccctgcagtttcccgctcacatgcccttccgagactgagtgctc

SEQ ID NO: 1863 - DNA, 201 bp, Homo sapiens
ttcagcactggggtcagcaaaccttttctgtaaaggcccagaccatgaatattttcagctttgtgggccacgcaaagtctgtgctgcaactactcaacttwgctgttgtagtgacaaagcagccgtagatgtgacacagatgaatgggtgtggctgtgttccaataaaactttatttacaaaggcaggtgggggttagatt

SEQ ID NO: 1864 - DNA, 201 bp, Homo sapiens
gcagagggaagacggcagccactctcatgtcaaatcccagcgtcttttgggaggcagcttcccttttttagtttagtttgttggaagaaaagaattgtccytttcccccctctaaactaaaagccttgccagcccaggtgggcagcaccgaggtccctgcagggaacgtgcaaggggaaccctgcagtttcccgctcacat

SEQ ID NO: 1865 - DNA, 201 bp, Homo sapiens
ctccctcacataggacccgagatggtcctggctgtgtatacttcatccttttatcaggcctgagcctggacatgtttccagattttgctttccctgggagrgaaccactttaaaaggttcaggaggcccctatctgtgaggtgtgcttggtgagaagcgcaggcagcccggcaggcgggaggtctgcagagcgctcgtgga

SEQ ID NO: 1866 - DNA, 201 bp, Homo sapiens
agcaaacatccctgtcgtcagggttgggtgcaaggagcataagcctgcctggcctctgggagagccctcactgtgtggcctggagccttcctaactgtgcrtcatctccccaggaccatccacctgaccatgccccaactggtgctgcaaggatcttatgacctgcaggacctgctcgcccaggctgagctgcccgccatt

SEQ ID NO: 1867 - DNA, 201 bp, Homo sapiens; identical to SEQ ID NO: 183

SEQ ID NO: 1868 - DNA, 201 bp, Homo sapiens
gatggggttggcacttactcttttgcagcacagcatttaaaacatactcaagttcctctgctgtcacctccatgtcctgttgaagtggagacaattgtttkttatagcccttggcaccttcttttatagtttatttttgttttaaatcagttctgagcttcatttggctccagtgacagaccagccttcaggaccctgctg

SEQ ID NO: 1869 - DNA, 201 bp, Homo sapiens; identical to SEQ ID NO: 184

SEQ ID NO: 1870 - DNA, 201 bp, Homo sapiens; identical to SEQ ID NO: 188

SEQ ID NO: 1871 - DNA, 201 bp, Homo sapiens; identical to SEQ ID NO: 190

SEQ ID NO: 1872 - DNA, 201 bp, Homo sapiens; identical to SEQ ID NO: 194

SEQ ID NO: 1873 - DNA, 201 bp, Homo sapiens
gctccagtgacagaccagccttcaggaccctgctgtgggcagatgtacctatctcctgtgtagctgcagctatgtgtctcatatgtcacatgttttagggrcatgccagcccaactaggagagagcctaacttgagagacatcccaacccaggaaagcgcatgaaaagctgggcagggcaaggcagtggtttcccagcttc

SEQ ID NO: 1874 - DNA, 201 bp, Homo sapiens
tggtcttactttgcaacaagctccatcatgcctcaggatgacgttgctgaccaaccccacgactgcaaccctttgctaggaagcaggtccaggccctcagsctggtggggagatggaagtggggcatgtcctacctcaccagcgacttgttcaaacagagcccgaaaccgctgctcctcctctgtctcctggtcaggtgga

SEQ ID NO: 1875 - DNA, 201 bp, Homo sapiens
ggaagctgttcctctgactcaccgggtaatggcttttttctctgaaaagattctcagacagaaatcagcttcctggtggggctcaaaagtgctgggaatcmggatgtactccccagggggcagcttgaaccggtcggagacttctctcaggttgatgaacgtcttgcttctggcccgagaagcgtggtatctgaagaagtc

SEQ ID NO: 1876 - DNA, 201 bp, Homo sapiens
gcctatcacctgctgacaagacccactctgactccaggtcctcagcctcggtgggagtcagacagcttggagccggggagcgggtacaaccagatgccccsggtccccaccgcagagcatcccaggcctgtacattattttctgcctccaaactgcaaagctttccacggtagactgggatgatgcacctcagttgcactg

SEQ ID NO: 1877 - DNA, 201 bp, Homo sapiens
ccacacacagggtgggggcctgtccttgtggataaggttttgattcgtgcctatcacctgctgacaagacccactctgactccaggtcctcagcctcggtrggagtcagacagcttggagccggggagcgggtacaaccagatgccccgggtccccaccgcagagcatcccaggcctgtacattattttctgcctccaaac

SEQ ID NO: 1878 - DNA, 201 bp, Homo sapiens
acccagtgaccagctggtgcctcttgggacgacacctccagactgtcagaggtggggcactgttcaccctgatctctgggaatggggggtgcatggttctygggagaagattcctgcttcccttgtattccatctgtcacccggttgctgagaccttgctgagccaaacatccatccacactgagcaccctcagctctggg

SEQ ID NO: 1879 - DNA, 201 bp, Homo sapiens
cgggcactcaggatctcacttgtaggaccagcatcccttgtactgcccctccttgcccaaaagcaaccggaccccacaggagccactcccaggcccgtacmcacctggagggaatggaagccagcccagctggcgccgggtcagaggtagagccctgactaatccagcaccgcaaatattgacatggcgtcccaggcacaa

SEQ ID NO: 1880 - DNA, 201 bp, Homo sapiens
cattagccattattgttcccattttacaggtgaggagactgaggctcagggaaatgaagtgatatgactatatgcatgagacaaattgtcaggataagacrggcactcaggatctcacttgtaggaccagcatcccttgtactgcccctccttgcccaaaagcaaccggaccccacaggagccactcccaggcccgtaccc

SEQ ID NO: 1881 - DNA, 201 bp, Homo sapiens
taatcattgtaatgatgataataatagtatcagtaatagtaataatgtgacaatagctgtaatgtactggaaaccttctgtgtgctagacattggcctgcrttagccattattgttcccattttacaggtgaggagactgaggctcagggaaatgaagtgatatgactatatgcatgagacaaattgtcaggataagacgg

SEQ ID NO: 1882 - DNA, 201 bp, Homo sapiens; identical to SEQ ID NO: 175

SEQ ID NO: 1883 - DNA, 201 bp, Homo sapiens
cggctccctgcgactctatgctgcaaaaagagtctccatgctcatcctcagcccttttgttcctgattttacagaaatctgtaagatatgatgtaaagctyctaactcccctaaataagaaacagataggggtacgagaatgaggaccagaccaaagggacaatcttcagttgcagacaaaggaaaaggcagaacagattc

SEQ ID NO: 1884 - DNA, 201 bp, Homo sapiens
tggggcaaggctagctacagcagtcagcaggggaggcgtctctgggggaagcagaggagcacagacctaaacaaagggagggagggagggagggagggagraagccgggccggtctcgggagaggtaacagccaatcctgtggcagcgaggcacgttctggctcaccctgcaggggtggtgagttaactgggccggggcct

SEQ ID NO: 1885 - DNA, 201 bp, Homo sapiens
aggagggagattaaatttccctctaatctgggtgtatatgaggagtctgagacagatgaatttgatttgccaaaaatggagagagaaggctgggcgtggtrgctcatacctgtaattccagcactttgggaggccaaggtgggtggtttctctgaggtcaggggttcgagactagcctggccaacacggtgaaaccccatc

SEQ ID NO: 1886 - DNA, 201 bp, Homo sapiens
ataggtttagagacagaatcttgctgtgtcacccaggctggagtgcagtgacatgatcatagctcactacagccttgaccttctgggctcaagcaatcctyccacctcagcctcccaagtaactgggactacagacgtgagtcaccacgcccagccactttttaatttttttttttttttttgtggagatgggggtctcgc

SEQ ID NO: 1887 - DNA, 201 bp, Homo sapiens
acctttcagaaggaaaattggctaaatgtgaaaaaagcaataaaagtgggaatacgccttcatccatttattctagttctaagaaccccgagcaaagaatwacatatgaagatttttgtcatcatattatttatagtggcaaaaatttggaagtgaaataatgaccaatagagaggcatggtcaataccttaggctatgtc

SEQ ID NO: 1888 - DNA, 201 bp, Homo sapiens; identical to SEQ ID NO: 186

SEQ ID NO: 1889 - DNA, 201 bp, Homo sapiens
gggagggaaccactttaaaaggttcaggaggcccctatctgtgaggtgtgcttggtgagaagcgcaggcagcccggcaggcgggaggtctgcagagcgctygtggaaactacggttgtgtgtgcaggacatgggaccacagagatgccgacagccatccagcaccggacaagagtgggaaatgccacctggagcccagcct

SEQ ID NO: 1890 - DNA, 201 bp, Homo sapiens
agtcctccctttcctcctcatcccctgggcatccataacataaccctttcagaacttctgtttgtttaatcaggagtctgtctgagagctaaaccaatgcraacacagctcagtgtgaatttttgttaccaagctacagagctgattcttatactcaatatcatagcagattaaagaatcttgttcagagcaagattgagt

SEQ ID NO: 1891 - DNA, 201 bp, Homo sapiens
cgcgaacccagcttccctgatggaccgtcacctcccatttgtggatcgcgtcttcctccagggcatcgggagtgaggttgcagatctccactttatcaaaktgggccttgaagtcctgaaatgccatcctgcagcaaagcggagagacacgatgcacaggagggcaagagtgagggcatcatccattcactcattcattaa

SEQ ID NO: 1892 - DNA, 201 bp, Homo sapiens
gcagctaggcggtgggcctgggttagatgcctgggagtggtgtgtatgctgacggcccacatgcccacatgtgcaaggtgcctgtgacttgccttgttgtrtgtgcccaggtgtggtacacgtgtgtgcttgtgcatgctccacatgtatgctggttgcatgtgcacttgggagcattgtctacgtgtgagtgtcctgcat

SEQ ID NO: 1893 - DNA, 201 bp, Homo sapiens
cctcccttgacaggtggggattacaattcgagatgaaatttgggtggggacacagagctaaaccgtatcattctccaccggcccttcccaaatctcatgcyttttcagatttcaaaaccaatcatgccttcccaacagtcccccagaggcttaattcattccagcattaacccaaaagtccaagtccaaagtctcatctga

SEQ ID NO: 1894 - DNA, 201 bp, Homo sapiens
tccgtggtggctggaaagggagtgaaggtggggggcagctgctcagttctggggtcctggcttggcttgcctgtgcggacccctctcatctgtaggaagcrcactgctcttcttcctcctccaccttggctagcgcaggagtttgcaggtggctctgagctgagcccagaaggacaatgcaaaccaggaccatgtcagtgg

SEQ ID NO: 1895 - DNA, 201 bp, Homo sapiens
gtcaggagaaggtgacactgtctggggtggaaggtcaaggaatgcctactcggtgcctggctctgtgccggctcctgtgtgtgatgccatttagctctacrggaagcctgcagggaactgtcagtctctccttttttcagacgagtgtagaaaggtttaatgtcactaagaaaattgtctgaggtcacccacctaagtaag

SEQ ID NO: 1896 - DNA, 201 bp, Homo sapiens
aaacgggctggccctgagtggtggcctgtgagtcaggagaaggtgacactgtctggggtggaaggtcaaggaatgcctactcggtgcctggctctgtgccrgctcctgtgtgtgatgccatttagctctacgggaagcctgcagggaactgtcagtctctccttttttcagacgagtgtagaaaggtttaatgtcactaag

SEQ ID NO: 1897 - DNA, 201 bp, Homo sapiens
cctgagctacatgtgacctgctcactctctttgcctttgaaacacttctgtgctattggtgacagggcttgagagtacctctgcttatcagattgcaggcytcagggacagaagaaacgggctggccctgagtggtggcctgtgagtcaggagaaggtgacactgtctggggtggaaggtcaaggaatgcctactcggtgc

SEQ ID NO: 1898 - DNA, 201 bp, Homo sapiens
acaaagactagtgtagagactcctgtcgggaggctgcctgagctggggaagctgtcactcacttggcgtaggctttttccagcaaggcgctccagaactcrttgtggtcggcagagtggaggaaaaccaagcggtccctgaaggtgggcaggcggtcatcgatcaccacgtccagccactcactgtgctgccagaactgtt

SEQ ID NO: 1899 - DNA, 201 bp, Homo sapiens
tcctgccgagcctcacctgcaaacccagagccctgattttttcccagcccttagatgctcactacaaagactagtgtagagactcctgtcgggaggctgcytgagctggggaagctgtcactcacttggcgtaggctttttccagcaaggcgctccagaactcgttgtggtcggcagagtggaggaaaaccaagcggtccc

SEQ ID NO: 1900 - DNA, 201 bp, Homo sapiens
aaagttagagtgctgttgtaaaagtctttcttgagaatcaaccttgatgcaaggtgggcctgagggctgaaaggggaggaagaaggggcacctcagaatcrggacaggatcctgagtcagagcccgggaggatagtagacaggccactccttcacatgtctgcacaagccagctctggccccacacgccccgggaaccagc

SEQ ID NO: 1901 - DNA, 201 bp, Homo sapiens
ggaggaagaaggggcacctcagaatcgggacaggatcctgagtcagagcccgggaggatagtagacaggccactccttcacatgtctgcacaagccagctytggccccacacgccccgggaaccagccagagaggcaggatagggtgactgacctgtcgctccacgacccgttccactcaacctggccccaagggttccgg

SEQ ID NO: 1902 - DNA, 201 bp, Homo sapiens
ggggtttcaccatgttgaccaggctggtcttgaactcctgacctaggtgatccgcctgtctcggcctcccaaagtgctgggattacaggcgtgagccaccrcacccggcctatgattccttttatataaaatattcagaatatgtaaatagaatctatagagaaagtagatgagtggttgcctggggctgggggaaatggg

SEQ ID NO: 1903 - DNA, 201 bp, Homo sapiens
tgcatactcaagtcccacagtaagccctgtggaatctgcctataccaagtcagccctctgtatatgcgggtttcaaatcctggaatagtatattttctccyttccttccttccttccttccttccttccttccttccttccttccttccttccttccatcctccctccctcccttcctccctctctcccttccttctttcc

SEQ ID NO: 1904 - DNA, 201 bp, Homo sapiens
agcacgggctgggcgagcagacatttcatagctgccacccaagtggttcggcagtacttgggagggtggttagaaatctccctgcagccccaacccagacwcagcttaattacagataatggtatctccgtggtggctccatttgctttaaattatcttgcattttcaagatttattgactgacctactgaacttcccagc

SEQ ID NO: 1905 - DNA, 201 bp, Homo sapiens
ttgccaaaacatcacttatagttttaaatgtatgctccataaggattcaccgtgcaatgccgttaatgttcttctgaggcatttagctgttattccatgataaaatgtggctttagcatggtttaggaccatatgtcacacagatctgatgacatttttttctagggttaccaggcagtgtggaaatgcacctgccctcat

SEQ ID NO: 1906 - DNA, 201 bp, Homo sapiens
catgacaggtatgtgcactgtttgtggtttatttatacattgcatgtgtgaaagcatgtgtttgctcacatgtgtgcatgtgtgtgcatgtatgtgtgcaygcatgtgtttgcaagtgcttctacacacgtgtgtgtttgagcacatgtatgcatgtgtatgagcttgtgtgtggtctgctgggaacaggaagggaggttg

SEQ ID NO: 1907 - DNA, 201 bp, Homo sapiens
tggttaaaacttgtgttttatttatttatttttattttattttattttattttttatttatttatttatttatttatttatttatttatttatttattatwctttaagttttagggtacatgtgcacaacgtgcaggtttgttacatatgtatacctgtgccatgttggtgtgctgcacccattaactagtcatttagcac

SEQ ID NO: 1908 - DNA, 201 bp, Homo sapiens
cccgcccagggctgcgctcagccaccttcctgctgtgctttaagcagtcacatgagcccccattttctccatccgatcctgtggtcccctaatctccctgycttgcctgtttattgcagtgcctaatatactaccatcagacagcccctaggtttagatatcacccctccaggtgacccctttcataattcaggaacccca

SEQ ID NO: 1909 - DNA, 201 bp, Homo sapiens
ttggttaaaacttgtgttttatttatttatttttattttattttattttattttttatttatttatttatttatttatttatttatttatttatttattatactttaagttttagggtacatgtgcacaacgtgcaggtttgttacatatgtatacctgtgccatgttggtgtgctgcacccattaactagtcatttagca

SEQ ID NO: 1910 - DNA, 201 bp, Homo sapiens
aagcatgatggcatgtgcctatagtcccggctactcaggaagctgaggtgataggatctcttgagcccatgagtttgaggctgcagtgagctaggcttatrccactgcactccagccagggtaaaagagtgagactctgtctaaagcaaaacagaactaaaaaacaaagcgtctgggcctattccaagcttctttgggctc

SEQ ID NO: 1911 - DNA, 201 bp, Homo sapiens
gcttggttaaaacttgtgttttatttatttatttttattttattttattttattttttatttatttatttatttatttatttatttatttatttatttattatactttaagttttagggtacatgtgcacaacgtgcaggtttgttacatatgtatacctgtgccatgttggtgtgctgcacccattaactagtcatttag

SEQ ID NO: 1912 - DNA, 201 bp, Homo sapiens
agtatctcagggcctcttgcgagtcctccagcccttggacgagggtaaagccacccccatgtcaccccttccacaccacataacataggggagatgtaatrtgttcccctgagtccacagtaaaaaacatctccctgcctctctggttttcttttcattgattagatttcttaaaatacaattaaaagtctacccacttca

SEQ ID NO: 1913 - DNA, 201 bp, Homo sapiens
catgcttggttaaaacttgtgttttatttatttatttttattttattttattttattttttatttatttatttatttatttatttatttatttatttatttattatactttaagttttagggtacatgtgcacaacgtgcaggtttgttacatatgtatacctgtgccatgttggtgtgctgcacccattaactagtcatt

SEQ ID NO: 1914 - DNA, 201 bp, Homo sapiens
tcccattgcagtgctttatccctaaataaatagcttttcttttagagagtgtctctgtgtttgttatttcagttgacagtagcacagaggaagatgacatsgaacagaactttataccaagcacccacctcactcccatgccaggtccttgtggactagaagagcacagactagaacacacacatcttggtctccaggagg

SEQ ID NO: 1915 - DNA, 201 bp, Homo sapiens
ccatgcttggttaaaacttgtgttttatttatttatttttattttattttattttattttttatttatttatttatttatttatttatttatttatttatttattatactttaagttttagggtacatgtgcacaacgtgcaggtttgttacatatgtatacctgtgccatgttggtgtgctgcacccattaactagtcat

SEQ ID NO: 1916 - DNA, 201 bp, Homo sapiens
actttggctgctgtcatgggttgttgagtacctgtggcttttccaggctcaaggtgcaagctgccagtggatccaccattcttgggtctggaggatgatgrccgccttcccacagttccactaggcagtaccccagtggggactctgtgcgagaccttgaacctcacatttccccatctgcatagccctagtagaagttct

SEQ ID NO: 1917 - DNA, 201 bp, Homo sapiens
gcgtctctgggggaagcagaggagcacagacctaaacaaagggagggagggagggagggagggaggaagccgggccggtctcgggagaggtaacagccaawcctgtggcagcgaggcacgttctggctcaccctgcaggggtggtgagttaactgggccggggcctgcagaggagtgaaggatttttcccacctcttccca

SEQ ID NO: 1918 - DNA, 201 bp, Homo sapiens; identical to SEQ ID NO: 192

SEQ ID NO: 1919 - DNA, 201 bp, Homo sapiens
tgcacacggcaaggattcaggagtttcctctcattgcaatgggcagccttggggagttttcctctgggaggaaatctcatggatttatactgaagaaatarctggctatgtgctgtgtgataacagatggaagggggctggaggggaagcagagaatcgggttgggaggcctgtgggaccgctagaagccacccctgcact

SEQ ID NO: 1920 - DNA, 201 bp, Homo sapiens
acaggccactccttcacatgtctgcacaagccagctctggccccacacgccccgggaaccagccagagaggcaggatagggtgactgacctgtcgctccaygacccgttccactcaacctggccccaagggttccggattcggatgagctcgattctctggcctcggaagcttacctagaagggaaaagcatgagggaagt

SEQ ID NO: 1921 - DNA, 201 bp, Homo sapiens
agcacagctggaaggcagaggacaaggaggtgcatggtccaaggctgtagagagaagggcagcagccaggtcgtgtaagtgactgcacacggcaaggattyaggagtttcctctcattgcaatgggcagccttggggagttttcctctgggaggaaatctcatggatttatactgaagaaataactggctatgtgctgtgt

SEQ ID NO: 1922 - DNA, 201 bp, Homo sapiens
ctgcagttggagttcaagtcgcctacctggtcaattcccgttacactgtaggcatgacccttaataagaccaaacggcgtccgggcctcagattctgcagyacttctggtctaaaacatggaaagagcagagtcacacccaccgtctaagtcaagcctcccctgctggatcagacccagctacatgcctggcccggtcaca

SEQ ID NO: 1923 - DNA, 201 bp, Homo sapiens
cccagctgtgagctctgtgacctctgtgggcttcaaggagctgagtaatgcatgtaccacaggctggggccttggactaaacatactccctacccacccakcttctccatttctttctttatataatccttcccccacaaagtggattccaaatatatataggtttagagacagaatcttgctgtgtcacccaggctggag

SEQ ID NO: 1924 - DNA, 201 bp, Homo sapiens
ggggcagcttgaaccggtcggagacttctctcaggttgatgaacgtcttgcttctggcccgagaagcgtggtatctgaagaagtctttgttcaggtgttcrtctttgtcagggcactgcaatgggcaagaaagggaggggtttcctagggaagttcctcttggcttttcggacacaattcatggactcttggttgagtctc

SEQ ID NO: 1925 - DNA, 201 bp, Homo sapiens
cctacctggtcaattcccgttacactgtaggcatgacccttaataagaccaaacggcgtccgggcctcagattctgcagcacttctggtctaaaacatggraagagcagagtcacacccaccgtctaagtcaagcctcccctgctggatcagacccagctacatgcctggcccggtcacaacctccagccccttctgctgc

SEQ ID NO: 1926 - DNA, 201 bp, Homo sapiens
tcaattcccgttacactgtaggcatgacccttaataagaccaaacggcgtccgggcctcagattctgcagcacttctggtctaaaacatggaaagagcagmgtcacacccaccgtctaagtcaagcctcccctgctggatcagacccagctacatgcctggcccggtcacaacctccagccccttctgctgccccaggtgc

SEQ ID NO: 1927 - DNA, 201 bp, Homo sapiens
ccaccatgcttggttaaaacttgtgttttatttatttatttttattttattttattttattttttatttatttatttatttatttatttatttatttatttatttattatactttaagttttagggtacatgtgcacaacgtgcaggtttgttacatatgtatacctgtgccatgttggtgtgctgcacccattaactagt

SEQ ID NO: 1928 - DNA, 201 bp, Homo sapiens
ctgtatccgagccccgaggtgagtctgcacctttgagggagctcccaggcagctgaggagagggctcagaagaggaagccactgtttcactcctcaaagckggggtccccagacccagtgggactgctgcccttggtgtgaatgcagcgtgagagtgtgaatctgtggtgcaggggcgagtgtgcgggggactctcaggcg

SEQ ID NO: 1929 - DNA, 201 bp, Homo sapiens
ggcagcgtagattggtgcttcagctcgtggatgacagagtcagggggcctggttctgagtcctagttctgtctcttcccagctgtgtgacgttgaacaagycactggacctctctgttcctctgcaaaacagcatgaaccaattcattaactacttctccaggatgcagtaggtcccagggactatcctaggaatgtgggc

SEQ ID NO: 1930 - DNA, 201 bp, Homo sapiens
gttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaattgggaaagaaaggaaatt

SEQ ID NO: 1931 - DNA, 201 bp, Homo sapiens
tgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaattgggaaagaaaggaaat

SEQ ID NO: 1932 - DNA, 201 bp, Homo sapiens
gttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaattgggaa

SEQ ID NO: 1933 - DNA, 201 bp, Homo sapiens; identical to SEQ ID NO: 177

SEQ ID NO: 1934 - DNA, 201 bp, Homo sapiens
agttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaattggga

SEQ ID NO: 1935 - DNA, 201 bp, Homo sapiens; identical to SEQ ID NO: 178

SEQ ID NO: 1936 - DNA, 201 bp, Homo sapiens
taagttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaattgg

SEQ ID NO: 1937 - DNA, 201 bp, Homo sapiens; identical to SEQ ID NO: 179

SEQ ID NO: 1938 - DNA, 201 bp, Homo sapiens
tataagttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaatt

SEQ ID NO: 1939 - DNA, 201 bp, Homo sapiens
atcctaagtggctcacacccagataattggcctgacaggctggccatgcggtgccttcaaccctactcacatgtcaccagcagcacagcgaagtcagggartcgggatggcgcctgcccctcccatcacccatggaggctgcatgagtggaagacaaattttattccagccttggctctcagtcactttcttgatttctac

SEQ ID NO: 1940 - DNA, 201 bp, Homo sapiens
gaaatgatagtgttggagtgctaaggggaatgattcagaagaaggggggaattcatacgtaaggggagagaagagagttgcaggaggtacatcctagagcyggtgaagaatggaaagaggctacacagggcttcagagtcaggattccaggaggaagggctccacgcacagagtgcatgatttaacaccacccatcacctt

SEQ ID NO: 1941 - DNA, 201 bp, Homo sapiens
acagggaatattgagacaatgaaagatctggttagatggcacttaaaggtcagttaataaccacctttcaccctttgcaaaatgatatttcagggtatgcrgaagcgagcaccccagtctgagatggctcctgccggtgtgagcctgagggccaccatcctctgcctcctggcctgggctggcctggctgcaggtgaccgg

SEQ ID NO: 1942 - DNA, 201 bp, Homo sapiens
atataagttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaat

SEQ ID NO: 1943 - DNA, 201 bp, Homo sapiens
gtggctcacacccagataattggcctgacaggctggccatgcggtgccttcaaccctactcacatgtcaccagcagcacagcgaagtcagggagtcgggayggcgcctgcccctcccatcacccatggaggctgcatgagtggaagacaaattttattccagccttggctctcagtcactttcttgatttctacctctgtg

SEQ ID NO: 1944 - DNA, 201 bp, Homo sapiens
gaggctacacagggcttcagagtcaggattccaggaggaagggctccacgcacagagtgcatgatttaacaccacccatcaccttgggcaggctcagcccwggtgttggggctgctccttcaagaggggcagggcaatggatcactcacatggacgctcttctttgtggagcttcctgctgtgaatttccgagtttcctct

SEQ ID NO: 1945 - DNA, 201 bp, Homo sapiens; identical to SEQ ID NO: 181

SEQ ID NO: 1946 - DNA, 201 bp, Homo sapiens
catataagttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaa

SEQ ID NO: 1947 - DNA, 201 bp, Homo sapiens
caacccatctcagctcatctctgccaatgcttcttggttctcagaaggcggcagccaaggccagagcagaggatggtgggacgagagcctccatggggacmatgacagcctggaaagcacaggcctgtgtgccctgccctcacgctggggtctggctaatacagcagcggctgcaccatgtctggtgacctggtagctgtg

SEQ ID NO: 1948 - DNA, 201 bp, Homo sapiens; identical to SEQ ID NO: 182

SEQ ID NO: 1949 - DNA, 201 bp, Homo sapiens
gtgtcagcacgggctgggcgagcagacatttcatagctgccacccaagtggttcggcagtacttgggagggtggttagaaatctccctgcagccccaaccragactcagcttaattacagataatggtatctccgtggtggctccatttgctttaaattatcttgcattttcaagatttattgactgacctactgaacttc

SEQ ID NO: 1950 - DNA, 201 bp, Homo sapiens
caagggtgcttctgggtgacatgaaatttaagttgattgagtaaaacagattgccctccccagtgtaggtgggcctcatctcatctgtgaagacctgaccwgaacaaaaaggcagaggaagggggaattcactctctcttcctgggtgcctgagctgggacatccgtctctcctgccctcagactgggacttttaccattg

SEQ ID NO: 1951 - DNA, 201 bp, Homo sapiens
caagttctagactagcttcagatttccccagaagctcaggggccatggatgtggcaggaaagggcttcaggagcccaacaagcagcggacgagcaacagcytcaggcaggccctgccacgcacccacacaaacatccctggttcttagtcacctggtccacttcccaagggaccagagctggaggagctgtggggacacac

SEQ ID NO: 1952 - DNA, 201 bp, Homo sapiens
gtgccggtcaagaaggaacagctcagagggccactgggctgagtggccctcacctccacctattttctgggcacctccctgttagactgagatgggacacrccctgatggaaaacagcagagagagccctctgcccactctgcactcctgcagactcagaggcagctctggggcctggcacattccactcagaggcggcac

SEQ ID NO: 1953 - DNA, 201 bp, Homo sapiens
gcagaaataagcaattggcttgcttaaatccctttcatgttaggaggggcattactgaaaaccctctactacaaagattgttgatttttttttttttttttattgagacagggtcttgttctgtcacccaggctgcagtgtagtggtgccatcattgctcactgtagccttgaactcctggcctcaagcgatcctcccacc

SEQ ID NO: 1954 - DNA, 201 bp, Homo sapiens
ctgactaatacatcatgctctgctgactccatatgtggctggtttcctggatccgattctgactgatggtatctgttctcacactgctaataaagacataycagagactgggtaatttataaagaaaaagaggtttaatggacttatgtgttccacgtggctggggaggcctcacaatcatggtggaaggtgaaggaggag

SEQ ID NO: 1955 - DNA, 201 bp, Homo sapiens
catggtagtttctctgtgtatcctgcagtgacccacctcctacccgttccttctggttcagttggcctgagagcgatcctaaggtaacctctaagagtaaraagaaaagggttgaaagaggagggtaggcacagtggttttgggagccatttatttacagctttgctgtgtcatcctgagcatcttgctgcatcagtgatt

SEQ ID NO: 1956 - DNA, 201 bp, Homo sapiens
ccatttgcaatttgtacagcataaacacagaacagcacatctttcaatgcctgcatcctgaaggcattttgtttgtgtctttcaatctggctgtgctattsttggtgtttaacagtctccccagctacactggaaacttccagaaggcacttttcacttgcttgtgtgttttccccagtgtctattagaggcctttgcaca

SEQ ID NO: 1957 - DNA, 201 bp, Homo sapiens
ttgtgtctttcaatctggctgtgctattgttggtgtttaacagtctccccagctacactggaaacttccagaaggcacttttcacttgcttgtgtgttttycccagtgtctattagaggcctttgcacagggtaggctctttggagcagctgaaggtcacacatcccatgagcgggcagcagggtcagaagtggcccccgt

SEQ ID NO: 1958 - DNA, 201 bp, Homo sapiens
gacctgggtgggacagagggcaagcgtgggcatctttggttcttatttgatggctttaattctgtcctgctgatttcaggattaatttaaccacagtatgmctcccctctattttgccacttttatgtcccacttggaggtagaagcaagaccatccttgcttctgtctctggggatagtattctcatggcttgaagatcc

SEQ ID NO: 1959 - DNA, 201 bp, Homo sapiens
tggtacaggaacagagtcatcatggccaagagtccaccgggtcctcttgccatcaggaggaatagcagggcttgtgcaggaattggggctggagggaaggrccgggctcggtcagtctccagctgggatccccagagtggtcaccctacccctccctcgagacagactgcctgactgtgtgtcatcaggctggtcaccatc

SEQ ID NO: 1960 - DNA, 201 bp, Homo sapiens
tttacttctgagtcaagatttttagaaagtgagagtgtctttttcaatgttttattttattcttctcttctgctggctatgtgcagatgatgacgtgaccytagaagatggcagagccacacaatagaaggcgtttgggttcctgaatcactgtatgaacagagccacccacagaatatgaacatcctccctggactgtca

SEQ ID NO: 1961 - DNA, 201 bp, Homo sapiens
gcctgcctggcctctgggagagccctcactgtgtggcctggagccttcctaactgtgcatcatctccccaggaccatccacctgaccatgccccaactggygctgcaaggatcttatgacctgcaggacctgctcgcccaggctgagctgcccgccattctgcacaccgagctgaacctgcaaaaattgagcaatgaccgc

SEQ ID NO: 1962 - DNA, 201 bp, Homo sapiens
tggtcagtgaccatcagagagaatcctatagttacatgctaggtaatatttcagggattccgacactccaaatacacacacacacacaaacacacacgcayttatgcatatgcacactgcttactggagttactcacaactacagataaagcttttcaccatatcactgggttataaacatcaccatgggaggtaacacat

SEQ ID NO: 1963 - DNA, 201 bp, Homo sapiens
aagaaattagtccatatgaatctaaaaatgggtttctctctagacttggatctccctagaggcaggagccaagtcttaggcatcttcagcatctagcagartgaatggtaaagagtagtcctcaaaggtgctcatggaactattactgaactttcttcatcctagcatcccatgcacagatgaatgataagaaaataagca

SEQ ID NO: 1964 - DNA, 201 bp, Homo sapiens
ctagcctggccaacacggtgaaaccccatctctactaaagatacaaaatgagtcgggcgtggtggcgcatgcctgtactctcagctgcttgggaggctgargcaggagtatcacttgaacctgggaggcagaggttgcagtgagacgagatcgcaccactgcactccagcctgggcaataagaacaaaactccgtctcaaa

SEQ ID NO: 1965 - DNA, 201 bp, Homo sapiens
ctgaactttcttcatcctagcatcccatgcacagatgaatgataagaaaataagcacatgttggggatttaaacacaacaataaacaaaaacagcttttaygtcttctagacccaatattctccttatttcaggtgtctgtgaggattcctgctgttcacctcaatcacccttgagcctgtgtgccctcaggctctgcctg

SEQ ID NO: 1966 - DNA, 201 bp, Homo sapiens
gccaggctggtctcaaactcctgacttcaggtgatcctcctgcctcggcctcccaaagtgctgggattacaggcatgagccaccgtgcctggcctaaagaycaccttttgaagctgcatccctaactcctgcctctcatcacagatgtaaattcctgattccactggtggggttggggagggatgggtgtctctgtgctta

SEQ ID NO: 1967 - DNA, 201 bp, Homo sapiens
caaggaaaacttggaacttcaaggatccatcatgggatgcaggacagtaggctccacccctcttcctgctttccagtaaatgatgttcagggctcacatgyctcttccaaggcatgatgtggggttgcagttctgatcccagcagagaacaaggctcctgtgaaacaattagttttggctcagaggcaaaaaatggaaacc

SEQ ID NO: 1968 - DNA, 201 bp, Homo sapiens
tgtgtgccctcaggctctgcctgggagcagggacaagggccaatgcatttgagaagggttttagaggagagagagtgaaagtaaaagacttctagttatcractaaccagaaactgtagcagtcagaatgttttatcctcatgcatttggcataaattatattttggatgtgtaaaaattcaagtaacatcaactcttcgg

SEQ ID NO: 1969 - DNA, 201 bp, Homo sapiens
catatctgttggagaccattcagcctattgagtggtaggcactggggagggggtgcattttaaaagattacaaagttgaatcagaaccaaaaaaaccaccwttttttttagacggagtctcactctgtggcacaggctggagtgcaatggcatgatctcggctcactgcaacctctgcctcctgggttttaagtgattctc

SEQ ID NO: 1970 - DNA, 201 bp, Homo sapiens
aaaaaagaaagaacaggctgagaatggtggcttatgcctgtaatcccaacactttgggaagttgaggtaggaggatcacttgagaccagtagttcaagatmagcctgggcaacatagcaagaccctatctctacaaaaaataaaaataaaaaaattagccagatatggtagcatgcacctgtagtcctagttactctggag

SEQ ID NO: 1971 - DNA, 201 bp, Homo sapiens
cgactaaccagaaactgtagcagtcagaatgttttatcctcatgcatttggcataaattatattttggatgtgtaaaaattcaagtaacatcaactcttcrgagtccaagatgtggcttgtggctcaccattaaaggggctcatttaatttgaaaggttcagggcaggtgagttccttgtaggggggagaggaagcaaaat

SEQ ID NO: 1972 - DNA, 201 bp, Homo sapiens
tcacttccacattttcagttatctttataacaatgccccactcttctgtaccaattttctgtattaggctgttcttgtactgctataaagaaatacctaasactaatttacaaagaaaagaggttcaattggctttacaaagaagcatggtgtattccctagaagttaacttaactccttgacttctagggagacctagga

SEQ ID NO: 1973 - DNA, 201 bp, Homo sapiens
ctcgaaaaagctttttctttctctgctatatagccaggctgcaaattttccaaatttttatgccctgcttcccttttaaatgtatatattccagctttaastcatatctttgctcccatatctgagtataggttgttagaagcagccaggtcacatcctgaatgctttgctgcttagacatttcttcttccagatacccta

SEQ ID NO: 1974 - DNA, 201 bp, Homo sapiens
taggggggagaggaagcaaaatcaagcaaaccaagatgatgagaggtttctgttgttacgtggaatacgtagaagatctaacctagaaacatcacatgccygcttgagtgagcaatctgcaagtcatctatggatggtgaaggaggacaaaggagccaacacaaatagctaacattctaaagaatcccaaagagtccaacg

SEQ ID NO: 1975 - DNA, 201 bp, Homo sapiens
atatacgatgaacaagtctagagatccagcgtacaacatgaggactatacttaaaaatgtcacattgcacttgggatttttgctaaaagagtagactttaygtgtccttgccacctaaatgagtaactgtgagatgatggatatgttaattttcttgactaccataatcattttactatcttcatatcaaaatatcatgct

SEQ ID NO: 1976 - DNA, 201 bp, Homo sapiens
agtaccccagtggggactctgtgcgagaccttgaacctcacatttccccatctgcatagccctagtagaagttctctgtgagggctctgtccctgcagcargcttttgcctaggcatgcaggcttttccatacatcctctgaaatctaggtggaggctgccaagcctcattcagtcttgcactctgtgtgcctgcaggctt

SEQ ID NO: 1977 - DNA, 201 bp, Homo sapiens
ggggttggggtgccaaccctcctgcattgtcaaaaaatcttgtattccctaaagctgaactccgaatagcctaccattgaccagaagtcttatcgataacrtaaagaaccaattaacatgttttataattatttatattatatactgtattcttacaataaataagccagagaaaagaaatgttatcaagaaaatcatagg

SEQ ID NO: 1978 - DNA, 201 bp, Homo sapiens
aacatggatgactggaagacattatgctaaatgaaacaaggcagatacagaaaggaaaatactgcatgacctcatttatatgtggaatcttttttttttttaaagtgaatatacagagatagagaatacaacagtggttaccaggagttgaggaggagagcagggaggagatgtaggtcaaatgatacaaagcagcagata

SEQ ID NO: 1979 - DNA, 201 bp, Homo sapiens
tgtcctacatccagggaacactggtacaaagggtgggatcccaaggccttgggaagctctgtccctgtgactttggctgctgtcatgggttgttgagtacctgtggcttttccaggctcaaggtgcaagctgccagtggatccaccattcttgggtctggaggatgatggccgccttcccacagttccactaggcagtacc

SEQ ID NO: 1980 - DNA, 201 bp, Homo sapiens
caacatggatgactggaagacattatgctaaatgaaacaaggcagatacagaaaggaaaatactgcatgacctcatttatatgtggaatcttttttttttttaaagtgaatatacagagatagagaatacaacagtggttaccaggagttgaggaggagagcagggaggagatgtaggtcaaatgatacaaagcagcagat

SEQ ID NO: 1981 - DNA, 201 bp, Homo sapiens
gtccttctcacactgcaaaatataattatgccttcccaataacccccaaagtcttaagtcattccagcattaactcaaaattccaaagtccaaagtctcayctgagataaggcaagtcccatcacctatgagcctgtcaaatcaaaatcaagttccaagatatacaaattccattttatacttccaaaatacaatgggagt

SEQ ID NO: 1982 - DNA, 201 bp, Homo sapiens
aaaagccctcaacagatttctgtttgtctcattggtcagaactatcttacttgaccactaatggttacagaggagagcagtgatgcaggatttttctcggyccctttgccagtcagggacctcttgctggtgatgctggaggccttgcttggggcacactacctgtccctggaggtgcctcacccaatcggcccccctggg

SEQ ID NO: 1983 - DNA, 201 bp, Homo sapiens
ctcccaaagtgctgggattacaggcgtgagccaccgcacccggcctatgattccttttatataaaatattcagaatatgtaaatagaatctatagagaaartagatgagtggttgcctggggctgggggaaatgggtacagggttaacactgttaatgggtaaagggtttcttgttggagtgatgaaacattctaacatta

SEQ ID NO: 1984 - DNA, 201 bp, Homo sapiens
attctttgcttgctggcttttggtccttacacttgttgcctcatggttgcaaaatggctgttttgtctccagacattacatcaacatttgaaggaggaagmagggttagtgtctgagccactgactctgctgataaaaggacagagaaagctctcccaaaagccctcaacagatttctgtttgtctcattggtcagaacta

SEQ ID NO: 1985 - DNA, 201 bp, Homo sapiens
ccgaaaagtgaaaggtataccagcttgctcatttcatggtggcattgtttacattaaaaaaggttggaaagcacttagtgccctctgttgggggaatggtraagaaaattatggtccagctaatcatgaagtggaacagtgtacagccataaaacggaacaaggaaactctgcatacactgatgtgggaaggtccctggga

SEQ ID NO: 1986 - DNA, 201 bp, Homo sapiens
ttctatcattctttgcttgctggcttttggtccttacacttgttgcctcatggttgcaaaatggctgttttgtctccagacattacatcaacatttgaagraggaagaagggttagtgtctgagccactgactctgctgataaaaggacagagaaagctctcccaaaagccctcaacagatttctgtttgtctcattggtc

SEQ ID NO: 1987 - DNA, 201 bp, Homo sapiens
catttcctagaagatgagaactagatcttcacccagaccttgcttccctatccatcccctcccaaggtcattggtaagcctgacatcaggtgagggtctcmctttcttcatccagggacttgtccatccctggaacactcctagtttcacccctgtcctagtgggcactcattcatgaaccataacaaatcttttcttcag

SEQ ID NO: 1988 - DNA, 201 bp, Homo sapiens
atgctttgcttcctttttaaacataagttcctatttcagatcatttctctcaagttcaaagttccccagatcctaaaggcaggggtaaaatgctgccagtytctttgctaaagcatagcaagagtgacatttgctccagttcccaataagttccttatttccatctgagaccacttcagactgaacttcattgtcaacatc

SEQ ID NO: 1989 - DNA, 201 bp, Homo sapiens
aaatcttctaaaattgactgtggtggtggttgcacaactctaaatatgctaaaaatcattgaattgtacactttaaataggtgaattgtatgtacagtatmtgaattacatctcaaagctatcttaaaaagataaataagctctgtgcctcattttgcctcctacagtgtttcgtaaagttgtagtactaaaagggagatt

SEQ ID NO: 1990 - DNA, 201 bp, Homo sapiens
cattacttatgcaaatttgtgcagctggcttgaatttctcccaagaaaatggttcttttattttctaccccatcatcaggatgcaaatattcaaaactttyatgctttgcttcctttttaaacataagttcctatttcagatcatttctctcaagttcaaagttccccagatcctaaaggcaggggtaaaatgctgccagt

SEQ ID NO: 1991 - DNA, 201 bp, Homo sapiens
gaatgcatgtgcgcacacatgtgtatacatgtgcatacaggcaggcatgacaggtatgtgcactgtttgtggtttatttatacattgcatgtgtgaaagcrtgtgtttgctcacatgtgtgcatgtgtgtgcatgtatgtgtgcatgcatgtgtttgcaagtgcttctacacacgtgtgtgtttgagcacatgtatgcatg

SEQ ID NO: 1992 - DNA, 201 bp, Homo sapiens
ttgagccctgagagggttgggtcctgccgagcctcacctgcaaacccagagccctgattttttcccagcccttagatgctcactacaaagactagtgtagagactcctgtcgggaggctgcctgagctggggaagctgtcactcacttggcgtaggctttttccagcaaggcgctccagaactcgttgtggtcggcagagt

SEQ ID NO: 1993 - DNA, 201 bp, Homo sapiens
aagtgctgtcggcacagccagaattcccctccgcttgccttcccagctcttccaaaggccagattcatggcccagggagaaaaagggtcatgaatgtagcsactgctcccaaagatgggcacatctaggctacgacaggaaaaccacctccaaccccgcttgagccctgagagggttgggtcctgccgagcctcacctgca

SEQ ID NO: 1994 - DNA, 201 bp, Homo sapiens
tacctggaaatggaatatcccggcataaccagggccaaagctttggtcctgggggatgactctggccagtgctttttgattaagcgtaagggaggcgatgrcggctaatagccagcagtctcctgcaaaatggaagccataaatcacaattttcattgctatttcacagcaaataggaaaactctgtgtcagaaggggatg

SEQ ID NO: 1995 - DNA, 201 bp, Homo sapiens
ctgcttgagtgagcaatctgcaagtcatctatggatggtgaaggaggacaaaggagccaacacaaatagctaacattctaaagaatcccaaagagtccaayggcgtctcacaccttggctccagtgaggaggaagggcagggtctcccttcagtgttctttactccccacgcattcagaggatgtcactcaaaaggtgggt

SEQ ID NO: 1996 - DNA, 201 bp, Homo sapiens
acattttatcatatacgattatttatcgatatgtcatatacgactttttaaaaataaaaaagaagcatcccgtaggacggacaattgatgtctctatatcmacgtgcgtaatagcccagatgtttgagccatgccagtgtccgagggaagtgtgaagcactaagtgctgtcggcacagccagaattcccctccgcttgcct

SEQ ID NO: 1997 - DNA, 201 bp, Homo sapiens
tctgcccgtctatcataaacagctgttgccttcttggcactgttataggacatgcttacttgggtttcagacatatggctgcctgatgcatcagctctgtraattccagcaactccctttccagaggaccaagactgcatacatcagtgtcagcacgggctgggcgagcagacatttcatagctgccacccaagtggttcg

SEQ ID NO: 1998 - DNA, 201 bp, Homo sapiens
acagcgaagtcagggagtcgggatggcgcctgcccctcccatcacccatggaggctgcatgagtggaagacaaattttattccagccttggctctcagtcmctttcttgatttctacctctgtgagtcccagaaaatgggagacaatggcccattttccctttataggctacgatctcaaagttgaggggcactgcacatc

SEQ ID NO: 1999 - DNA, 201 bp, Homo sapiens
ttacttgggtttcagacatatggctgcctgatgcatcagctctgtgaattccagcaactccctttccagaggaccaagactgcatacatcagtgtcagcaygggctgggcgagcagacatttcatagctgccacccaagtggttcggcagtacttgggagggtggttagaaatctccctgcagccccaacccagactcagc

SEQ ID NO: 2000 - DNA, 201 bp, Homo sapiens
ggatgtacttaatgctactcaactgcacacttaaaaatggtaaaatttatgtcatatacattttatcatatacgattatttatcgatatgtcatatacgaytttttaaaaataaaaaagaagcatcccgtaggacggacaattgatgtctctatatcaacgtgcgtaatagcccagatgtttgagccatgccagtgtccga

SEQ ID NO: 2001 - DNA, 201 bp, Homo sapiens
tgccgcctgtgtaagcagatatctgggaggatccatttatccgaatcacctttatccagattcacttgttttcagtagacaacatcaacgtcatcagaacmtaaaagcccatcacactcagcttggcagtttctgagttcacatttctggaaagcaccgtatgtcactgggcttgggacattgtaatatggccctttctgg

SEQ ID NO: 2002 - DNA, 201 bp, Homo sapiens
agctgaaggtcacacatcccatgagcgggcagcagggtcagaagtggcccccgtgttgcctaagcaagactctcccctgccctctgccctctgcacctccrgcctgcatgtccctgtggcctcttgggggtacatctcccggggctgggtcagaaggcctgggtggttggcctcaggctgtcacacacctagggagatgct

SEQ ID NO: 2003 - DNA, 201 bp, Homo sapiens
gcctgtgtaagcagatatctgggaggatccatttatccgaatcacctttatccagattcacttgttttcagtagacaacatcaacgtcatcagaacctaaragcccatcacactcagcttggcagtttctgagttcacatttctggaaagcaccgtatgtcactgggcttgggacattgtaatatggccctttctggctgt

SEQ ID NO: 2004 - DNA, 201 bp, Homo sapiens
gggggtacatctcccggggctgggtcagaaggcctgggtggttggcctcaggctgtcacacacctagggagatgctcccgtttctgggaaccttggccccractcctgcaaacttcggtaaatgtgtaactcgaccctgcaccggctcactctgttcagcagtgaaactctgcatcgatcactaagacttcctggaagagg

SEQ ID NO: 2005 - DNA, 201 bp, Homo sapiens
tcagaacctaaaagcccatcacactcagcttggcagtttctgagttcacatttctggaaagcaccgtatgtcactgggcttgggacattgtaatatggccytttctggctgtttgacacaggcaagagagactcgccagggctgaacatcgggaaagctaattccgaatcgccctggttctggctttctgagaggtgtcac

SEQ ID NO: 2006 - DNA, 201 bp, Homo sapiens
ggcctcaggctgtcacacacctagggagatgctcccgtttctgggaaccttggccccgactcctgcaaacttcggtaaatgtgtaactcgaccctgcaccrgctcactctgttcagcagtgaaactctgcatcgatcactaagacttcctggaagaggtcccagcgtgagtgtcgcttctggcatctgtccttctggccag

SEQ ID NO: 2007 - DNA, 201 bp, Homo sapiens
agttcacatttctggaaagcaccgtatgtcactgggcttgggacattgtaatatggccctttctggctgtttgacacaggcaagagagactcgccagggcygaacatcgggaaagctaattccgaatcgccctggttctggctttctgagaggtgtcaccagcagagtacaagccacccccagccttagctggagcacaga

SEQ ID NO: 2008 - DNA, 201 bp, Homo sapiens
tttttttttttgatagagatgtggtcttgctatgttgcccaggctagtctaaaactcctgggctcaagagatcttcccacctccccctcccaaagcgctgygattacaggtgtgagcactctacatgaccagatgttctagttcttattgtgggtggcaacagatcacggctgttcattttcttgttattctttataacat

SEQ ID NO: 2009 - DNA, 201 bp, Homo sapiens
ctttctctgtctcctccacactcaggcctgtggcgaactccctttgtttctcttcttcttgttcatcttgaagggcagcaggaggtgaacatagtgcctgsgtggctctgggatgccatggggcaaaaccccaaggacaaatgctcagaagcttcacatgggtgcagggagatgacctctaggaccccacccggtccaggc

SEQ ID NO: 2010 - DNA, 201 bp, Homo sapiens
agcctgtggtctggccaagtgatgtaaccctcctctccagcctgtgcacaggcagcctgggaacagctccatccccacccctcagctataaatagggcatygtgacccggccaggggaagaagctgccgttgttctgggtactacagcagaaggtaagccgggggccccctcagctccttctcggccttgtctctctcaga

SEQ ID NO: 2011 - DNA, 201 bp, Homo sapiens
aagtgatttctacatgaaatgaacctgacctggcatctggggccttcctggcctctcttttctgtgctgttctttctctgtctcctccacactcaggcctstggcgaactccctttgtttctcttcttcttgttcatcttgaagggcagcaggaggtgaacatagtgcctgggtggctctgggatgccatggggcaaaacc

SEQ ID NO: 2012 - DNA, 201 bp, Homo sapiens; identical to SEQ ID NO: 171

SEQ ID NO: 2013 - DNA, 201 bp, Homo sapiens
ccctcctctccagcctgtgcacaggcagcctgggaacagctccatccccacccctcagctataaatagggcatcgtgacccggccaggggaagaagctgcygttgttctgggtactacagcagaaggtaagccgggggccccctcagctccttctcggccttgtctctctcagatgtaactgagctgtgggctaggaggaa

SEQ ID NO: 2014 - DNA, 201 bp, Homo sapiens
aatgcacctgccctcatgccgggccccagagaggtaaacccactggcccagggctccctcttacctggaaatggaatatcccggcataaccagggccaaakctttggtcctgggggatgactctggccagtgctttttgattaagcgtaagggaggcgatggcggctaatagccagcagtctcctgcaaaatggaagccat

(The sequence listing continues in the following parts.)

What is claimed is:

1. A method of determining that a human has an increased risk for developing positive autoantibody rheumatoid factor (RF+) Rheumatoid Arthritis (RA) comprising:
   testing nucleic acid from said human to detect the nucleotide content of a single nucleotide polymorphism (SNP) at position 101 of SEQ ID NO: 5502 or its complement;
   wherein a G/G genotype at position 101 of SEQ ID NO:5502, or a C/C genotype at position 101 of the complement of SEQ ID NO:5502, is detected and indicates said human has an increased risk for developing RF+RA.

2. The method of claim 1 in which SEQ ID NO: 5502 is contained within SEQ ID NO: 1688, where SEQ ID NO: 1688 is the genomic sequence of the TRIP (TRAF interacting protein) gene.

3. The method of claim 1 in which the SNP is located at position 6497 of SEQ ID NO: 1688.

4. The method of claim 1 in which said nucleic acid is a nucleic acid extract from a biological sample of said human.

5. The method of claim 4 in which said biological sample is blood, saliva, or buccal cells.

6. The method of claim 1, wherein said testing step comprises nucleic acid amplification.

7. The method of claim 1 in which the testing is performed by using detection reagents comprising the nucleotide sequences of SEQ ID NO: 6629, SEQ ID NO: 6630, and SEQ ID NO: 6631.

8. The method of claim 1 in which the testing is performed by a process selected from the group consisting of: allele-specific probe hybridization, allele-specific primer extension, allele-specific amplification, sequencing, 5' nuclease digestion, molecular beacon assay, oligonucleotide ligation assay, size analysis, and single-stranded conformation polymorphism.

9. The method of claim 1, further comprising correlating the presence of said G/G genotype or said C/C genotype with an increased risk for developing positive autoantibody rheumatoid factor (RF+) Rheumatoid Arthritis (RA).

10. The method of claim 9, wherein said correlating step is performed by computer software.

* * * * *